United States Patent 10,724,096 (METHODS AND COMPOSITIONS FOR INHIBITING AND TREATING NEUROLOGICAL CONDITIONS) - sequence listing, part 107

SEQ ID NO: 1967 - DNA, 860713 bp, Homo sapiens
tctcttgacagaagaaaaatgagccttagaaattgtttccaaatcctgaaagagtcatcattccatgtactcaggacagatttagagagtgctgaccctgccctttgaaagatgttatttgcctcttagtgcccaaataaggaaggataattaggaatcagaagcctacctagggctcccctctctcctctcaaaattgcacttggtgtcatattgccctagaatttatgcctggtgctggcaaatatttttaaatttattttttaatcttttccttttctgcaatcaaatttcttgaggggctgagaagaagaaataggcccagagagaagcaaggcagtctgggtgcaggctctagacagcccagggagaagaaagagggagcagctccctgtgtcctggagggagccctgtccccattgggcttcctgctctgatgtcccctagtggaggctcctcagggagtccagcctcccagaactgccctataaacctcacagtgagctaagcaagtatatccaggaaggagggtctgtggagatgtgagactaaggtgtgttatggcctaaacactgcccatctccatccttcttggggatgacaaagtgaacagtggaggagacaggatacatgggtgcatctggacctcaagcagtaggctgttctgtggtctgtccctaaatcttgtgctggagaccccatacgagagccactccctgaccctgggctggagccctctaccccctgctcacaagaccagcagctgtttccttataggcccccagggagccacagaacagcatcaaccaagaccatcctcttcatgtgtcagcttttcagggagggatcgaagtcatggcccaggaaagggcttggacagcccaggggaggaggctggttggtatgaaggatgccctcctcaccctgagctgctggagggagtacaagggacttggagagcccaggctcagttgatgatcctcaggatgtagagctatgtatgggtctccactgtggtctctcccccgccttctccttcactgcacaggtggctagggctcagtgtcagggctggtgatcaaaagaccaaggtttatgcatgtgtctctgtccactgacccacctctcaccctgtgtctgtcttaatgtccagcgtcctgagcccagcctgtgctgacccagccacctgcagtgcatgcatctgtggggcaggtgggtaccagctcctgcactagaagcagcagcaatgttgggcacgggcatgtgctctggtacaaacatgcctccgagagacccagagctccacatatataaaagcagtcattgacccttaggggcataggcccaatgctgaggctccaggttggagaacatggcctctctgagcatctctggactccaggcagaggaaaaggctgatttttattctcagcttgggacacaagcaccaaggctcaggcagtacttcaggccagtggggaagtgggagaaaaagctgctgcccatccagcaatggagcttctctgtgcagcccccacttcttgggcaagtcagctgattaacgttgcttttcatttgtttagtaaaaatttagattttaaaactcactccagtgaacgcagtgtggagaatgtgtttctgtcctctcaattctaccctcacacccaacccttggcagtaacaaattgtcgtattgtctcatattaagagaaatccctcaataccaagatcaggctgtcctggaaaccaaatccataatgggtcaaaacaggaccagggtcattgtgtctgactcaggatagtcgactcccaaaggtctgtttatccacctcattcactgagaagctactatgcaccagcctcagatccagggattcaaggtacatgatgaacaagagaggaaggggccctgtcctcatggagctgacactgagtggtggaacagataaggcaatcaagtaaaaatgtcaatgcgacaatatgatgtcatcacacagtgaggagagctcagttgggggtagaggagccatcagaaggttgggcaaggaagacacaggatctgactcaagtttatgaagaaaagtccagatgcctcaaagaagatgaacaaggagacagcaagcatgaaggccacggggccagttggggtcattggagagaaaggtcaggtctagcctgtgtttgtaagaggagggactgaagcctgggtgaggagagagggctcaggaatagccttggaaagtggagggagtggatgcgaaacccctgctgagggggcctccatgagcaatgaggctgggggaggccctgagctaatcaccatgatggaaactcagacaacagcctcccagcctctttcaaagttgtcacaggacgcttttctctccaaatggcaaggggggaatcccactatgagttttatttgagatgtctcttctccatgtcctgtcctgtccctaggctaaattcccatgcgcaaacaagatactgctcagtctcaggtatcacattcacacacaaatgctccagaatgagggaatgcactctgaccaacccaccaggaatttttgcctttgagaatactagatcagatcactcacaccatctcccctgacaccatcatgttgaccagtgggttgtctgatcggtttggacagcagaatgcagatgcctgtagttgcagctggggtcagtcacatgctcatctcatggctgggagactttgggtccagacaacaggaaaaaaaggaggtttgcctacgtgatcccacaatgtgcatcactctgtcatccactcccatccttagttcatgttgggttttgtcctgtagatgctgggacctggacaggatcacaagccaggcgatttctggctcacaaagttacagctcaagctccctgatgttgctgacattcttcccacagaccaattttagacagacacactattgccatgcaggcactgacctgagatacaggtagtctcaggagagggaggaagcagatacacatccccatgatggcctccttgtcccagagtgggtaagaaaggcaaggaggccaggaagccacaggagtggccactgcccaccacctgtgcacctgtccctccctcaggtgagaagcagcctgagggtccagcacctgcaccttttcccagtgcccacacacttccaagtggggcctccttctgctcacctcccaaagctactgctttccgggacatctgtgtcattgctgagagtctacttttcatggggcccttgtcccagtggtctgggatcagtgtcagcctgtttaattcagcactgtctctgtcctttcaggacaccaatctagctattaaagctctaattgaattctcctttttttgccctgaaactttagactctccttctcagtgtctctctagaatattttgtctctatccaataagatcaagttatgtcttcaggcctacagccacttctttccccaaattctgcaccttcttttaagttcttattccctcttatggcttattttccactaactagctaatgatgccaaaacatttatctattttacctccttcaggaataaaaaagaaaagcatttatcaatagcccattgtcacaaagaaaggaacagaggagagatatcttctagaaaaatacaggtgaacaaggaaaaagttttaattcctcataggaactactccatgatccaagaaaataaattccagagattcaagagttcactccttagaaacaacagtgtaaatacaaggtagtaaattttcttggttttctcaatgaataacctcaaaagggttagagtatgattataataaaaagattatacattactttcaaaaatgtaagatgaacatgtcaaaaattttaatcgactcatatttctgaaaagaccagtaaaatggtgaataattttaaagaacattttaaaacacacagagtttctattccacgagggcaggacctgtgaggataatttcctgtgttagagaaacactgtcctaaacaacaatagtagaactctctaagctctgaatttatcttctcctgtaagaaaaaatctacaaagtgacaggatccaatttatataaaatatctagcaaagattttggacattcccatctcacacctcctctccaggctctcctcaagtgaaatctactctccttctgcccgtgttctcacctttctgcacgcttccgcctgctgacacatggcttctcctgctttcctttccagtagccctaacagatcaggccctgccagtaagtaagctcctggcctgagggaaccacatcgcatgttactggatttctgaggcacttgccctgccagggtctctctttctgaatcacaatccctgtattcctgggaattctcttctcctggattctgttattcagctctgtgtttctccctccatatctactttgtgaatttctctacatcttcacctgaatcccaggaagcctaaggacatgctgatgcttcctcagttctcatgtcacaccctgttccctcctcctctatgatcccaccaggtcatcctgcatcagaaccctgagtgcggcagaggcttctctggcctccttacccccagtggcagaagggaggaagggaggtcccctgtggcctcccatccttgtgctcccattagggtcagcatgaagcaggaatgaggctgtctatatcatcatggcattcccaacactaaactctgtgcccaggagaaggtaggcactcaataactatttgacaattgaagaactgcctctcaccacactggccacattgtactggactcaggatggggctgaactggaagagtcagctgtgaacctgctcttgtctctgccctcagcctgagagctgaaggggaacctaacagggagagcacccatgggcagggaaggtacattagtagcctcatcctgtttgtgaggctctgctcagccttgggaatccctgtttattcaaggcagagaagaaggaaaacaattaaccaggcctggccaacaggcagcatctacaaggcgatgagttgagggccagatggtcagagttggttctggcatctctcaggcgcctctctccatgttgcccttttttgcgatccaggggtgaggtttcaccccactgagcccccacccatctagatgggctctgctgagagaaaaacccattttctagatgagcccactgaggctcaaggggcacatgtacttggtgatgcaccttcttcctttagagactggtcagcctagaacaccccctctcgagtggccttctggtccctcatctgcccagccccacccagatctccatgaacctgagctgtgtgagagaagagggaagagtaggaggaagggaggagtccaggccatggtgtggatgttgcaggaacccctgggtcttcaaactgaggctggacaccgcaatgttctttttatctccctcaaattttttggtaaaatgtcagtgcttgtctggtccattattcaaacctgattctttttaccaccatcataggcatacatttctgagtcttcatcccagagaacagctcctctctaaaggggaggtgtagggtggctgtgagttctgagtttgcccctggggaggaagcacctgctccaccatgtgcacaggcctgtaagcaagagtccaactttgttgaaataggaaccatttgagtttgcttcaggccttgctgacctcagaagtttcacattgtcccctggtgacctcttcacaatgatgttagtggtgatggaacaatgcaggacagaaggccttccttactttctttcaacaaaaaaatggtgtattatctagcctgacagtaccctagctggagacagtgaaaataatttacattttaaacaaataatgtttgttattttttcaatctcatgagtgtaagataaaagtaatcctatctcaataccaaaacaaacaaacacgaaaaaccagaatctgaggagactgaagtgtgttgattgagagacagtaagaataacttagtccagctcccctgcctggctgtgaaatccaatgatccagtgtcccactctacagacaaacctacaggtttttcacccaatgcagacagaagacatggtattgaattcatgagtccccgctgagagtcacaataggctggtgtggcacaatgcattatgggaggcacagaatgaagggacaacatgtattcagtggattctgctctcttatcagactgagtcactgcacagactgctcacagggtttctccactgcattctgcctcacataaataaacaccaagagccataggatattagtcaattatattttctccttcagtgtcatacttgagatctctatcatatttgaaattggactcagagagcttcaattattttgttgcaatatatattatctttacaaaaattacctagactactgtgtttctgaaaaataaatcttacaatttattttacttccatgatggtattaaacttgaatggttagcatatcagccagtagtgtgtctggggctggacaacagagagtgtttggggtccattcctgaagggtgtgtgtgtgctcagagctggcatcatccacctattctgactcctgccctctgctaagtcctcacagctgtgaacttccaaacccctgggacaacacagctccactcctgctcattcccctgatccccaaaggcacagggccctgatcctgacccaaacacagagtgggatcaaaaagctgagaggttgtcacttgcataggtggatttttttcctcaaagagtataaagagagggagaaagattgggagaagctctgcggtagctgtaggcacagaaggcaggaatcaggccaatctccaccatggactggtcccctctcctcctcatactcctcactcactgtacaggtgactagacacaggcccaggggaggagccctgggaagcccaagggactctgctttctcatcttgtctctagaacagtatcaccacttctgtgtctcttccacttccagggtcctgggccaagtctgtgctgactcaacctccatcagtggcaggggccccaagatagagggtcactatctcctgcactggaagtgccaccagcactgggggtggttttcatgttaatgagtactagcagctcccaggaatggctccatagctcctcatttgtgaaaacagccattggccttcagggttctgtcctggttcacaggcttcgctgagcatttctgggctccagtctggggataaggctgactatttttctttatcttggcacacaagcattaatgctcacacagaactgtaggccaccggggaaggaagacaaagatatgctgtctttccagtgacagagtttccctgtgcagcccccaacccattcaccaaataagtgcttaactgtgattttttttggtggacaaaatgtggagtatgagaagcactgaagcaaacatggtctaaataatgtttcccagtcctctctcaattctacccccatatccaacccttggcaataataaattgtcatactgtcatatattgaaataaatatctatattagtccattctcacattgctataaagaactacctgagacagggtaatttatgaagaaaggctcacagtctttaattgactcacagttctgcaggctgtacaggaagcatgaattggaggcctcaggaaacttacaatcatggaggaaggacgaggggagcaagtacatcttgatatggcagagcaggagagagagagaaggggaaatactacgcacttttaaacaaccagaactcacaagaactcactcatgatagtgaatcttaagaacagcaagaaagaaatctgcccccacgatccaatcacctcctaccagcccctcctcagcatgagatttgggtggggacacagagccaagccatatcaattcctcaataccagggtcaggcttccctgggaaccaagtccatcatggatcaggacaggaccaggaacacagcacccactgtgtctgaccaaagagcctcaactgccagatgtctgtccatccacaccattcaattagcacctactatgtgccagccttaggtctaggggctcaaaaacagggtggacaagacaggaagtgtccctgtcctcatggaccagacaccatctggtggaagagatgagacaattgagtaataatatcaatacaataagatgtcatcacttagtgaggagaggagaggagagctcagtaatggtggtagaggagccatcagagggttggacaaggaagacagaggatctgagctaagtttgtgaagaaaagtccagatgcctcagacaagatggacaaggaggtgggaagcatgatggctgtgggtccaactagggtcactgggggagactgtttatacccagcatatgtttgtggggaggagggactgaagcctgggtgaggggagagggctcaaggctggccttaggacatggacaggatggtattgagtcacgctgcagaaggagccttcatgggcaagggggctgggggaggccctgagctcattattccaatggaaatatcaaactgcctgttagcctttgtcaaaggtatcaaagagactttttcattcaagatggcaagagaggaatctccctcttagacttctttgagatattctttcttcatgaccgtttcttgcccctggatgaatgctcacatgggagcaaattacctcctcagtcccaggatttcaatttgcacacaatccccccagaatgatcgagacctgccatccctgacccactgatcaggaattctggccttcaggacaacttgaccagatcagtcacaccatgtcccctgacaccatcgtggtgactggggtgaactgtcagactggtttgggtaatacatgtcctgtccctggagttgcagaacctgttcagaaagataatggtgtggatggagggaggctaattccagccacatcagaaagcaagaaagacatggagaccacccttgagctggcacagcatccttgggtctcacatgtgtctctagcgactggaaaaggaactcagatttaactaattctattttctcatctgtcactctccctttcactactgactcctgaagccccaacaaaagcagcactatgggattatggtcatggaatagaggccttgctgctgaacttttcttttttattctaaaaagtacaacacagataatgcatattaactaaaaattataaaaatgtatttaaatgatgtgacaatgaatgtataaggggttaataggagaaaataataaacaatgttaaaaaatacaaaataccaatacactataagagttatactatgtcatggattgtataaatcagtattgtaaagatggcagtgtcctaggattaatccatcaaattaatataagtgtaattaaaatttcagtaatattttaggaaactgcttaacttattttaaaactcaaattgaaaattgagataaaaattacctaagattatttaccaaaaatttgtaatggaagtgataccagatattgagttatttgaccaagcaatattagctaaaatcatgcatgattgagatcttgacatttacataattctcttaaaaattagagtagataggactgatgattttttatgtgaccttggaaatatggctaactctgttcataaaattaagtagagtacctaattcatacttttattaaaaaatccaaacagatttaaaatataatttagaaaagaaaaagtttaaaaactttagtttggaaaaatagaaatattatttttatttcatatgagaaagtacttcttaaataaacccaaaagtcaattcataaaagaaaatttgaagtatttggttgcaattatttgaagctttttttttcccaaagaggaccacagttggtaaaaagagagaaggatatgcaagagtggaaagacattggcaaggacaaagtattgctgtttgcatccagaagacaactttgaaatgagcgaagacagaaaaaaaggaaacccagtaaaaatgttcaaaggacacaaacaagccattcacgggtctcaaaatgagagcagataaatgtgacatcaaaatatgttaaattccaccagagacaaagagaagggaataagatcttcaagtagaaattgtggaatgagccaagcatgtctgtgcatggggagctttccaggccttgcaaaaagcaaagagagtaagaaaagagcaagaagggagtgagaagcccttttgtagagaaaccaagaaaagaaagtttagagtgttagagcctgggccagaaagataaaagagagagaagaggtagataatgtgggatttgagtgacctttgattcctgtgggcatacttctgagtaagacatgaagccactgagggtggaaagctgttaaatgatattgcaaatttaaataaaaaaaaaagatgccagtgaggatgtggggaatcccaaactctcactcacagcaggttgtaaaaacaaattcagctattttgagcaaagtccctcagcacgaagataccttaagagggtgagcatctgtcttgcaccaagtccactctgtacagagacacaaggaaatgtttatgagaaggtccttactaggggaaaagtataaaaaacaagctagttgtcaaacacaaggggaatttataacctgcagttagctgatggaatgctaactagttggaagtaataaaataaaagtattattatgagtttcaaaggcaataaatatataaataaaattaaaaagccaagagctaaagaaataaattattttaaaatatgaacatgcactataattttttttaagtttataccatgagctatttgaaagttagactggaagcacattatatacacttatgtaagagcctctgaaaaagatggaaacacatacgaaggttaaaagataatttaaaacaatagagagttatttcagtagctgaagatatgagtgccaataaaatgaatgcgattcaaccctgtgagcattgctttcataaaaaaattaaaacagaaaatgaatattaatagatgacttaagtgaaatcacaatgtatgtggtgatacagctgaaagacaaacgttttgttagtaagaagggcatcgctaagcctgatgagtgctttgtttagaattcccagctaccctggattcctctccaacctcatgaacagcttcagaaaagaggatcaggacaaccgatgctcctctcattgaaatgcccggatgtggcagagaggcaggaaatattttgggtctgaggacagtgaggatcatcactgagatgatcctgcccaaatgaaaaccactcagggcctccaagggagttcagccatcagctcactggactaggtttgggatgcaacactgacctgccccgacccagagtcataatgagccaggccacctccacccactgggtcagctcatctcctctttatcttttctccttctgacctgtgagtacccagatcagggtggacaagtaagagacacatagcaaggtcttatgtgaatacagtgactctaccttacgacgtttttgggagatacaaaggtacttagaggagctcagtttccaaagcagtgctccaggaagctggaaatctgcactatgctctgggctcctctcctccatctccaccctcactattcaggtgagaaagaaccttatgtcgggggatccacacccagctctgctccataccccctcactctctggctcactgggttgtaaacctgctctcatggccctctctgtccccctgcagtgtctgtggcccaggcagggcagactcagcagctctctgtatccaagggcttgggatagacaaccacactcacctgcactggggacagcaacaatgttggcaaagatggagctgtctggccgcagcagcaccagggccatgcccccaaacacctgatcaacaggaaaaacagccaactctcagggatctcagagagattccctggctcccggttaggaacatggcatctctgaccatctctggcctccagaccaaggacaagcctgcctattactgctcagcctgggacagcagcctcagtgctcacacagcgcctcaggggaagtgagacgaaaactcaggagctcccctagcttcactcggtatgcgggggcgtcatagagcactgtttaaactaaaccaaaaatgacaagggctggtttccacgtgacaaagtgtgtgctattcaaaactattaaaaataatatcataagttaaaataactaaatctgcagtattaatgaatatttataggaaacattgttgtgaatatatttgtggctagatacttacatgaacatacacatgcattaatcagtagtaaaaatgaatgcaagggtaaactaaggaaatatttattttcccagattttccttctcttttatttggagatgctggactaaatgctcagaggttccggtggtctgcctttgagtgtgtgttcagcagggtcacctcaagcttatcccaccttcttatgacctgggcccatgcctgtcctctcattagaatcccctttccctctgtcacagagctctctttattccttctacagacccagacttgttcctcacacttagttgaggcttcctgggccccacgtccctgtttgcccccaacacccacacaagacaatgatcccatgtgtgtgctcttgttgtgccctttccttatcctctgacatacctcaggcagtatctggaaagaacaaatgaagtgggagcgttagcttgtagttgaaaatgatttttgatattttggggaaaatatctggtttaaagatagttttccatcgagataaaaatgcatgtgtgacagcaccacatttctaatggcggaccaaagccccccacatctttgccccccacatggctccagggacattgacttgttaatatacaacccaggagagagcactgtgtcctatgcaactgcaatgcagaggcaggtttctgcccgctcctccaatgaagtgagtagcaaccccaaccccatcttcacccatcatttagatgacccccatacaaccacaacatagaaacacattgatcaaagggcctttttctctttgcagagacccctatttgtttatttggcatgtgagattttagacttttaccaacaattaaaatatactttattagaaaagttacacttcttaagaaactctgattcttactgtgaagttaatacctaatgcatcctataagcatagtaagtggaaaattgttctgtaaggagaagattaatcaatgaaataaaatacaagtatttgagagcaatctaataggtaaaagattagaggacataattgtgaatgccaggtgcaatataaaggaaatgtgggccgggcatggtggctcaaccctgtaatcccagcactttgggaggccgaggtgggcggatcacctgaggtcaggagctcgacaccagcctggccaacatggagaaaccccatctctactaaatatacaaaaattagccaggtgtggtggtgcatgcttgtagtcccagctactcaggaggctaagggaggagaatcacttgaacccaggaggcggaggttgcagtgagccaagatcacactattgcactttggcctgggtgacagagtgaggctcagcctaaaataaaataaaataaaataaaacaaaggaaatgtgaatacctagagttgattaaattgtggcccctcaccttcaacactcgaaaagctcagagtgggtagaaaagcttgttgagttatcttctgatgtcattgacaagataaatcagggacaatagaaggaatatgtggaaagaggtgccagaggctagaggggaaagtgtgaagtagccagcagagaggagcctgctggctgactacttgtgttagtagtagcaggtggtgttgacgccatctcccaggggaaaaccctgggaaacaggaaagctaaaagcaggctcaccatcctcatccctaacagaaccactgaagtgagcacaccagagtgtggggttccctcccggctcttcagatgacattgttatttggcaccaagctgatgttagtatgttctttataaatatatattgcacaaagaattgcataaaaccttcaataatttaatgaggactttctcacttaaaaaggtttttatgtctcttctgtggcccccataggtagccggggatccctcactgcatttcagtctgacaactcatcacatggacagagtccaccgtgtgtgactgtgtgtctgtgataataggtggcaaagcttcactgtcatagccgcacctgcttcattgcctggtgcttgcctttctgaaataggaaaataaactcttaccaatgtgtcataattaggttctatttaaaatctcctaccaaagttaagagcagcctgcacaactggtccacaaaatgagaaacctccaatttatttggactcttttctctaccctacccagtgatccaactggtcaccagccatgtggattctctctccaaaacgcttttaaattcaactctcctgtttactttccattctcatgtcttatgtcaaatattcatgtcacttacctagttctgatcagttctctggctccatggacagctcccccaactctgccttcctgaccatctctgggctgcggattggagatgaggctgacttctcctgtcagtctcatgatgaaagctacaatctcacagtgctgcaggcccattgggcagtgacaggaaaactccccagagcaccctcaccctgagtctgccatcagcctctccccaccagcatgggttgctttttcctgtcccctgtttgaatgtttgaattcaaattttctgtttatgtgtctctctattttctttccaaaatacacaactttttctttcttgtcttcatggatggtttttctggtccctgtgaaattactttatgaagaatatttagtttaaaacatagtttctgaacattgtcattttaacattgtgcactgggtcattcattgtgtgaggggggctgttctgttcatggttggacatttataagattattgggactcacacatcagatgcctatagcaccctaattcccaaattctaacaaacaagcaaaaaatgtagacattgcaaaatatcctagggagacagcactgcagaatcacccttgtctgagaaccactggattaaaaggacatggtttcacgtattgggcagccttttgtgttgaaccctccttatcccattccactgaatataaggctacatgcattatatctcgatggttccaaatttcctcttaaacaaatgtgtgggatacaactccaaaggttatgttgacagatgaataatcctctgaacaccattagttcagaaaacctgctacccaatgtacagcatctcttgctgaccagagtgtggagtgaaacatttgaccaaactgtgtgcataattgctaattcaaatttttaggtaaaacacctaaaacataacacattcttctctacttatcctcttaggggttgcttttcaagcatggtgtacaaaattatgacaaggcctcgtatgtgtggagtttacattttagaatgggtagacgacagtagacaagagcagcctcagaactgagcagtcagtgaagtcctttttttagccctagcgctggatgcaaattttaccagctgccatttgtgtttttgggcttgctccacccagtacagtccccatgaactgcatgttgatatgtatatttcaaagttaattaattaaaactaaataaactttaaaaaatattcctcagccacaccagcttcatttcacctgcctcctggactcatgctctccatccatggctctcatgctggagagttcagacacagggcatctccaccatggcataaagttctactgcagagcacagtctgtgacaatctatttaacacttccttaggccagtttcttcattacctgtaatggggatatagtaacactcaagttctcttcacagtctggaacactattctctgtgggagtattacctcggccccttcttcctacagaacggaggagtgataatgtaactagtattggccaataagatgaacagaaatgagaggtgtaatttctgagcagtagatgtaagattagcctgtgctttgtcaagttctatcatctctgacgtaacacccacagtgttctcacagaattctctcaaccatcctgcatcctgggatgaaggtgaagtgaactgaagccccaagcatttcaatcagagatgggaatggtggaggagtgagaaatatacattcgttgtgagtcaccaagatttctgtcaatttctcactgcatccaagcctagccagtactgagtgctatggaaattataagtgaatgtggggagccacaatgacaaaattaacatctatctataaatatatataatatatattaattacattatatcatatactaatattaatatataataaatatataatatataacacttacatattatataagtatataatatataacacttacatattatataagtatataatatacaataattaatctatattacatataatatattaatataaatatatatacataatttgatttgatgcaatactgtgaacatttagtagactacggagattgcatgatgtttcattttattcactggcaaatatttaattaagctgtcaccataataaacattaaaacacacagaattgacaaaataattctcctgagctgtggatatacaagttagacaactgattagaagcataggttcactcctgtgccatttgtggaatttttacaacttatttactttaagtgatgattttaagcataattggtttttgttcttgctttttatttattcaagcagaagaaagacacaagaatgataacccacatacatacagagtagtagaatggcaagagctaattattctcaaacacaaattcttaaagataaatgtaaaatatttgaattaaacattttgctatccaaaaaaaggtatgccgtttttttcctgagtactccagggcaggaaagtatattcatcaatccccctggtgtccgctttcttaacacattgttcatattggtatatatttttttcttattacttaacttactcatcctatatattgtgtttcctaaatatatttcaaattcattctcagccttgtgatttccctcgccctcattatgtcccatgtcctgctggggctcccccataccacccctctcctcatctgtaatgccccctcccagttcctgccctcctgggaactgctgtgctcttttctgccctgagccttgttacctccttcttgtactacctatttgtctcagtgagctcctcttccattcttcaaaggctccagagccctagagaagagcatcatctcaaaaaatttcccaagaagctgcaagtaatgagagtgtctaagaccactctttctgctttatggcaattttatatttaacgtggtattgagtcttgctgaattttcagtctgaagtcataatgtgctcaaatatacaaattccagagacacagagcagaatggtggctgccaggagctgaggggaggaggaaatggggagttgctggtcaacaggtgtaaagttttagttatgcaagaatatgttataaagatgtgctgtgcaacacttatctaaatattaattattaatcaaacaaaaaattcaaaattattaacacacatttccccctgggtttactggacagatgattttatatttgtctctgctaagtagactaaggtgtaaggatttggcacgaaagttgtaaaccacaaacccagccaaaaacaaaatattctttatacagtttttcaataaataaaattaatttaatattgctagtttaataaaatagctgtgtcttctaagttatagataaattttgcatatttttcactttaaggatcttacttaggtaaacaactgcatataccaactactaatattactaagaaaaaatgatttagagaaataaaaataattttcttgtgtctcagttttcacatataatctaaataaatttttaagtaactaaattagatgaatataaatgaagtaaacacttctatctaaactttttgtataatttaaaatcttaaaaaataaattaaataataggtactcttaaaaaagtgtaggtcatttaaaattaaaaatatatattttggatatagttataaaaatattaaaatagttctcatgtataaaagatgaatttatgagagacaattcaaagtttcttacatcctaggttttgagtaaaaattattgttaaaataattaaaaattctaattaatatataattcaatatataaaataagacaaaaataaaaatactaaatatatgtttttaagttaaaaaagcaaagtcataaaatatatgctttattaaaataattttgccaagttaagatgttatataatggttacttataaagcaatataaaataaattagagagatataaaatattataaatatagatatctttttgtaaaaaacattagaacataattttatattgaacaatcttatataatttttgtcctaaaataagatgatttactattttaagaagacaaatcaaaatgtcccaacaagtcttagtctatgtaaattataataaaatacatttgggaattatgtcccaacatatcttactctatgtaaattatagtaaaatacatttgggaattatttaataaaattaagtataattaacaggactataattttaaaaattatgtcttcctaaatattaaactttaatattgaaaatacacaaatacaaaactgaatattttgattttctatgtccaaacacagttttcttaatattaatttactctaaataaaagatttaaacattgatttttaattttaacatctatttctctttaaaacttctcaaaattacacttcaaaagttcaaattttgttaatattttcacacataatttacagacttttattgtcatacctttcaaaaaaatgtaatttttttacttcactgggacaataactcttttctttaacctttttttaaattattatactttaagttttagggtacatgtgcacaacgtgcaggtttgttacataggtatacatgtgctatgttggtttgctgcacccatcaattcctcatttatattaggtatttctcctaatgctatctctcccccagccccccacccccaaacaagccctggtgtgtgatgttccctgccctgtgtccatgtgttctccttgttcaactcccacttatgagtgagaacatgcggtgtttggttttctgtccttgtgacagtttgcttagaatgatggcttccagcttcatccatgtcactacaaaggacatgaactcatccttttttatggctgcatagtattccatggtgcatatatgccacattttcttaatccagtctatcagtgatggacatttgggttggttccaagtctttgctattgtgaatagtgccataataaacacacatgtgcatgtgtctttatagtagcatgattcataatcctttgggtacatacccagtaatgggatggctgagtcaaatggtatttctagttctagatccttgaggaatcaccacactgtcttccacaatggttgaactagtttacagtcccaccaacagtgtaaaagcgttcctatttctccacatcctctccagcatctgttgtttcctaactttttaatgatcaacattctaactggtgtgaaatggtatctcattgtggttttgatttgtatttatctgatgaccagtgatgatgagcattttttcatgtctgttggctgcataaatgtcttattttgagaagtgtttgttcatatcttttacccacttttcaatggggttgtttgctttttcttgtaaatttgtttaagttctttgtagattctggatattagccctttgtcaggtgggtagattgcaaagattttctcccattctgtaggttgcctgttcactctgataatagcttcttttgctgtgcagaagctctttagtttaattagatcccacttgtcaattttggcttttgttgccattgcttttggtattttagtcatgaagtctttgcccatgccaatgtcctgaatggtattgcctaggttttcttctagggttttttatggtgttaggtctttttttttttttttttctttgagacagagtctcgctctgtagcccaggctggagtacagtggtgtgatctcggctcactgcaagctccgcctcccgggttcctgcattctcttgcctcagcctcccaagtagctgggactacaggcacctgccactgcgcctggctaatttttttttgtattttttaatagagacgtggtttcaccgtgttacccaggatggtctcgatctcctgaccttgtgatctgcccgcctcggcctcccaaagtgctgggattacaggcgtgagccaccgtgcccggccatggtgttaggtcttcattcaagtctttaatccatcttgagttaatttttgtatactgtgtaaggaagacatccagtttcagctttctacatatggctagccagttttcccagcaccatttattaaagggggaatcctttcctcattgctttttttagtcaggtttgtcaaaaatcagatgattgtagatgcgtggtgttatttctgaggcctctgttctgttccattcgtctatatatatgttttggtaccagtaccatgctgttttggttactgtagacttgtagtatagtttgaagtcaggtagcatgatgcctccagctttgttctttttgcttaggattgtcttggctatgcaggctctttttaggttccatatgaactttaaagtagttttttccaattctgtgaagaaagtcagtggtagcttgatggggatagcattgaatctataaattaccttgggcagtatggccattttcatgatattggttattcttatctatgagcatggaatgttcttccatttgtttgtgtccccttttatttcatcgagcagtggtttgtagttctccttgaagaggtccttcacattccttgtaagttggattcctaggtattttattctctttgtattaattgtgagtgggagttcactcatgatttggctctctgttagtctactattggtgtataggaatgcttgtgatttttgcacattgattttgtatcctgtgaccttactgaagttgctaattagcttatggagattttgggctgagatgatggggttttccaaatatacaatcttgtcatctgcaaacggagacaatttgacttcgtcttttcccagttgaataccctttatttctttctcttgcctgattgctctagccagaacttccaacactgtgttgaataggagagggcatccttgtcttgtgctggttttcaaacagaatgcttccagtttttgcccattcagtatgatattggctgtgggtttgtcataaatagctcttattattttgagatatattccatcaatacctagtttattgagagtttttagcatgaagggctgttgaattttgtcgaaggccttttctgcatctattgaggtaatcatgtggtttttgtcgctggttctgtttatgtgatggattacatttattgatttgcatatgttgaaccagccttgcatcctagggatgaagctgacttgatcgtggtggataacctttttgatgtgctgttggatttggtttgccagtattttattgaggattttcgcatcaatgttcatcagggatattggcctaaaattctctttttttgttgtgtctctaccaggctttggtatcaagatgatgctagcctcctaaaatgagttagggaggattccctctttttctattgattgaaatagttttagaaggaatggtaccagctcctctttgtacctctggtagaattcggctgtgagtctgtctggtcctggactttttttggttggtaggctatcaattattgcctcaatttcagaacctgttattggtctattaagagattcagcctcttcctggtttagtcttgggagggtgtatgtgtccaggaatttatccatttcttctagattttctagttttcttgtgtagaggtgcttatagtattctgatggcagtttgtatttctgtgggatgggtggtgatatctcctttatcattttttgttgtgtctatttgattcttctctcttttcttctttattagtgttgctagcggtttatcaattttgttgatcttttcaaaaaaccagctcctggattcattgattttttgaagggttttttgtgtctctatctccttcagttctgctctgatcttagttatgtcttgccttctactagcttttgaatgtgtttgctcttgcttctctaattcttttaattgtgatgttagggtgtcgatttgagatctttcctgctttctcttgttggcatttagtgctataaatttccctctacacactgctttaaacgtgtcccagagattctagtacgttgtgtctttgttctcattggtttcaaataacgtctttatttctgccttcatttcgttatgtacccagtagtcattcaggagcaggtttttcagtttccatgtagttgagtggttttgagtgagtttcttaatcctgagttctagtttgattgcactgtggtccgagagacagttttttgtgatttcttttcttttacatttgctgaggagtgttttactaccaattatgtggtcaattttagaataagtgcgatgtggtgctgagaagaatgcatattctgttgatttggggtgtagagttctgtaggtgtctattaggtctgcatggtccagagctgagctcaagtcctggatatccttgttaaccttctgtctcattgatctgtctaatattgacagtaggatgttaaagccttccattattattgtgtgggagtctaagtctctttgtaggtctctaaggacttgctttatgaatctgggtgctcctgtattgggtgcatatatatttaggatagttagctcttcttgttgaattgatccctttactattatgtagtggctttctttgtctcttttgatctttgttggtttaaagtctgttttatcaaagactaggattgcaacccctgctttttttttgctttccatttgcttggtagatcttcctccatccctttattttgagcctatgtgtgtctttgcacatgagatgggtctcctggatacagcacactgatgggtctgactctttatccaatttgccagtctgtgtcttttaattggggcatttggcccatttacatttaaggttaatattgttgggtttgaatttcatcctgtcattatgatgttagctggttattttgcccgttaatgatgcagtttcttcatagcttcaatggtctttaccatttggcatgtttttgcagtggctggaacctgttgttcctttccatgtttagtacttccttcaggagctcttgtaaggcaggcctagtggtaacaaaatctctcagcatttgcttgcctgtaaaatattttatttctccttcacttattaagcttagtttggctggatatgagattctggtttgaaaattcttttctttaagaatattgaatattggcccccactctcttctggcttgtatggtttctgctgagagatccactgttagtctgatgggcttccatttgtaggtaacctgacctttctctctgggtgcttttaacattttttccttgatttcaaccttggtgaatctgacaattatgtgtcttgggattgctcttcttggggagtatctttgtggtgctctctgtatttcctgaatatgaatgttggcctgccttgctaggttgagtaagttctcctggataatatcctgaagagggttttttttttttgtttttttttttttggttttttttgagacagagtctcccactgtcacccaggttggagtgcagtggtgcgatcttggctcactgcaaactctgcctcctgggttcccaccattctcctgcctcagcctcccgagtagctgggactacaggcacccaccaccattcccggctaatttttcatattttttggtaaagacagggtttcatcatgttagccaggagggtcttgatctcctgacctcatggtctgcccacctcggccttccaaagatctgggattaggaggcatgagccaccgcacctggccctgaagagtgttttctaacttggttccattctccccgtcactctctggtacaacaatcaaacatatatttggtcttttcccgtagtcccatattttttggaggctttgttcatttcttttcactcttttttctctaatcttgtcttctttgtttatttcattaatttgatcttcaatcactgatatcgtttcttccacttgattgaatcggctattgaagcttgtgcatgcgtcacgaagttctcatgccatggttttcagctccatcaggtcatttaaggtcttctctacactgtttgttctagttagccattcgtctaacctttttcaaggtttttagcttccttgcgatgggttagaacatgctcctttagctcagagaagttcgttattaccgaccttctgaagcctacttctgtcaactcgtcaaactcattctctgtccagttttgttcccttgctggcgaggagctgtggtcctttggaggagaagaggcactctgttttttggaattttcagcttgtctgctctggtttctccccatctttatggttttatctacctttggtctttgatgttggtgacctacagatggggttttggtgtagatgtcctttctgttgatgttgatgccattcctttccgtttgttagttttccttctaacagtcagacccctcggctgcaggtctgttggagtttgctggaggtccactccagaccctgattgcctgggtatcaccagcataggctgcagatcagtaaatattgctacctgatacttcctctggaagcttcgtcccagaggggcaccgcctgtttgagacgtctgtcggcccctactgggaggtgtttcccagtcaggttacatgggtgtcagagacccgcttgaggaggcagtctgtccattctcagagctcgaacaccatgttgagagaaccactgctctcttcagagctgtcagacagggacgtttaagtctgcagaagctgtctgctgccttttgttctactatgccctcccccagaggtggaatctacagaggcagtaggccttgctgagctgtggtgggctctgcccagttcatgcttccctgcctctttgtttacactgtgagctactcaagcctcagcaatggcaggtgcccctccccccatcaagctgcagtgtcacaggttgatctcagactgctgcactagtagtgagcaaggctctgtgggcctgggacctgctgagccaggcaacgggagggtatctcctggtctgctggttgctaagactgtgggaaaagcgcagtatttggtcaggagtgtaccatttctcccagtacagtctgtcaggcttcccttggctaggaaaggggaatcccccgaccccttgtgcttcccgggtgaggtgacaccccaccatgcttcagctctttgggttgcacccactgtccaactagtcccaatgagatgaaccaggtacctcagttggaaatgcagaaatcacctgtcttctgcgtcgatctcactgggagctgcagaccagagctgttcctgtttggccatcttggaagagaccttccctgtgtattccgagccttctgcattctgccatcactgcagcctcctcatgttggatggacctgatatttttgcttttctagtaattcagaaatcctcagtggaaaggctgtttattaatatgagttatctccagacagggcaaaggtgtggtctatggatgctgtggattagcaatgaccaggctctcaggtgactccactcatgtgattttcacagaaagactgctgtctggccagtgagcagcacagggcactgtgagtcacactcagtgtctgcacagtgaaaacccaaaacttgccacccccccaaactccccagggctgggtagatggagtctgcactcactgacacagatttagcagctagatatggtcccagcacccccaccttcttccaagtcctgcgtgccagacaccccgacaacagctcccagatactgataaatccatggggagagttgggggtaggcagtgggagcaacacacttgcatccataacccctcctttgtgaggccactgaaggggataagagaggcctggagaagccactccagttctggacctcaggagggctgtgtccactgtgacctgggcacctattctcctgtgatattctatcatttctcaggtagggacaggtctcacgtcctggggaagccccctagcctgagttcttgccctgtgtttcactctcaccctttgtcctgattcctcacccacgatcatctttgcttgcaggttccctctctcagcctttgcttattcagctgccctccctctctgcacatctgagaaatgctataagacttccctgtaccccaagtagtggctgcattgttggaggctgtcacatattcttgtaccagcagaagtcacggagccttccccagtatctcctgagatactactcagactcaagtaagcaccaggactctggggtccccagtcacttctgtgaatccaaagatccctcgggcaatgtgcagggattctgcacatttctgagcagcctgagatcaagtccgactattactattttacatatcacagcaacagtggcactttcactgtgctccagacttacggggaagtgagattagaacctcccctgcattctctctgccttgtgcaggcaacaatacactgtctgggaccgagtgtggctcatcagtagcagctttgttgtttgtatttttcattcttcagtacagggtgggacctttctactggcctccattaatagtgagagtcaaacaagacagtctgtgggtgactccaaagtctaactcagggtttccttatgttagttagcttggactactcttggctcctccccagagatctcaacttctctggaattctccaggtgccacaagcactgatttcagtcttggccttgcacctcccctgagcagcttctgactctcctctcattacatctccatttatggcctgtcacccactcaatgtgttaaaaggtaaagcattttgcaaagtacttatcctgaactttagccccaaatccacccagcttccctagcccaggccagctctgcttcttatgaggctgatgagaggtacaagggctgcgacccttgctgagtccattcctgaaaatgcccccaataaagcctgattagcgccaatgccacaggacattgttctgtttcctttgcaggtggtgcccagtgaggaaagttcttcctcctgaatatgaatattttggagcatgaaacagctgagctgatctggggaggggaggcaaccccttgtgatggtggtcagattgcttggttgggattgtcacagaccatgtgataatgggattatattgcatatcacagatgcgctggaccctcaagtgtgctggggaactctggttaaagaatagaagtgatccctttgttcatattcactatgctggatgcccttttgagatccctgcaggacgctaaccctctgactgcggcagccttgccctttgatctgaagcttttatcatacattgtcctgctcaggggatttgggtggggcgttactcctatatatcatcacaagaaagggattctctggagactaaatgcaaactggaatatcccctggaggctgtccccctgattgggaaatatgaagagactaggggtgctcagtgtttaaaataaaacttcagagagtagagtctgagtgtaaacccttcaattccatttaatctctacaaatgtatataatgtcaaaacatagttatgtcatatatttacacatgtgcacacaaatctattaatacatgttcataagttcacatatatgctttatgttatacatatatgcatttatacatcaactgatgttattataatcatagttttacagactcaattttcctttgggtttttccacatttccccactttctttaacacttatttcttgaaaattttggtggctgcttactgagattttactaaaaaagagcttcagaatttcatttagagtagatcttgtggcaaattctattttttttgtctgaaaaaatggtattttttctcttttttatttttaaaacttatcttgaagcataatatgtaaagtgaaatttgcagatcttaattgtaaatttcagtgtgctttttatgaacacatatactcatgtgccccatgcgtactcacaacatttccattactgcagaattaaaacattttgttctagtcaatgaaattattccattacagaatagatatgtgtaccacatagaatgtgtacctgagacacacttcccctggggactccttataaagtgcggtgaattgtgtgtcttttttcccattgaggaggccaatgtggaaaactaaagactgagatgatgtagaaaactgccctgagagggaacctcactctgccctgaggtagggagccagcactggtcaaggccccggtggaggatggcacctctgttgggtccacctggcctctggtcacaggcacgatggacctgggcctgggcagcagggggcgctgtggggctggcacttagagtctgtggggctcttagctgggaaatgatacctggccctggcctctgcctagggctcactggggccagcagctgggtcctctctgggccctttgggagcctcagtccaggtacatcccaggcctactcttcccagaaatgacccagccactgggactgcacacgggcccagggaggggcacgcttgggcaggggaagaggagcacatttgcatgaaaggcccatctctctcctctaaggctagagggtgaacacgagagacctgccgcgtggcttcctctgcagagatccggggagtctgcaccatggccttgaccccactcctcctcctcattgtcctccttcactgcacagtccaggacggcacaaagcatcctgatcccccagctcactgacaccacctcccaactcatgccagaactgtccttccctgttctgctttattcagtgtataatggctgtctgtgttttcgggatccctctggcagcccgtgccgactcagtcgacctctgcatctgcctccctgggagccctggccaagctcgcccacactcagcagtcagcatagcagctatgccattgaatgctttcggcagcagccagggaaggcccatcagtacctgatggagcttaagagtgatggaagccacaccaagggggctgggattcccagtcactagttctcagtctccaggactggagctgaccactatagtgtcatttctacaatcccgtctgaggatggagctgactatatctgtggtacagattgtagcattggtgtgccgtttgggtaaagcacagataaatggggaaatgaggcaaaaactgtttttctactctgctaccaaggttgaaaaatggctctcagaaccagtgtctgctgacctgcatactcaaatatgttatgtgtgtgtgtgtgtgtgaatgcgtgtgtgtgtgtactttaattttacgagtagagagccagatattttctgattcctgcttccagttcccttggaaacagctttttaggccaggccttctagggagtgcactctgatctgtaactattgtgcaaatattacaacagagcctgtctcctcctgctggtctggtgtattgtggctatataggggggtgcaaagaaattctccttttcatattcagacactgggactcagctgcatacctcagtcctgtcttattgagatcatttaaatgatcaatcttagaagaaaacttctgacttaaataaattttagaagtctatcaacatgctagaaagcatattccagataaataaaaatagaataaagatttatagagattgagatgaaaagctttaaaccctttgggggtttctgaaggtattctcaggtgttcagtgcctgggatttgggagtaagggataaggaggagaacttatttccaacacactgaagatgacaacagataagcagaaagttaccaaagaaggaggaatagaaatagccatgaatatcatcctggtaaccctgatctggaatgaaggatttcatttatttacttatttatgtatttattttcaaaataagtacatctcatggagtccttggcaaaagctgaaggaagtattgcttcaggaaatatctgtccagtaattaggaaactactaatgtgattgagcagagacttcattaacttcacatgcaaagaatacagacttgcagaaccctcctggaaaaccatgaaacaatacatcatcaacaataacaactatagcaaaaacagcaacaacatcaaccaaaacgctttacaaaaaagttctaatttccagaactgtcacattatattatttaaaatttccatttgtcaaagcaaaataatgaggtaggttcaagacacaggaacatattgccatatataacggaaaataacaaagaaaaaaacattaaaaaaacaaaaaaattaaaagttgacaaaaactattttcaaagaggcagaaacactggtcttattcgaccaatacttcaactccattatttctccatttgctcaaagaaattttaaaaatgtaaaaatgttcaaaaaagcatgaaaagaatgtatctccaaataaagaatattaataaaagatataaaagaaagagtcattgaaataaacatagattaattgatattatcctattacaggaatagaatgaaataagggtggaaaaatacgcaggacctaaagaccctcttgacaccatcaagtgtaccaatatacacataatgaaaggcccagaagggtaagagtgaggaaaagaaacagaataatgtaattgaaaaatggtaaccaaaactttcccaaatttgacaaaaagaaacatactcaatccctaaaaagttcaataaaccttaatcagcattaatcggaactcatagatataaaacttatggaaagcgtcatggtgggataaagcttactaagttctaaaaagtcaaatagacaaagacggttacaccaaaagtgtgtcaatttctgtttcctgccatgatgcaatagatggagttcttacaccataaacaacactttaagacataatcgagtgcatgtaatgactatttccagacagtgaatattggccaacagggataacttgattatgtaacctcagagaaaggaccctaacacgcaaatgagcactgcagtggacacggatttctttttcttcactttttttttttcgagttagggtcctgctctgtcgcccaggctggagtacagtgatgtgatctccgctcactgcaaactctgcctcccaggttcaagcaattctcctgactcagcctcccgaatagctgagattataggcactcaccaccatgcccagctaatttttttgtccttttagtagagagggggtttcgccatgttggtcaggctggtcttaaactcctgactgatctgcccacctcggcctcccaaagtgctgggattacaggtgtgagccactgcacccagccaacacagattttttttttttaattatactttaagttttagggtacatgtgcacaacgtgcaggtctattacatatgtatacatgtgccatgttggtgtgctgcacccattaactcgtcatttaagtatatcttttttttttttttttagacggagtctcgctctgttgcccaggctggagtgcactggctctatctcggctcactgcaagctccgcctcccgggttcacgtcattctcccgcctcagcctcccgagtagctgggactacaggagcccgccaccacacctggctgattttttgtatttttttagtagagacggggtttcactgtgttaaccaggatggtctcaatttcctgacctcgtgatccgcccgcctcggcctcccaaagtgctgggattacaggcgtgagccaccgcgcctggaccacagatttttttttggagacaatttttggcccagaaggaggtggtgaccaagataatcgtgagctttttacacagctcagaacacacagatgagaagtcagaaaaacatagatggctgagactttcagagcaagacactgaaaagcaggcagctacacagagcaaggtccctgcgctctgcatgaggcccctttggatttggttgggcaaaacatgacaccttgcagggggctctaatttaatgaataggccttcccctactgggaactaagattcatattttttctctctgtcctgttttttcaccactgtatctacaaaccctaggactcagcctagcgcaaagagccaattaataccatgtttgttgaacgaatatgtgaattcacctaaatagaattctcagtaagagaaaaagatctgaggaaaataaagtgatttttactgctttatgtgtattttgagtttgggttgtgaattgattcaaggggatatattaaattagaatgttgacctccgtgtttagagaacaagagaggaatatgaacttgagtgctggaaaggtgaccagcaggatggactgggtcccatgggtttgtgcagagaccatggaaaaggatgagcctccagttactaagtaattgaacaagatatattttaggtaaacacttattttataatcacctgttggaatgggtgataactgtagatgtgactgttattcattgactctctgaaaaaattatttattcaaggcaagaaagattggagaatagttttatcttgaaacacttttcataaacatgacatattcttgctaaagcagataccatattcatctccaagctggaagggttatctcatcttcccaaacatgcaccccttatagtatattttatctgcttttatggcatgtccactttcttggtcacagacattgtaagcctcagagtttaatttgtttctctactgtatacgtatggcacctccagttggtcactgaagctggagattgaaatcctctacatcccccagatctgtcctctggctctatggcgctgtcctgttccatcagacctacattgcccttccttgtgtgaaccctaacctaagtccaatctctactccatgaaagctgtctgtaacagaagcctggcacctctttctcctttttatgaaataaatatctatttctatagatagatctagatctagacattaatagctccaaatctgtagaggacaaagtgcctagttctcaggtgataaccaacccacatcttctgtcctggaatatccagccccagatatcaccccattttctcctccctgtctcgctaaatatatattcacccaccaagccactgggtttgtagtaatttgtcacaacaagaacagaaaaatatgtggaaaagaatggaagaggagtgttgctgttaaaaaaaatacttaaaatatggaaatagttttggaagcagacaagagatagagtttggcagaattttggaaagcatgttagaaaaatcctagattgctttgagcatggtgttaatgcagatatggttgctaaagacttggctgggatgggctcagtaggaagtcagaagcatggtagcgaaaaagctacattttctttcttttttttctttctttttttttttttgagacagggtcttgctgtgttgcccaggctgcattgcagtggtacaatcttggctcactgcagcctccacctcctgggttcaagcgatttttgtgcctcagcctcccaagtagctgggactacaggtgtgcgccaccatgcccggctaaggttcgtaattttagtagagatggggtttcaccatgttgtccaggctagtctccaactcctgacttcaaatgatctgcctgcctcagcctcccaaagtgctgggattacaggcatcagccactgtgcctggtctagttacatttttcttagcaaatacctaattatacatctacagactggaagtagaaatacagccagtaccagcactttgggagaccaaggagggcagatcataaggtcaggagatcgagaccatcctggccaacatggtgaaaacttgtctctaccaaaatacaaaaaaatttagccaggtgtggtggtgcatgcctgcagtccaagctactcaggaggctgaggcaggggaatcacttgaacctgggaggtggaggttgcagtaagcccagacagatcacaccactgccctccagcctggtgacagagtgagactccatctcaaaaaaaaaaaaaaaaaaaaaaagaaagaaagaaaagaagataaaagaaatacatccagtaaaggagctcctggtgcactgatgggagttcacagggaattaagagcgctcttttgacttttgtgggaaaaccggaggaaaggggatcattgttttttggtggaaaacaggttggctggattgtttcatgcaattgtatggaaagcagaacaggtgagcagcaaacttggatatttagctgagaatatttccaagcaaagtattaaaagtataacctcattcattcttgctgcttacagtaaaattttgtgataaaaaatgtgaagtaagggaggaagtcttaaatggaaagaaactagggcatgataattgaggagattactagcatatttcgccaattacttgctcattccctcttttctgggagaccctaaaagtaactcatcatttactgttttccatccgcttccttccttgtctagaatatgggcctggaccctccacaagatgcgtagagaagtcagaaggccttgtcctgtgcaagcattcaagcatccactcctcgcactaatatttctagacagcaaactggtgatccttgctcacctgaaacatacatacgggttggaggaagacagaacctaacacaccttacctgtgtgatgttcagggctggcctctaacttctgagagcttcatttcactccacttcctacaaggattgctcatgccctccttcacttgtggtgaagttcaaacaatacattagatttgacatctttgccaagagctgtagagtgcaaggtgctcacccagagctacatcttccagcagatgaggctcacagttaaatcactgctatggtgtccgtcaactcaggcactgttgtgccttttcacagagcatcgcctgttaactgcttcacccacccactgtgggagtccaggtaggaggacaatgcctccccactagctggctcctctctggttgtacctgtgggtcacacatgcaggtgacggtttgtactacctcctacctggctgtactccccaaagccagggctgacacccctcactgcacttccattccatcccatcagtcacaggaggcagctattggctcattaccctttgcaaggagttcaagggtagaagtggcccatttataagaatatttatatggactatcttgtatatcctgtgaatcatgatactgttaaatcaactctaatacatcatgtttatgtccactgaaatgatgatgataaaaggaaaagtgatatctggacacgcagactgaaaaagatcccaaagattctgcacacaaggcccctattctctggggacatgtgggaattcaatggtcttgctgacatatagagtttgcttcactctgtgtcaatctgaggcatttgtgacctcagagttgtgttttctaagaatttaccatgtgtggcagctggacttcaagttatacctaaatatctctgtctcctagcactcacatccctgtacatattgaaaagggatcactagtacaattgataggatattgagaaaatgactgatgccaggccataatacactttgagttttgcgttctgctctctcagatcacttgctttggggaaagccagttgccatttgtgaggacactcaagtagtcccacagggagtttcatgcagcaagaagctgaggcctcctgccaccagctttgtggctcagtgaaactgtaagttgattctattgccttggtaaagtcttctcatggctttagttccccccactgaaatcctattttcaacctcatgagcctatctgagccagagccaccttgctaaactgctcccaggtttctgacccacagaaactgtgggattgcacatctttgcagttgctaagttttgtagtatttgatgtgaagtaattgaaactggatgcatcgagagaggggaatggaggtggcagagtgggtggaattaggcctggaggtctgctttcagtgagatgtgatgggaccatggcagacacctccctgtttctgattccagtggattgcttactgggcctggcctttttcttatactccatgacttcattgttaataccctacaggaattctgtatgcgctatgtcttatccatcttccttgggtaaatatttaaatataaatgaatcaaaacacatgggccactttctaatcttgattgttcaaaactgaattcctcaaattgaggggtatgattttctttattgtccttggtgctcgtctgccagtgtctatcaatggtagaatcatgtaaacagtcccctcccctattttgtttcactctctgaggacgagagagaagtcttggccttcaacagaaaatggtcaaactagaaagagtaacacttttgagctcctcagtgaatgtggccttggaaaaccccttcacctgggcagcaaaggaagagggagaaagacagagcctgaactggtaggaagtcctacctcaaaaacatcagtcagtcctcacatggatggccagggcattaaggagaactaattaagttaatttcacattctccatgacaaatgctgttgtcatcagtagggacctctcctctctttttccatcctcctacctgttctcactgtccctgacttacccacagtgaactttatgttttcaccttttatatccctatgcctggtcctctgctggcctgtgctgatcttttcataaatatttttgaaatgagaagacgcattttcttaagtaccatgaaagtcgacatcacatccatctttcagggtcctgctcccagactcttctgacttatctgttcactgtgctgggttggcagggaaaagtcatctgcagcagaaaaagtgacaaaatggagatacatagtgtgtcttggccaaaaatcagccaacagatgagagagatctaggattgtgagaagttctgccgttccccagcacctcacactatttgatgtctcaatgtttgtacatatcactatattttctagaagatgcactacatctagaaatagtgtttgctttgtttgtccccaagcaggaccccactctccactcagagccagttcacagttgccttcttccctggcccctgtggaaggagctgctcaggtgtttgctcccagagccctccgcattttccccttactgcggcctcctcacaatgaacaattgtcatgtttttcatttctcctgttcctgttattctagaaatccctcaatcaaaaaggatggttatgaatataagttacctgagacagagcaggggtgtggtccatggatgctgtgacctgacagggacccagcactcaggccaactccactcacatgattctgactgaaagactgaagtgtgcagcagggggaaatctgggtctttccaagctctgaacagtggtgcccacatatctgttatccctgggcaatggagcctgcactcactgaggaagataccacagctgtgtcttctctgggctgggtagagtctcctactcacaggtctgtggaaggtgcaggagctgcttcctcacttactcctcccgtgggacaaacgctgagtctcacccaccaacccaccatatctaaagaatcatgctcagacttcagctcttcctagggtggaacaaagattaccaggaggatacacaaatttgtgtggacagatcctcccttttcaggccactggagaagataaaagaggcctgagttaagcagcttcctctgtggggccacaggaggcggtgtccaccatggcctggacccctctgctcctcatgttcctctctcattgctcaggtgagaactggttttaggtgtctagggttagctccttagcttgcgtcagcctctctggctcagatccccaagacatgtatctctagttcctgccccagcccccatgagtgtctgtgcttgcaggttccctctcccagcctgtgctgactcagatgacctcactctctgcatctccgggagcatgagccagacttacctgcaccctgagcagtggcttcagagttggtaactttgcaatatagtggtcagctgaagccaggcagccgtcccaggtgtctcctgagatactactcagactcaaatatcactcagcaccctggggttcccatccacttctctggatccaatgatacattagccaatgcagggattctgtacattcctgggctgaagcctgagggtgaggctattactgttgtacgtgtcacagcagctccaagtcagcactccagacccactgggaggttacaaaaacctcttctctgatctcctggcctggtgtagtcactcctgctggtggctctaataaagtctatctcactgggtgacttatattttagatcttcaaccagcacctgattctttttttcagacaagtagatctgaaaatgtgactttattttcttcaattccactttcatattgattcatgctcataccttctcatttctttctggttttcacaggcagaaatcccttgctcagagacaaaaattctctaaattgagactttggaggagaccaaaagagagtggttcgggccatgcccggctcagagtctaggagtgactcagagatgcttctggtcccagagcttcaatctaggcattggatacaataccagcattcacaatggaattgtattctctatattagcaacaaaccatcacagattttgaaataaaaagaatataatttataataacatcaatataaaatatttaagggtaaatattaaaaaatggaaagtcttaaactgaaaactataaaacgttgagagtcattacaaaaaaaccttaaaataactgatattccttgtttgtagttggaaaactcaatgtgattataatttttataatgacaattctttccaaagttatctaaggaatcattgtaaggtcttcagtaaaaataggtttgcagggaatgaggagataaaaaaatctcaacaaagaaatgaaaactgtaacagaaaacatcaatgaaacaacagacctgggataatccttctcagctgccatgggatctaactgtatttaagaaaggggtgagtaggaaggcggctgccaaatccaggaacacagatgtcattttgagtgaccaaggtgagccaagggaggacagctttagtcagaagagcatagaccaggagcagaactcacatatctgaagctgatgggcagagtgtgggtgcaataggcctggcattgggtgctgctgagctgaaattatgctgtcacctgaggtgcgcccctggggtgacatggttctggttgttcttcaccccagggaaggacactgtgacctgttatctgttggaggatgaggactcagaaagctctttataagagagggcaccagtgtgatatgagggtccctgattgtctttccaaaggttggaaattgaacccgcatctttcatttttgtgtagagaacccaagatccttttctacataatcaagggttatttccaatagctgccttggcctgtctcagaaagagtgtgggtttgtcttacagcaatggtgcccactatttatgggaacgtcttgtataccctgatctatgctttcaggtctttgacatctcaggtttttggcctacctaatactagccatacgtctgggtactgtgatctacctcctactacacatataaatgcccatctcagcctcatctctccttgggatataaatgtgtgcaagggatttgaagcagctctgccttctttttgggtcctaaggatcagggttatgggtgtctccatccttccctgggtcttctcctcctcactgtcctgaaacatgacccagacacaggctcctgaggctcctgcaggccttcttccctgcttttgccaactgcaggtggaccctgccctgtgctcacaggtctttgtatctctccctgctggtcaattgccctgcaggggcttttcttatttctccattatgagaattcctttgtttttggaggaaataatttttatctaatttttgatttacttatcataatcctagaatttgtataaaaactcctgtttttgcataatgaaacagttgctatctcatgccattttattcaaagtcatgtgcttctgttcacttactggttagaactattgtttaatcattgacaaatatttatcgaacacccactctgcgccatgttctcctatgtcaggtgctgggtatacattgatgaatgaaacagactctatccttatggaacttgtgtctagtgagcttagaagtaaattttgtgagtgctaggatggagagtcaagctaaggactcttagttctgccagcatttaacatgttgttcttatacattttaagaataaattactccagaagaatctttttgttttgttttgttttgttttgttttggtgaagagtatccacatagacacacatagcaaagaccttatagaatgcatcagagataaacaaaataaaatgtaatgtttcccagagctggatgtagtttctggtttgatttattttaatgacacacagaagaaatcactttataatgaagtaaaattccacactacagaaacagagtaaaaatactttcttgaaaaaaatgccaaacctacctttaatcccaaggaaagagaattgcttgaatagatctgttagtatgaaacacataatagacaacctgctgtgtaaaattacttggaagtcatattttagaaggttttaaacattcttaatatactctgtttttgatattacgtcttatatttttctctgtggtggaaatttatttctaagaaataagaaaggatattagaatggcaaaaaatatttgtataaatgtgttaacattttaatggtaactatatatgaataaaataaaaacattgttaaaaatttattggaatgaataataaaattatcaagtttataattaataaaatcaagtatatttcttcttatgcaatttaaaaatagtgcagaatgtttattattctggtatcactaaaaatgacaaacttcattcatatctatagaaaaataattataaaattcagcaagtaatacaggagataatttgaacaaatattgaaacattttcttacttaaagacactaggtaaaaatttcagcaatgagtagagaggttatcaaggcgcattttattattgatgattgatatatgttttttctctcgagaaagtgcacaggtgggtatcagcagaggagacagtataggctccccagatgtcaaagcagggatgcgccaatacccatcagtcatcatcataaaagacagactgtgccttcctgtgtcaggctctgtgccaggagctgtgtgccccacgttcccttccagggtcctgcctgaagtctgtgctcactcagccagccccatcatctggaagtaacagtcccctcctcctgcactggaataagcagaagatttgggtggacagtgtggcctggccccatcagctcccaggagaagctctctgtctctctctcatcctgcatgccagttaatgacgataaaacccacctaaccaacccatctacaacactcagcttcatccctatctctctctcacactccatcaagggacacagtcatcccatgggttttttcccctggcatctctcactttcttcctcttccagatccctgggatcagctatcaccccacccgacaccccttctcctgcttggctgccttcaggctctttgttgagcctgacaccaaaggatgtctttctaaagtgtcagtttcatctattctgcccccagttcacaacctgaaacaacctccgatagtgaatcaagccaagcccctcactctaaagcacagagacatgccatgaattcctaaggggatgacagaatacatcattgatgagaagattgaacaagtgaagtgtgagtggcaagtcaggtgaggacatttgaatccaatctggcatttaaaatgtctcttcatttccaaagtcctatctctccctagtaatgttgtttgactgctagtcccagagcaggaccccacatcccagtgacagccaagtcacagtcgcctccttccctggcccctgtggaaagagctgctcagggctttgctcccagagccctctgcattcccaacttcctgcagcctcctttcattggatgggggtgatagtttgcacatgcctttctagtaatccaagaaaaacttactgaaaaagtctgtttgttcatgtcagtaatcaggggcatgaccagggcatggcccataaatgcctctggactgatactcaccaggctcccaggccaacaccacatacatgatttccactgagagaatgcagtctggacagagagcagcagggtacactgtaggtctgcccagtgggcatccacagctgtgccaacccctcccaccccacaaattcctcagggctgggcagtggaccctgccctcactgagcctgactcagcagctctgtcctccctgggtgtggtcccagcacccacttcctcccaggtctggcctgccagactcccccctccaccagaccctaggacttgaataaatacatagggtaaggtagaggcaggcaatgtgggggacacatttgggtccataactcctcctctgtgaggtcagtggaggggataagaggcctgaggcagcccactatggctgtggacctcaggaggactgtgttgaccatggcctgggcccctctcctgctgtttctctctcaattctcaggtaggcacaggcctcccatgtccagggcatgtccctcaggcttcaccagtcccctctggctaaaatcttacagcaactttatgctggtaggtggcccaactcccatgtgcatctgtgtctgcaggttccctctcccagcctgtgctgactcagccgccctccctctctgcacctccggatcagccagactctcctgcaccctgagcagtggcttcagtgctgatttctgctggatatactggtaccagcataaaccagggagcctccccagtatctcctgagccactaccaaaattcacttcatgaccagggctccggggtccccaggcacttctctggattaatggaaggccggtccaataaagggctcttgctcatatctgatctccagtctgaggatgaggcttactattactgtatgatcgagcacagcagagcttctcatgctgacacacacaggtggggaagtgggacaaaatctcagcctgctcagagtcttgttctctgatgaaatttagatcttaaaataacttatatcacttgtgtgggatgagtgagatatcccgagctcacaggaactgtcgatgaaaagagtcgagctctgtaaaatattgaagacatttattccaagccaaatatcagtgaccaatggcccacaacgcagccctcaggagatcctgagaacatgtaccccaggtggtcaggctgcaacttggttttatacattttaaggagacatgagacatcaatcaacacatgcgagatgtacgttggttgagtccaggaaggcagcacaactcaaagtagtggggctccaaagatcgtctttttgataattggttaaaagagttaaattattgtctaaagacttagaaccaaaggaatgcctgggttaaattaaggcattgtagtgaccaaggttttgttgctcagaggaagcctccaggtagcaggctgcagagaaaatagattgtaaatctttcttatcagatgtaaaaagtctgttctctcagaaattccaaaaatgaggaggcatatctggctccccgttcccatgatgacctgaactctctttcagattaactttggaatgcccttggccaaaaggaggggtctgttcagatggatgggagtcttagaattttatttttggtttacaatcctgtaacacgtcctgtaatttgctgcccagaggtcattaatggcctggaagaaataatgtgccagctgcagtgttgtccacagaaagacttactcattctgctgccctgagtagtgatatcagaaagatccatctgccaacagtcagaatacccttccaggagggttgcacagtaccaggggtgctggaagacctgggatctgaggcaagcagggggcactgttggatggatcccaagatgacaggattaccaggccacacaaggattaaacaagagacagtaacagtccactggctcttacacacttggataagcagtgacctccctgaagaatgactttcctgcacctgggctgaaggacccacatgagcactgggttttggataaaatagagcaatttcatttatgaacatagatgtgaaaattcctcagcatattcacaagtagaacccatgctggacctctgacctctaggatttaggctgagaacaggacatttgtgaggtcggtggggaataagcatgaactttggagggacagcaggtatgaggggtgctgagccgtatgttagatgccccaatcagggaaagagcctcgaggcttccagtgcagcttccctgataccctgtgggagagaaagatagatactggatatgctgcaatagagctcactaatgctctagtaaagagcaggcagcttgcattagcacagtccttcaggagagaaaacgcagccccaggaaagctgtcagaggccaagatgactcattagtcacattgaattcataatgcatttatgatgaaatatatgataaatgtcttatccttttgttcttttttattttttattatcgtgggtacataataggtgtatatatttatggggttatgagatgttttgatacaggcatgcaatgtgaaataattatatcatgaagaatggggtatccatcctctcaagcatttatcatttgtgttacaaatgatccaattacactctttacataattcaaaaaagtacaattaaattattatgaccataggtatcctgttgtgctatgaaatagtaggtactattcattctttctaactactttttgtacccattaaccatccccacatcacctcctactccctgctaccttcccagcctctggtaaccattattctactttctatgtacatgagtttcaaatgttttgatttttagattccataaaaaagtgagaatatgtgatgtttgcctttctgggcctggcttattacacttaatataatgatctccagttccatccctgttgttgcaaatgacagactcttattctattttatggctgaatagtactccatcgtgtgtatttaccacattttttatgcattcatctgttgatggacacttagattgcttccaaatcttagctaaacagtgctgcagcaaacataggagtgcagctatttctctgatatactgattttctttattttggatatgtatccagcagtgaaattgctggatcatatggtagccctatttttaggttttttgaggaacctccaatcgttctccatagtggctgtactaaatccaagaacattcaaaatcatatttatatcagtgctaaaaagtgtgacttgacttcaaacaatagccagtagttggtaggaatacaagtataagtttgctaaaaatatgatttgtcatttatatgaatatttctgttcccagaacaatctcatgtagactggcttctggaatctctcctacctcctactgagctgactctcctggagcctggccgtaacggtgcagggctggaagctatatactacaagcacatgctgtatggcatccagcactaacctgggcagatgacggcgaaacaatgtgtgatatttccatttgatttattttccttctttctctatagaaagtgttattataaaactgttatgttgaaggaacacaaaatttgaaggaaaggaatcaaacataaatgttaaatgtttatgtgtgtttatactgttgatctatgatatctcttgtagttactgttcaacatttctattttatatgcttttgtaaaataaacaacatattttatacaaaaactctcatgtgtgctagttgaaagtaatgccacctaaatgcaataacagaatttgaggagactaaaatgtgttgatttgagagacagtaagagtaatttagaacaagtccccatctggctctgaaatctaatcctttgctggtatccctacacctgaaaacctgcaggctttgcacctctgcagacagatgacattgggttaaattcatgggtctccactgagggtcacaataggctggtgtggcacagtgcattctgggagatacagaactgagggacagtaggctgggcgcggtggctcacacctgtaatcccagcactttggcaggccgaggcgggcagaacacgaggtcaggagatcgagaccatcctggctaacacggtgagaccctgtctctactaaaaatacaaaaaattagcctgacgtggttggggggcacctgtagtcccagctacttgggaggctgaggcaggagaatagcatgaacctgggaggaagaggttgcagtgagccgagattgtgccactgcacttcagcctgggcgacagagcaagactctgtctcaaaaaaacaaaaacagacaaacaaacaaagaactgagggacagtatatccccagtggacaccgatccataatcagccccagtcactgcacagactgggtgtatggtgtcctcagtgcctgctgcttccgtgtaaatgaacagcaggagatcctagggtattagtgaattatatattcatttccaacgtcacactcaagatgaagtctctacagtatttgaaattgaacttggacagcttcaactatttttgtttcaaaaaatattatatatacaaaaataccctatttctgaaggtaattggagtttattttacttccacaataatactaaacataaatggttagcgtattataaagtggtgtgtctaggcatggacagcagaaggcacttggagcctgttcctgaggggtctgggggtgttcggagctgagaccagccacttcccctgtctggtgctctctgttcagggctcacagctgtgatctcctcacccctgaacggctcacagcactactcatacttatccctatggcgccctcaggcagaagagtctgatccagggctcagggtgggatcagaaaagttcccatttgcatgaggagatcctccctgcctcagagtataaagagagaaaaggagagagttgggaaaagctttacttcaactgtggggcaaaaaggcaggactcaggacaatctcaagaatggcctggtcccatttcctgctcaccccctttattcactgcacaggtgactggacatggggccacggaaggggccctggggagcccatggagagctgctttctcctcttatttatagacccagaatcaccatgtctgtgtctttcccactttcagggccttgggtcccatctgcgctgattcagtcaccctcagtccctggggctctgggccagagggtcaccatctcctgcactggaagcagctccactttggttattggtgtgatatacactggttccagcagctccaaggaatgacccccaaactcctcatctataaaaacaattggtgacacctgtgggtccctgacaattctctggcttcaagtctggcaactccattttcgtgaccatcactgtgctacagcctgaagatgaggctgattatcactgccaattctacaaaaacagcctgagtgctttcacagtgctccgggttgaagtaagtcagaccaaaacacacagtgtgcccagccatgaagctctcccatgcaccccctactctgcagctaagtcaatgtgttctctcacttgtttgtcctaaaactggggcctgagaacttcttcagggtaatttttctagggaatgtgtcctcaccctctcaatatctgccccaaattcactctttggcaacaataccatgtgctcttttctcagaggtagcagctggtactgaatgccagaggccagctgccctgtggtggagtacagatgggtgaatcagtcggctggggcttccacaacaacacaccacagactggagtcttcaccaacagatatgtattgtcttactgttctggagtctgaaaggaccagatgaaggtgccaccccgtttggttttctctttgccctctttcctttgcttccagatggctcttttctcactgtgtcctcacatggccacccccaggtctgcatgtggtttttgtacacatttcttatgaagtctttagtccttttggattagagactcattcctatgacttcattgaatcttaataatcttagtgtccagatctcccaatacagacaaattggtaacttagttataacataaaaaatcagggggccaggctcggtggctcacttctgttaatcccagcactttgggaggctgaggtgggtggatcacgaggtcaggagattgagaccatcctggctaacacggtgaaactccatctttactaaaaatacaaaaaattagctgagcatggtggtacatgcctgtagtcccagctactcaggaggctgaggcaggagaatcactggaaccaggaggtagaggctgcagtgagccaagatcacccactgcactccagcctgtgtgacagagcaagactccatctcaaaaaaaaaaaaaaaaattcggggtggatgcaatataatttgtaacaaaggatcaggggtccagggacccagagtccatctgtgtctgacccaggagaggtgatgctgcagaggccacctggtcactccattcctctgagctcctactatgtgcagattctggatgtgttcttggtgctcagggtacagcgtggataagacaggatggtccctgtcctccaggaactgatgctatttaggggaaaacagaacacatcagtaaatgtatcaataagaatatgacatgttttaggaaaatgaagagaggtgtgttttggtgaggtggggtgagcagacttagaggagttgatgacaaagatgcagcgactgattaaggttgtaaaattcacctgctgcaacataaagtgaactaagaggaagtgagggtccaggcagggccatatgaggctctggttttgacacaaacattaggctgtggagtcctggacatgggcggaacacgcaaacggtgaaaggtcatgtctgcatggttcagaagtgggaggtgctgaggaatggagtgtggggagacagggaccacagctgggatctcaggacctgtgaggggtataggtgagctgcagctaagtgagaaaacattaaggaccctgtgtagttgacacaagattattgacatcttaagtcttcaataaatacaatcagcgctgacaaatgtggccgtgcctcagaagagctagaaatgtttatgtctaggtaactctcatgttctgtagaacttcacttgtatttttttggttttaaaggattattataagagcagacgtttatgaatatactccattcttttatcctcaatattgcccatctcttaaaatcctttggctttacacacacctacaacaaactgatcttcaaaaattgataaaaataaacgatgtgtaaaggataccctattcaataaatgatgctgagaaaactggcctacaatgcagaaaagtaaaactggacccctacctcttaccatataaaaaattaattccagatgaatgaagacttaaatgtaagacctccaactattaaaatcttagaagaaaagttggaaaatactcttgtggacattggtgtgggcaaataatgtatgtctaatcatcaaaagaaattgcaacaaaaaacttgacaatcaggaccaaataaaactaaggagctcctgcatggcaaaagaaactctcatcagagtaaacagacagcctacgcaatgggaaaaatatttgcaaactatgcatctaacaaaggactaatatccagaatctataagaaagctaagtcaacaaaaaaatttaactccattaaaaagtggacaaaggacatggtcacttctcaaaagaagacaaaaaagcagccagcaaacatgaaaacatgcagaacttcacttatcagagaggtgcaaatcaaaaccacatgggatatcatctcataccagtgagaatgggtattattaaaaagtctaaaaataacagatgctggcaagaatacagaaaaaaaggaatgcttatacattgttggtggggatgtaaattagtacagcttctgtggaaagcagtttggagatttctcaaaaaaaaaaaaaaaaaaaaaaaactaccactggacccaggaatctaggtgtgtacacagaagaatataaataattctaccaaaaagatatctgaactcattcgtttgttgcagcagtattcacaatagcaataacatggaatcaactcaagtgctcattagtagtggatcgagtaaaaataaaatgtgtgatacgcattcaccatggaatactatgcagccattgtgaacaacaaaaccatgttctttgcaaaatatggatgtagctgaaagctactttgcttccagatggctctcttctcactgtgtcctcacgtggtcactctcaggtctgtgtgttgtttttgtacagattgcttatgaagtcattagtcctcttggattagagactcattcttatgacctcattgtatcttaattatcttagtgtccagatctcccaatacagataaattgttaattcagttataacgtgaaaattcagggtgaacacaatataatttgtaacaaaggatcagggatctctttggcttctcgatggatcacctgccaaggggcaagggtgtaatttttacaatgataggcgcatagctcttaacacaagacagaattaccctgttgaatgcttcattcaaatgatatgttagggaggaggccagttggatgataaagctttgggaatgaacatttaacagcacaggatctaaaatgcagaagaaaagaacctctgatgcaaactttctgagtggagataaactgtctgatatcctgcagattaataaaaccagaaacttcatctgccccctctaatagaaatctacacattaacacaatttcactatatgaagtttccagaagatgatgtggagcttgcaggtgagcttcattttacactttccgcctattcatttctgtgggaggacttactttccctctttcaattttctcatgtgctgttcatgtcacaccctctaattcaaggctccagcccacctttcctgccaacaccaacactctctgtagatgaaaacccaccagtcagcagcctccttggcctgagagaggtcatcttcctgggtttctaagactctggtcctgccgagattctccttcctcaatcctaatcccgtggtctctggcagccccttcacatggacctcatcgctcgtctctgtgttcctccagctatatccacgtcagaaactgctcttcatctgcactagaaataaagaattatcctctcaactcttaaatgtttgctctgattctctcctcttctttgagctcaggcacaccaccccctctcagattcctgagtgtggcagtgtcccctctccagtctccctaccacctccaatggtgaaggcgaagaaaggatgtccctgcatgtatcacatcctcatccttcccttcagggtcagctccctgggtagggaaaacactgttcccttgaggctcacatacccactgtcaaaaagcacccagcacatggtaggcactcaataaacctttaccaaatgcagacctgcctctcaccacactggacacattgtagtgagctcaggatggggctaaactgggagtattagctgtaaacttgctcctctctctgtccccagcctgagagctgagggggcacccacgagggagagcacctaggggcagggaggggtcacaggcagcctcatcctctgtgtgagacactgctcagactgggggatccctcttcattcagatgggaagaaaagggaaacaaaattcggtaggaacttctatgcatccacacagaggaggcaatgacaagaaaacacaggatgcaagcacagtggtaataatgtatttctacctaatattgaataaaactcaatattgcctgtattctgtaaacaataactatttacaaaactgactgtaaattatgattttaaaaaccacagcttatgaagaagagaaacctcaaacaatgacacccctgaattgcaaatctaagacatggcacacatttattttcagttccatatgtggcctggatttatttacaagacaatattatgatattatatgtcactattccattttagatggtgtatttaaaatctcacagtactgcaactacctagtaatctactcatcagtataaacatcaatgtgacaatcctgctatccttctctacccctgcataaccccagcaaaaattcattatgaattcacagaatgtaatatcagaactgttgtagccacatacacagtttgtttcattttatgttttgataaagtaatcttttttgtttaagcttattgttttttaaaaaatatattacatactagatgtcattacaaatcagagattaataatttctcttatgcttatactactcccacagcactcattactgaatgtaaaccatatttatattttctttctttttttttttttgagacagggactcactctatcacccaggctggagtgcagtcgcacaatctcggctcattgtaacctccacctcccaagtttaattgattctcctgcctcagcattctgagtagctggcattacaggcacccgccaccatgcccagctaatttttgtatttttagtagcgatggggtttcaccatgttggccaggctggtctcgaactcctgacctcaagtgatctgcctgcctcagcctcccaaagtgctgagattacaggcttgagccacctgcctggctccatatttatattttctaaacatcctacttggagtggctgatcctaccagctaccatgtttccacctcacctgggatcaaacactgacaattggtaattttatctcttgcagtcttcaaatattgagcaaatttgccatttttgctattcaataaaaatgctggaaagttatttgccatgccactgactctgttcagtgcttggaggacagactcctaggagtgagaagttgaccacagcatctgaatagctattaccccaagtctgtggaaattagagaacaaaattttaccagaaatgccccccagagcttctccccataacctcaccacccttagagaagagagctcctgttctcctcagcgctgcagggtccacagaggaggaagagctctggccagcagggaggagccacagaagaaaggacctggtgtctcccgtgaccagggtagtgagtcatgggaaccagtcactgctctggacttgacctgacctaagaggacttggtatagagtcaccacttcagtcctcaccaaggaacatccaaaaagccctggacagattcacccttaaggagaccagtaaagcatgaactgccctgagttaatgagaaggtcacaaaaagggtctgtctggcctggtgctgagcctgggggcagtgatcagagcagggggaatgcacagctggctctggggacatctggtcatcatgtcacaggagagtgtgtctggatgtggacacctggggacatgaagggctcattaccaagtgatctaggggagatcagagctgcgatcagctaactgcctgcatggtgccctctgctcagtgatcacagtggtgagctcctgatgccccggaacacacagtttcacccttgcctgtatccctgatatccacgagaggggcctgacccaaggccagcgtgtcatcagaaggctggggggctctaatttgcatggatggaccctcattctcagagaatgaagaggggaagggagagatttggggaagctctgtctcagctgtgggcacagaaggaaggcaggactcaggacaatctccagcatggtctggtttcctctcctcctcactctccttgcacactgcacaggtgactagatataaggccatggctaaagccctaggaagcccatgggccctgctttctccttttgtctctcaacccagaatcaccatgactgtttctctcccacttccaggatcctgggctcagtctgtgctgactcagccaccctcagtgtcttgggccacaaggcagaggctcactgtctcctgcactggaagcagctccaacactgggactggctataacgtaaactgttggcagtagctcccaagaactgaccccaaactcctcaggcatggtgataagaattgggcctcctgggtatctgaccaattctctggttccaagtctggcagcttggcctccctgggcaccactgggctctgggctgaggacaagactgattatcactgccagtcccgtgacatctgctgagtgcttgtacagtgctccaggcttgcaggggagtgagacaagaacccccttcctcctttcccaggagggtgagtgcccagcagctactgcacaggcctggcctgtggcttctgcagttgctgtttccccagtgggcctgggagcatccagggccccacctgggagtagatgcttctcctcccctccgtcctcagagtcacccacagcagtccctttctaggaaaagggcctccagaaaacagaatgtcctgtaccctgcaacttgggacacagggtctctgctctaaagtccaggggctggagtgacaaatccagcagtgaaatctcagatctacatctgatggggaacctgcatctccatcatccttttgctatttccaggagttttcaaagcagtgtcttcctctcactggtcctcagtgtgttttcctgttctttttgtttcagcctatttttttttttttttttgagatggagtctcgctctgtcgcccaggctggagcgcagtggcgcgatcttggctcactgcaaactccgcctcccgggttcacgccattctcctgcctcagcctcccgagtagctgggactacaggcgcccgccaccatgcccggctaattttttgtatttttagtagggatggggtttcaccattcacaggattgtctcgatctcctgaccttaagtgatccgcccacctcggcctcccaaagtgctgggattacaggcgtgagccaccatgccgggtctgtttcagcctattttttatgtgtctttttattgaggaataattaacaaaataaacccctgatatttaaagtgcccaattttgtgtgttttaagatatttatacacccttggataatcaccacaatgaatcagtgattccatcagaagaaatcggtgactggttctggcagaatccagggaaccctatctaatatctcgtgaacttctacttggactcaagtaagaaacagggctctgaggctcccagccacatcttgggatctaaagatgcgtcggcctgtgcaaggattttgcacgttgctgtgctgcagcctgagaatgggtctgtctcggggtctgcacaggggcagtggatttcacagtggctctgaggcttacacagggctccaggcccatgggaaagtgagacacaaatcttccctctgctctctaggcctggtgcagtgatcctggctggaggctctgataaatctagctcagaatgtaacttctgttgtgaacatctgattttccttggacaaatagttctgacaatatcttatttcagttcgactagtatatcgatccattgctcatacttctcattccattcttgctttcgcaatcggtggaccctgtcctgtgcccacagttctctgcatctctccctgctagtccagcctcctgcaaaggttcagctcccagaagagactcctacatccactgccctggaagaagcaacactatgagtagaatggcaagattttgtcacatcagcactggggataactcatcactactctgggcccattgaagcaatcacatactctctgaacctcagttttcatttttggcagcatgtaaccctacctcagcagctcttgctttcaacatggggatgagctgaagaagaggcttgtaaatgacaagtatcagtcactgttcaccgtgcaggggtgtctgtgtccttctgtgtcaggctttgtgccagcagggctgtgccccgcaaactcttccaaggtcctccatgcagtctgtgttccctcatctggccacattgtctggaagttaaggtcacctcctcatgcactggaacaagcagcagagtcgagtggacagcgtggcctggcaccgccagctcctacgggagccccagatggtaatgcctgctggtctccagcttgcagggttctgattttgggctcttgctctaggtctggccacttgggcttctgcaatactctgggatcctgtatgaggatgagggtgatgatcagtgttcaggatgtggaaagagccccaggttaacccaggacacctgtctcatggggacatgaggcacaagcctcccatctgatcccacagcctggcctatagactcactttaattttgtgtgactgtcacctgactcaggacattcctgcagtcattttttcctccaggactgatggaatgaggccattccctgggtctgtcgcctcatatgcagtcgacctatatactgggctttcaggataaaacattcccagcctgggcattgcaatacagacaggcaggtagctcagacagaaaatactcttgttgattccagatttctgggcacatggacttggtgtgtgtttgtgtccatgactaaggtcaggtttggggttgggagtgagagtggtcaccacatggtccaggaagaatgtgttgtcaaagataaaattcgtacaccttcctgcccttccctgtacctgaggcagcttcctgaagcctgcaggtttctgagattctccataaatggagaggaaacatcccatagaatggatgggttttttttgtcccagacaaaaagacaagacaggacgagggtacagatgtcagcaagggttaaacagcaagtatgcacttgatcatgccaaagaatactgaaatagctttgagggtaattcagtgtccttgagaattaaaaacaaattggagattgagggcttcaaacccccattaggtccttgtgcaaacagatgctgaattccaacccacattaagaaagaggctaaaaagatgagacaaaatctctgaaagacaggtggaggggatttctgcagtttcttggtgcttaagagacagggacctgccaggcactcacctgagaaatcctgcagggtcacagcacagggaagggaatgtgtcgggtacataagatgactttgatgttgaaaacaccacctctaccactgataatggttttcatcattcatacttaggtgcatgtacaacctctagcaaccataattaccacaaaggacaggcattgtgtaaacttttatgaggttctgtgttataaaataattacacaaaatgtataaataatgtgggcactaataaggtgaggttatatgttgcaatatctggggttcctattgaatttatagactgtaaaactaaataggtgctaatgtaaaatgatacagttagaaatacttgattcatgaaaaataaaaagtgagcgaaaagaaataaagcaaaaagcccaaataaaataaagagaaaggtaaactcacacacaatatcagcaattatattcaatgtaaatgtgttgatgaaccagataaaaataatttccttaaaataaagttacttgtgtgttatattttaaaggatgctaaaaatacactatgcaaacatttacctgcagaaagctcttgtggttatctcggtatcagaccagataatttcaatgaaaattatttacatcaggaaatgtgggacattttatgtatataaaatgaaatatttgacaagaacacataacaattataaaatacacatcagtccatgcatggtggctcacgcctgtaatcccagccctttgggaggccaaggtgggtggattgcttgagctcaggagttctagaccagcctgggcagcatggcaaaatttcatctctaaaaagtacagaaaaaaaaattagccaggcacggtggcatatgtgtctgtagtcccagatacttgggagcctgaggtaggaggatcccttgagcctgagaggtggaggttgcagtgagccaagatagcgccactgcactcctgccagggtgacagagtgagatcccatctcaaacaacaacaaacaaacaaacgaacaaaacaaaccaaaaaagcacacacaaataaacaaaccaaaaaacatgtccctaataatataatctatataaaatataaattagcaggactaaggaagagaaaagaatcaattcccaattatagttataaataatagcacacacttctattaactgagtgaatcagcagaaaaaaaattgcacataacaatatgtgaacaacctgaaaaaccaaattcacccactgacgccaggagcccaaacctgaggagtagttggctaatgaatatgtattactgaaacgattgaataagtgctagaagaaataaatgaggcattcattatttttacccgatttgatgcttctcctctctgtcctgtgagcagggggcactcccatgtctattcctagtcccattcttatcccctcgtctctctccccaagactgagctgcattctgcagggtggctcccgtccccctggagtaaatgactgacgtgaggagccctgccttccagtgctgctgttttcatcgtgctctggtttgaatgtctcccttccaaaaggatttatacttaattgccagtgtgatagtactaagaggtaggccttcaaaaggtgatatagtcttgaacacggagacctcacggttgggatcaggtctcttatataaaggctggaggtagcggtgtgctctgtctctcttcttgccatgtgaggacacagaaaaaaggcacttatcagatgacagtgccttgatcctgaacttcccagcctcaaaaactgtgagaaggccaggtgcggtggctcatgcctgtaatccaagcactttgggaggccaaagcaggtgaatcccttgagtccaggagttcgagaccagcctgagcaacatggtaaaaccccatttctataaaaaatacaaaaattagccagatgcagtgacaggcacttgtagtcctacctaatcaggaggctgaggtgggaggatcacctgagcctgggaggtcgaggctgcagtgagttgtgattgtgccactgtactccagcctggatgacagagcgggagactgtctcaaaaaattaaaaaataaataaataaaaaataaaacagtgggcgagataaagaaaatgtgttacttatataccacggaacactatgcagccataaaagaaagttatgttcttggcagcaacgtggatggagctggaggccattatcataagtgaactaagccccgaacagaaaaccaaatgctgcatgatctcacttataagtgggagctaaactatgaatatacccgaacatacggaaaggaacaacagacactgggaatgactaccagaccaaaaaaaaaaaaaaaaaaaaagaggatccaccctgtggatcctctgcccactgcctgggtcatgaggttgttgggaccccaagcctccgtgtcatgcaatcaacagatgtaactaacctgcatgtgtaccctttaaactagaatagtaagagtaaagagcattgaaagaaaaagtcaagatcagaagcgaagaaaataataaatgaaaaaacacaatctatagttatccaaacaatccatgactgtcacaaacacagaacaaggacccagtggacagaatgaggcagccaaatactcaacccaacatgatacatagggaacacatttttcaaaacaccaaaaagacacaatgggaaagggagagtctggttcaagaagtgattttgagaaaactgaatatgcacatgcaaaacactgaaataagacctttgcattgcacgatacacaaaatcaacacaaaataaattaaagacctaaactcaatcttgaaactgcaaaggtcttataagaaaacataggttgggtgtatattttaggaagcctgtatctatgcacacaggctgcaaaaggtgaaaaataatcataacactaaagggaaaattaggggaactacatgcacagacaatgcaatggcttggctatatatgtgtgtgtgtatgtgtgtgtgttttgtagggtggaggtttggatacaaaaattacagctaacatgcaaatataaacaaagacactagtgacactttagaacttctacagggggaaagaaacaatgaaataaacaaacaaacaaaatgcatcctaaagactaggagagaattatggaaagtcctacctctgaaagagattgttatctaacacctacaataaactcactctactaaatgaaaaacaacaaaaacaacaacaacaaatacccaagctaagaggatctgaatagacatgtgtgtaaagaagacaggaaattgactcacaggttaacagtttctcaatatcactaatcctcacaaaaaagtgaatcaaaaccatactcaggtaccatataattccagttaaaatgaatattgcaaaagataaaaataaaaattgttggaggtgatggctggtgtagaattgcaggaaggaaaactgttgtacgctctttgtgggaatgtaaattagtatacacactatgcaaaactgttggaggttccttaaaaaagtaaaaggtcaaagtacaaccaccactccaggttaacaatcccaccactgggtacacatttagaggaaacaaaatccctgcattgaagaggtatctgccttcccatgtgtcctgaagcactagtcacaatagtcaagatatggaatcaacctaactgtccatccacagatgaagagataaaggaactggatatatacatgatggaaagcatttcagccataacagtttgggaaatcattgatctgcagccatgtggagaaacctggaagacaattaggggaaatgaaatgagcctgttagagagagacccatactgcatgacattaggcaaatggaatccaaaaaacactgtcttctagaagcagaactttcaataggggttactagaagctggagagaggagggggcctgggcagggattggtaatgggtacagagtaacactcagaggagaggaatccattctgatgttctattccacagcagggtgaccagggtcaacaatgtctaggggaatttttcaaaaacagctggaaaggatggttctgaatgttctctccacagggaaataataagaagccagacaccatgatttgatcatgacactacgtatacatatatcaaaatgtcccttgcaccctctggttatatacatacactctatagtaatgaaactgccatcaaatgttggtagtattcattctaactggagtgacatagaatctgagtgtggttttcaatcatgttttggtgtgaatcggccatgttgataatcttatcttttacctgtgcatcaacctcatgtcttcaggtcctctgcccacttttacacatcaaattcaaaacaaattaacaataacatggcaaatataactaatcacacacacacagaaaatgaaaaccaccactcagattccatctcactctagatggaatggatactacaaaaaaaaagttgaaaaatattaaaagacaaaaaaacgatggtgtggatttccagagggggaacttgtctccgcagttcgtaggaacataaactagtacacacactaaagaaaccacttggaggtccctccaaaccttaaaaccacaactaccatttcatccagcaatctactactagtcgtatatacagagtacatgaaatcaagccatggaagagattatctgcgttcccaggtggaatccagcactatgcagaatggccaagatgagaaatcagccgacctgtccatctgcagatgaagggataaggaaactgtcccatgcgtagacactggaatactcttcagccagaaaaatacaatgaattcccatcacgggagccacacggttgcacctggaggacatgatggtaaatgaaatgagccaggcagagacagacaaactttgcatcctctcactcatgcagaagctgagaaactttatctcaaagacctagaaagcataatcatggttaccagaggttggggggaagaaggggaaggggcaaggattggaaaggggtagaaagttccacacagatgagaggaaggaaattctgtttttctattccacagcagggtgactagggttaatagcatcattacatcttcaaaacagcttgaaaggaggatactgaagcttctcgccacaaaagaataaacagtggtacgaaataacagaaaaaataaataccctgatttcgtcattccacaatgtatgcaaagaccaaaatgtcgcactctaccctctcattgcattcctttactattcagcaaatttgtttaaagaaatataaatacatgatgctagaattcacatgggaccatgaatcaccctgaatttcttccaaagcaatcctgagacattcagactacatcagatgcatctcacccaccgatttcaaatttcatggaaaaactgggtacctgcttccacacagagcagtggaacacaagagagggcccagaagtaaactcacacaccaaaaaccatctgatccttgacagaatccacaacaataagcaagggggaaaggatgccctattcaaacaatggtgctgggataagtggttagccatatgcggaagagtaacactgggccccgacctctaaccagacacaaaaagaaactccagatgaatgaaagatttaaatggaagacctcaaactattaaaatcctgcaagaaaacatacaaaatacctttctccacacaggttttggcaaagaatctatttggctatgtccccaaaggaaatgacaacaaaaatggacaagccatgcttaatactctaaagagccaccacacagcaaaataaattagcaacagagtaagagacagcatacagagtgggagaacatgttcccaaactgcatctgatcaaggtctaatatccagaatcttcaaggatcttatgccaatcattcaacaaaaaacaacaaaaaaatcccattagtgtatgggcaagggatgtgaacacacacttctcataggacaatgtgcaagtgaccaacaaagagggaaacatgctcaaactcactcatcaacagagaaatgccaatcaagagcaggtcgagataccatcccacaccactcagagcggcgatgactatgcagacaaagaaagaaagaaagatactggcgaggcagctgaggagaggaaaggctgatatggtcttggtgggggaagcaagctagtacagacactgtggaaagaagtttggagatttctcaaagaacttagaactaccatccaaccccacaatccctctcctgaagatctacccaaggaaaatatatccttctatccaaaagacacaggcacttgtatgctcacggccgtgttattcacaatggtaaagaaacggaatcaacctaggcatccatcaacagtggataagataaagaaaatatggtatgtatacaccacaaaacactacacagcccccaaaaatcacatttttggcagcaacatggatggagctgcaggtcattatcctaagtgaactcaaggccagaacagaaatccaaatgccacacattctcacttataagtgggaactaaactatgaatgcacctgaacgtaaagaagggaatgattacattaggaataactaccagaccaaaaagaaaatgcaaatgggagggagggggcgttgcgtcctgaagacccaccttgtgcgtcctctgctcactgcccgggtcatggagttgttgggagcccaagcctcagtattatgcaaccaacagatataattaacctgtgtgtgtactctttcatctataataaaagtagaaactattacacacacacacacacacacacacacacacacgaagaagcttaagagctacataaacaaaaaaataagtaaaatctatagttatccaaacaatccctcactggcaaacacacagaaacactaacctatggacaaaatgagaaagccaaaaatgcagcccaaaattacatatggtgaatgcatttttcaagagaacaccaaatatcacaacagtgaagagagaagtctgctaattgtctttgagtaaaatgaatttctacctgcaaaacactgaaatggatcctcatgttacataagacaaaaaaatcaatgcaaaatacagtaaagatctccacccaaaactgaaaacacagggtgttttcacaccctagaagaaaacacagggtgagcgtttacttcagtgaaactttaatctatgtacacagattgccaaaaggaaagaaaacaaaagggaaaagtaggaggaagaaacccacagacaatgcgatcttttttcctttttttttgtgacgggacaccaaagtcaccacatgcacatgcaaatagaaacacgcaggactatggaaagctttagagatgttccacaggaatgaaaccaatgaaccgaaagagaaggtgtcctacagatttggagacagatctgaaaaactgtatctctgaaagcggttgttatctaacatgtccaagaaactaacaccactgtgtttggaagcaacaacaacaacaaaaaagacaaaacaaaacaaaaacacaacaacacatatgctgaagcaaaactgggcaaaggcccttaatagacatttctgaaaagatgacatgaattgactaatgagtcaaaaagaagttgctcaactttatcatttctcccgcaaaggtaagtccaaaccacagattctctgggattctggagaatgtgaattctgactcagtaggtctggagtgagcctgagattctgcgtttctaaaaggttcatttccccacaaatccacattatgtgtattaatattaccaagtaaataagaaaggtcaaaaataaaatggcaagccattagtagataaccttagtcttcctcctcatcctcctcctccactgcatgggttaggatggtccccagcatcctgatcccccaggtcactgacatcagctcccaaactcatgccaggaatgtccttccctcttcttccttcaggccataatgggtatctatttttccagcatctttctcccaatctgtgctgatttagccaccctctgtatctgcctccctgggacaaagggtcaaactcaccagcactctgagcaagagctacagcagctgccacatagactatccccagcagagctcagtgatggacaccaggttcacaatgccagtgggcagtggtgctgtttactgcatccagtggggatggagtggttgtccaggcacagacagatggacaatcacacagcaggaacaaatgtacattctgaaatttaacaaagacagaataagggactcttggggaatagaggtctcaattgcagacatagtgagtgcctcaaaaattagagaactggggccatctctgtcatggcccggattcctctctccttcatcctcctcagtcatcaaagagattccattagggggcaatcaaaggatgctggggcctgctactagctcccaaaaaacaccacaagcatttcagcagggagaaaagaaaatgctcacaaggatggggttagatttagttataaaccagattgtgtggcaggagggaggacatatcccccatcctttggccactccaaaattgggagagctaatctggggaaaggcaccaacacctattcattagtgtctcggtcctgtgtgatcatgggtctgtgtgagttctcagcagctgcctctctcaaggtctccccacaggacagcagggtgaaacctggggcaggaagagaggggaagctgatttgcataaagaactttttttatcctattgggtctggggaggcatgaaaaggccctgaggaaaacaaaccccagctgggaagcctgagaacacttagccttcatgagtgtccccaccatggcctggatgatgcttctcctcggactccttgcttatggatcaggtcaggggaagggactctatccctgggggaccacagaaaacagggtccaggttactctcatcctcatgatcataactgtgtctctcctgttcgttttaggagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttccacagtgatttaaacctatgaggaagtgcaactaaaacctctttatatactgagaacagttcagcccttacagacaggagggaaagtgagagggtggaaatggtcaacacggtgagtgaggagtctcctcgccccagtctctgacgcaggggttcactgccaggtgcctcacccagtctctccccgggtgtgtccaccttcccagtgtggcttttccatggctgtgcttcgtctccactgagaataatgtggagggagaattatctacaaaatatataagctcacagtgagtcacagacaccccagtgctccaggaagacgcttcttattcaaagagaattaacaggcatatgctcactcattaatttgaccatggaggctgactgaatattttatttatcactgaagtgggagcattttcaaggggcttgttaaaaatgtaattctctaacctaaacctactaagtcagaaacttgtgttggtgacagatagcctgtatttaacaagctgtacatgagatttttattagcgttaatgtttgggaagaacctacttttattatcataaaattattcataaggatctccatttataatgatgtcaggttaatattccataatcctactctcctaaattcccattcaaagcccccaaatactcagaaacagattttaaatctcaagccatagcaaaaattataacttgatttatgcagacagagtagggaggaatttctaaaaccgtaagttcctaggtgccaggtgtgctgactcatgcttataatcacaatactttgggaggttgagacaagaggactgcttcaagccaggagattgagaccagtgtcttccacatagcgagagtctatcaccacgaaagaaaaaaaaaagatataagtcccttcaggaatttccaaaaacttgtttccttagggtatatttagtggtccatatgaacatctgttactgaaaaccatcccgtagaggactggcttccagaatcccttctccctcccactgagctcacctacctgtggctctggctctcagggtctttataggacacagggctcagcctcttatcaccgattgttccacaggatcatggttccactgagatcctctcagcatagatacgtacctgtcctgaacagtgtcttttaacataatgttggcaagatgggaaggactaaggggtgacggagccttggagccaccagaagatggcagtaacctcactgctgagctttgctaggccagactcaggctcccaccctcctcccttcctctgactctttcttctggccacccggggtccaggagctttttccactcaatctgggctcaggggtcacctcagagaacctctcaagacaaaggaggtgcttcaggggatctaacacaagtgagggcagattttaagactgtccatgcacagaaaatcctgtgaaaagaaacaaaccagccctacttgtgtctgcgcacctgagtccttaggactgttttctcctgatctcctggctgagtaaagattgcaaatgtgcggttcattatccagatccagagaaatccatgagagtttatgaagacaaagacgacaactaccctatctacttgtcacacaatgaagacactggccttagatctgtcagtgccctggaacattctggaagaagagggtgaaggttacttggcatacgttgggactcaaacatgaggatctcatgatgacccagagggataaaggtgggatcagttgtgagggtggaaaatgtggatttcttaaggccattttgttaatccttttctcattgcaaaggatttaaactgaaatgaacacgatttttctaataaatgcttatgaggctttccattaaatttaatcatatttcctgcctttatgaaaataaatatagaaataaaatatacttccataatgcattactgattgtgtatctttaaactagagggaaccattacttctaaagaaaaattactaggattgtttgcattttaatctgggatcctacatgatggctacagatacagctgttgttcaaggttttagcctggaatctctgccaattcaataacggaggcaataaaaatagacactagtattataaagacagaattcatttattttgaaagttttgaaagctatgaatatctaccaagaataaaataaattgtactgaaaatatattagaatgaattaaaaaatgccaaattcacaactaataaaatttattataaagttaaaaattcttatatttttctgtctcagtataaaaaataaacatttaatgtatctattagaaaataattagcaattttgtaaatgatatcaaagaaaatttgaacaaatggtgaaatattttcttatctgcggacaccaaattaaaaaaattcaggccaggtgcagtggctcacacctgtaatcccaactactttgggaggccaaggcaggaggatctcttgatccaaggagtttaagaccagcctgggcagggacgggtgcagtggctcatgcctgtaatcccagcattttgggaggctgagacggcagatcatgaggtcaagagatcaagaccatcctggccaacatggtgaaaccctgtctctactaaaaatacaaaaattagctgtacatggtgacgcatgcactcctgtagtcccagctacttgggaggctgaggcaggagaatcacttgaaccggggaggcggaggttgcagtgagccagatcgcaccactgcactccagcctggtgacagagcgagaccccatctcaaaaaaaaattagccaggcatggcttcatgtgcctatagtcctagctactagggaggctgaggtcggaggattgcttgagcctgggaggtcgaggctgctgtgaaccgagattgtgctactggactccagcctgggtgacaaagtgagaccctgtctcaaacaaacaaacaaacaaaaaaccaaaaaaaccccaaaataaaacaaaaattcaacagcatgtagattagtaatgttagtgctttatttttaaaaattattgttaacttatatgggttttcctctgagaaggtgcactggaaggtgtcagcagagcagatagcacaaactcctcagatttcagaagcaggggtttatggtaaatgaaaaatgccagtcacttgtcagcatgcacaggtggctatgcccgccctgtgtcaggctctgtgtcagtagtagggtgctccatgcgtccttttcagagtcctacatgccatctatgctcactcagccaggcctgtcacctggaagtaacaggcaactcctcctgcactggaattagcagcagagtcaggtgaataatgtggcctggccacaccacctctcagcaaatgtccccagtggtgatgcccgatagttcccaatcctccttaagtaattaattcacttcaattgaattaaaaaaatcaatcacttccctatgacacacaaggacattcactctctggctttaactatccttgcctgccttgttattatcattccatgtgcccaatactgtcaaaagatgtatttttgccataccctccacatgcatttcatatgtgtgatttttattttcaaattctatatctcttctaggaatatggtgtgttttatttgtcctgctgcaggactcccctctccactcagattaaattattaaattccagataaaaaattaacttggaatactgttgaatcaatagtagaagtaaccaaaataataaagatatttcaaaatgaagattgatttttaaaagtaaaaatgtcacatactccacctagaagataagagactgtactacaaattcattagaacatccccttcatgtcatgggccagtcatgtccctgaacttaacctctgtcttctcgggtgatgttacaggccaatgcagcatcagctgcccacactcctagtggtggaatctgggagcacaggcaggagtctgcgcctgtggccttggctgggtgaaagatgacatttccaagacttcttgcttggcagccatcctcacgtgcaggtggtctggcagcagcactgcaaaacccaggcaagggatgccccactgcaaggcccagtggtaactgtggtggccattggcattgggggcagatgcagccatgtgagttggtgggctgtggcagccaccctaatgatggtttccacccctcccagctggtggtggctaaaaccacccggtaggagtttcaaaagcagtggcaccattaagcggagctcctggaggaggactggaagcaactgcttgcattgaaggaatgtagctatagtggaattattgaaccacatcatatttgcaaagatgcagaatgtattacagattacgagatatggaagttgaggttaatctggtagagagcagtgaatatgaggaggaagctctctattgggcgggtgctatcatagctgcagaaggtgatggtgcaatgcttctgccagtgagtaaagtcttgtacaaacttaaaccagttacggggtaaaatctgatccaggactacctgagggtcacttatgttggcctgttcaatacacacatttctttccaggagccttaccaaaggtctatagtagtgagttcagtatggaggcagtaatcagatcatatctggaaggaactggcataaactccaatcctgtgggacatcatggacagcaactaaattcgaatcaacagagtagagcccttgacattggacaagttcgtggtgaaagatctgaggctttaggactccgacatttgtgaatgacagcactaaatgaagtctttactggtgaacgtctatccagaataccttatgcttgggctgtggcagtggataatttaagtagacccactctatttatttatttattttgagacggagtcttgctctgttgcccaggctggagtgcagtggcgtgatctaggttcactgcaagctccgcctcccaggttcacgccattctcctgcctcagcctcccaagtaggtgggactataggcacccatcaccacacctggctaattttttgtatttttagtagagacagggtttcaccgtgttagccaggatggtctcgatctcctgacctggtgatccatccgccttggtctcccaaagtgctgggattacaggtgtgagcctctgcgcctggctaagtagacccactctaaaagactggtttcttactgtgagatttcagttggtaatggtccatgggaaaaatggaagacttcagggctcaatttgtgaactggagcaagatcaaaggcaacagggttgcaagtcaggctgtggagcatgattaaaatattgcaaatgacaaggacgttggagtcttgcattcaactgtaaaatgacagaataacaaataaatataatgaatcattgttctagagtccaaaaagggccaaaagtaattttcagtattcaagaactaaaaagcaagcagttttctcgagcacccatgagcattgtttctcctgagagatttgtcctcgttttcattgctggaacacctgcatggttgtagatggaggaatgtcttttgatgttcctatttttatatcagacaagctttaaagcaacaacagttataaaagacaaagaaggaaattttataatgataaaaggatcggtccaacagaacaatatcacaatcctaaatatatatgcacctaatactggagctcccaaatttataaaacaattattactagacctaagaaatgggatagatggcaccacaataatagtaggggacttcaatactccatggacagcactagacaggacatcaaggcagaaagtcaataaagaaaaaattgactttaattatatcctagaacaaatagatttagcagatatttacctaacattctacccaacaacttcagaatataccatattttaatcagcacatagaacgttctccaagataaatcataagataggccacaaaacaagtctcaacaaatttaagaaaattgaaattatgtcaagtaccttttcagaccacaatggaataaaactggaaattaactccaaaaagaacccttaaaactatacaaatacatgaaaattaaataatctgctcctgaatgacctttgggttaacaatgaaatcaagaaggaaatttaaaaattgcttgaactgaacaataatagtgacacaacctattaaaacctctgagatacagcaaaactaagaggacagttcatagcattaaatagtctgaaacagcatgaacagacaatctaaggtgacacctcaaggaactcaagaaacaagaaccaaccaaactcaaacccagaagaaaagaaataacaaagatcagagcagaactaaataaaattgaaacaaaaaatacaaaagataaatgaaacaaaaactggttatttgaagagataaacaaaattgacagaccgttagtgagattaaccaagaaaaaaagggagacgatccaaataagctcaattagaaatgaaatgggaaatattacaaccaataccacagaaatatgaaagatattcaaggctactatgaacacccttatgcacacagactagaaaatctagaagagatggataaattcctggaaaataagttattatttgaaaaagacacttgtatggccgggcacggtggctcatgcctgtaatcccagcactttgggaggataagcgggcggatcatctgaggttaggagttcaagaccagcctggccaacatgttgaaactccatctctactaaaaatacaaaattagctggacatggtggtgcatgcctgtaatccccgctactctggaggctgaggcaggagaatcgcttgaacccaggaggtggaggttgcagtgagccaagattgcaccattgcactccagcctgggcaacaagagcgaaattctgtctcaaaaaaaaaaaaaaaaaaaaaaagaagaaaagaaaaagacacttgcacacatgtttatagcagtacaatttgcaattgcaaaaatatgcaaacagtataaatatacatcaaccaatgagtgaataaagaaaacgttatttttttatttttagacggaatttcgcttttgttgcccaggctggagtgcaatggtatgatctaggtttaccgcaacctctgcctcctgggttcaagtgattctcttgcctcagcctcccgagtagctgggattacaggcatgtaccaccacgtccagctaattttgtatttttagtagagacagggtttctccatgttggtcaggctggtctcgaactcctgacctcagatgatctgcctaccttggcctcccaaagtgctgggattatgggcatcagccactgcacccagccaaaaatgtgattttatatatatatatataatatacaccatgaaatactactcagacctaaaaaggaataaaataatggaatttgcagcaacctggatggagttggcctcgtttactactctgggtttctgtctgaggatgagggtgatgattgctgatcaggatgcggaaggaacccagtgctaacccacagcatctgccccacagggaaataaggcacaagtctcttgtttgatcccacgctatgacctctagacctactcttccctcttgtcaccaaaaccacaatcaggaaaaatttctgcaggcatttcaccatcctggaacaaggatctgagactcttcactgaatttgtgaccttctatccagccaatatttatactgagctattaagattaacatcttagcctggtcattgccacacaggcaggcaaggcagctcaggtggaaaatacttttggtcatcccatgtgtctgggcatatggccttgatgtgagtttatgttcatgctcaggacaagttatgggtcaggggactagtcagcttatgggccaggaaaaggtgctaaggtttgtggagtcaaagagggaattcacacatattaatgctccttgtttccacctaaggcagtttgtgaagtctgtgggttctgtgactgtccacaaatggagcaggaacattccttagaacggatgattgggaccccacaaaggaaaagacaagaggaagcacaggctacacaatgaaaatacacttggtcatgccaaaggctaggtcatgccaaaggctaatgaaagagctttgagtataattcagtgcctttggggttgagtggaaaatacaaaaaccatctttgccctgctctcacaccacaacaatcaacacgtttccatgaccaaatgtgtaggatttctccccaccccctagaaagcaagccattggttttgcagcggacaccacacaggtgccctctcattgaatgcaattctgacactatccacatggagacagggtcagatcttacagtttgagggctacttccccaagactgtgccccactacttacgccaatcccaagcctcagattgctttacctgtgcttctgtccaaatagctgtaagttgaagatttcacaacatctccttggcttctattaatttgctagaatggctcacagagctcagtagacacttacaggtttattaaaaaggatacaaccaagcatatagatgaagacatgcatagcacaaggtatgggaagtggtgcaccaccgtccagtaatcttcatgtgttcagccttccagaagttctcccagcctagctccatttgggttattttatggacgcttcctcaccgaggctttatggagtaaaccactgcccattggtgaataatcggcagcccctctcccctccacagaggttgggagatgaggctgaaagtcccatccctctaacactgccttggtctttcttgtgacctgcccccatcctgaagttacctagggactgtcagccaacagtcatctcattagcatacaaaaagactctggtgattttaagtattttaggagttgtataacaagaaatggggtcaaagaccaaaaccataatttataataacacagggatgaaaaagaaagtagaggttgatgatttcaagcccacactagtcctcattatgacagatgtggatttccaacccataagaggcaggaggctgaagagctgagacgaaacctgtgaaaagcagggacaggggacatttctcaatttcttgttactgaagtgatagagctccaccaggcctcacttggattgacaaactaaattaaaagatacactctttaaataaaaagcacttctgagcatacatccaaaagaatgaaaatcaggatattgcagaaatatttgcacatttttattcatgcagcattaatcacaatttcaaagacatggagacagcataaggtccactaatcattgaatgtttacagaaaatgtggtgtatagctgcaatggatgctgttcaaattcaagaagaattaggccgggcacggtggctcccgcctgtaatcccggcactttgggaggccaaggcgggcggatcacaaggtcaggagttcaagaccagcctgaccaatatggtgaaaccccgcccctactaaaaataccaaaattaactgggtgtggtggcagaagcctgtaattctagatactcaggaggctgaggcaggagaatctcttgaatccgggaggcagaggttgcagtgagctgagattgcgccactgcactccagcctgggtgacagagtgagactctgtctctcaaaaaaaaaagaataattaaattttgccatatgcagcaacagggaaaaccctggaggatattacactgagtgaaataagccaatcttagaaggggaaatgctgcacggcctcatttatatgaggtatctaatttttttttttcgagacagagttttgctcttgtcacccaggttggagtgcaatggcgcgatctcagctcattgcaacctccgcctcccgggttcaagcgattctcctgcctcagcctcctgagtagctggtattacaagtgcctgccaccacacctggctaatttttgtatttttagtagagacacagtttcaccatgttggccaagctggtctcgaactcctgacctcaggtgatccgcctgcctcgacctcccaaagtgctgggattacaggcatgagccaccacgtccggcctataggaggtgtctaatatactcaaccgagcagaaatggagtagaatgctggttgccaggggtagggagagaaggaaatggggagtcactgctcaagggctatgaagctttaggtttgcaaaatgaacaagttctagagatgtgctgtacaacactgtgcttacagctgacaacactgtattatgtacttaaaattttattcagagggtatatcacacattaaacgttcttattaacatgaaaaagggatagaaaataccatgaaaccacttacagaaagcaagtatggcaatcctctgtcctttgtcttgggagaaagttttggccaagagacaatttaggcaaaaaagagaatttactgaagaaaaacagagagcaaatagtttatttagagagacagtgtactctggaagataaggcagagcgggctgctgatagagaatgagccagcggcccgagaaatgtgcactgagtttttatgatattgcactttttcttggagttcccacctctgttttaagtctccacctttttttctttctctagtttttctgcttcagccttaagtccctgccttttccccacatagtttccagcccaggctgtgggaccctcccttaacacacacatgggcccagtgtttgataggaattctacctaatggctgcattgctcattactgccaccccaggaaggttgtatggtggtcaaatctatacttactgtacctgcatctctcttagaaatttctcctttgctctcacccctattatcagcatgcagctagctacattctgacaggttaacttcagagtgagtgaatactgggtgtcttaaggggctttgttctggcataggtatttaccctaatctctgttcgtatctagcatgtgtgctttgggtggtctctggggtgtgagattttccagaactcccttttctcaggggctgcccctcctgcttctgtctagctatctgcctactctaaagttagtattagtatgaaagcttttatgaaaaacatttttttccaagaaaagggaggcattttatactggtgaaataaggtgttcaatgacaacacataacaactgtaaattgtatgcacctaataaaatagctttaaagtatttgaagcaaaactgtctcttttagcagaattaaaaagagaaataatcaatccataatcatatacacagatattaatacaactctcttattaactgagtgaatgacatggagaaaaaagagtatacatacaaatacgtgaaaaccatgattaacaaaatcaatccagtgacaccaggaacccaagcctgaagggtagttgcttgagtatgcattcatggatgaacgcatccaatgaatcatcacaggaacaaacaattgaggccttcgtttatgtatttctaactgatgttaagtttttccttcctattctgtgagtagaggtggatccctgtggaaggagctgcccgggtctttgctccagaagctgtctgcattctcccctcactgtagcctcgtcacattaggccattgttatatttcccatatgtccttcttctagtaatccaggagccctcaatgaaaaggctgtttattaataccagtagctcaggacagagcaggggcatggctcatggatggtttggaccaggcccttagatgactgcactcacatgattcccactgagactgcagtctggccagtgagcagcaggggcactgtgggtctgtctcacggtctgcacagtggctattcatagctgtgccaacccctaaattccccagggctgggcagtggagcctgcactcactgaagccgactcagctgctgcatcttctctgggtgtggttccagcacccacttcctcccaggtcctgccagactctctcatccaccagtccccaggtcttgaataaatgcatagagtggggtgggggcaggcagtgggtgggacacatttgcatccataacccttcctctgtgaggccagtggaggggataagagaggcctagggcagccactccagctctggacctcgggagggctgtgtccaccatggccggggcccctgctcctccctgctgctcccctctcacttatcaggtagggacaggcctcagattcctgggaaagcctcccagtctgagttcttgccccgtgttccactctcacatttcatccctgcttactcacccatgagcatttgtgtttgcaggttccccccacctcggcctgttctgactcagccaccctccctctctgcatctctgggaaattctgaggctcacatttaccctgagctgtggcttcactgctggtggctagcacatatcctgctaccagtagcatctagggagtgctctctagtatctcctgagagatgatatatctccagtgggatagatatctcaagagtgggctcctgataaaaggataaagttcaaccctatttactcattttcacactcttctttgccctttttctctgagataatgcagcagaaagacccttgccagatttcagcatctgcttgtggacttctaaggtcacagaaatctcaaccaaataaacttttagtctcagtaagttacccaatatatggtattctattgtatcagaagaaaatggagaaaatggactaggacagcacgtgtagaacagtctgctaatctgactcaagtaagcaccatggctccagggtccccggtcacttttctaaatctaaagatgcctcagccaatgcagtaattctgcacatctctgggctgcagccagaggatgaggctactacatatctcagcagccatggcacttccacagtgctccagacccccagggaagtgagactaggacctcccctgtgttctctctgcctggtgcaatcaccactgtcctgcctgggaccaactctggctcagggattgattcctgttgttactttttcagccagtgtctaattttcctaggatatatagatgtaaaatgtgtttttttcttaaaatgttaatttgatatatttttcatatcttttccccttatgatgcctacagtggagtaggtcagttcttagagctaagtttccctccaggaagattacagaagaggaaggagatgaataacctacacgtgctgtcctagtccatttcccccattttcttctgatataatagaatatcatatgttgggtaacttactgagactaaaagtttatttggttgagatttccgtggccttagaagtccacaagcagatgctgaaatttggcaagggtctttctgctgcattatctcagggaaaaagggcaaagaagagtgtgaaaatgagtaaatagggttgaactttatccttttatcaggagcccactcttgagatatctatcccattgccaggataagggcactaatccattcatgatggtggaaccctcatgacctaatcacctcttaaaggtcctgcctccaattacttttaccatgataattaaattctaccatgagttttggaggggatattcaaaccatacacatgtcccaaactagggcctagacctgacttagagatgtgtgtggtctgagaacttctgatcagctggttggtccagcatgccccaaccccagctccactgaccagctccaggagtgagtgaggtcaccttcctcacaactgctcattccagcctgtctctgaactgttcactcctcttgaggttcagaggatgcaggtctttgtggttccagggatgttgggcaaacagtcttttccacagtggaatatgactgtgcttgtgacttcgcagtgtgcagaggacactcagcacctgcctctcccccccgactttgtcaggcccatgattatcaccctctccttcatcccaagttcatctgatacgcatgccaagatttcagtgaggctggggacacataaggatgatgatactaaaatgaacaagttccatttcataatagtggcagaagatcagagatctgtaggggagttgtgcccccactctgagtatttaggaagcaactctagggacatcttgctctgcttctcccttctctgcacaggtgaaagaaggagcctgtgcagacaatcgttcattagaagctcctgccttcttcctcttttccaccccctaggactggatggggcctttgtaatggcttcaaattatagtgagagtcaaacaagacaattggtcaatgactccaacatccctctcagggctgcctgacatgagacaggatggattgcatctgatacacccccacccttctttcttatcggtatattaggtttttcttattgatgtgaacacactctatattacacaaaataagttatatttatatttcaaacctgtgatggtgatttttaaattatagtaaaaatatacatataaaatttaccatcttaatcattttaggtgtacagatcataagtattaactatattcacattgctgtgcaacagatctgcagaaattatccatcttgcaaaactgtagctattgaataacagctccccattttcctgcctcttgtggtggttttaaatacaatgcaatacatactagctgaaaatggaaaaaagaagtatatgaaaatgttaaatgcatagcacaaaaaatgaataatagggtcactttggttataactttaaatgagaaaactcaaagtaaaacaacaatctatgatatatcatataaaatgcacaatttaaaatttttaaaatttaatattaacaaaaatatatgtaatacaccacataagtattcaataaaactgaatacaattatgtttaatttttttaaactgtgaaaaagatcctattaacttttgaatatttacgcaaggaaaccaagtacatctcttcttgaaaaagtttgattccaattttttttttctttttttttttttgagacagagtcttgctctatcacccaggctggagtacagtggcgtgatatcagctcactgcaagctccgcctcccgggttcacgccattctcctgcctcagcctcccgagtagctgggactataggcgcccgccactgtgcccagctaattttcttttgtatttttagtagagacggggtttcaccgtggtcttgatctcttgacctcgtgatctgcccgcctcggcctcccaaagtgccaggattacaggcgtgagccaccacgcccagccagtttgattccaattttaacagacaggtgtttttgacaaccagtttattttcttactgaaattttctttttctttttttaaaaaattttaaatctttaatttccgttttcacttattttcttcttgcttccaaaaggaaaggagtgcgtagctctgttgcctgtacatcgtccacagcccctggctcggggcagggtcccctaggccgcccgggggtccacatgcagcccctggggggccggcgcggggtgaggtccggccggttggggccgccgctaggcgcgctggctgggcagctcctgggagatgaagcgacgcaggcgctccaggtactggctgtagagctcgatgtcgttgtgtccggcgccctccacccacagcggctccaccgccttggggcagcgctcgtagagcgccagcccgtgtgagaagtcgatcacctcgtcctctatgccgtggatgatgagcacgggcgacgtgatcttggacaccttctcgatgttagggaaggcgtcgaagcagtaggtcttggtgtcggggaaggcgacgcgcatgcccgaggtgagcggcgagtgcagcaccaccgcggcacactcgtagcgcgaggccaggtccacggtgggcaccgtgccgatgctctgcccgtacaggatgatgctgtccgggctgatgccgtacctggcggcgccggagcagggtcagccgcggcctccgaggcgcgcgcacccttcccaccagcgggcgtccccgggcccagctccggatgcgaccctctagtctccccactcagccaagtcagtgggtcaggcccaggctccacaccagtcccgagggccacccccagcccccaacaccgcggcggtgggcgaggccagcggccccgccccgttccctggcgctgccgttcactggcgtttcctagcaaggatctgcagggatcccgcctacggagtgcccctggggcaggggtaggggaggccctggcgcctgttctcctcctggtcacccctaggtgcacactgggaactgtgtgccccccacatcctgaatgcttcaggcctccctgcccgggttagaaagccgttcctggtgcactggccaggacagcggacactcttccttcctgcagcccttgcccacccccttggccatgaggaattcaggcagctgtgtccccagatgtctccacccaattttggactctcggagtccccacgcccaatgagatgccagtgcaacccaggtcagcatcgaaggtggtggctgcggaggtggcaccccctcccaccagcaccttcccttgggagtggacaagtcctcggccacctcagcaccaccagctcccacccagggccacccccacccccaggtcattggtgtgcggcccttgacccagctgatccagcaccagttacaaggcctcctcgtacccagtcccaaccacgcgggacccacctgccaccctgcccatgccaggaccccacaactctcctcccacacgctccaggctctgatcccaggcagacaccctcttgcaaggcaggagcatgggcaggtgtgcgtcccctctgcctggcattcggactccaccagcagggctgtccccgtccctggcctggaatcccagcctcctggcagcactccacagctcgccactcacccatgccccaaaggatgctgcctggctggtacctgtggccccagctctgcctcggcctccctggcctgctccctggcagccatggtcagtagtgtgctgagccagcccagccctgtcacctgctacaggcaggagcccccagctgccacctggatgtccccactcaaatgaacgggacacatccccagtggaggccctgggcacgctctggcctccccctcacagctctgggcctaggttcctgcaggacaaagtggcagcaggacagatggccgagcagacgagctcagagctggccatggcgggtgtgactctgccagtggcccaggcagtagagacaggaggggccgaggaagtcgcatgaagtggtacttggtgtcagcgccccacactgctgggaggcccccagagccagggtggtgccaggggaccagctcccaggcccacagcagggaccgcctgcaatatcaccaaggcaacgaggaccccacctccccagggcctctgacttctcagagttgtgcctggtcccctgtgggagcaggtcagaccagtgggctgggcagggccaggatgagacagccccagtggatggcgagcaggaaaggccgccagaggcccacccgggtctcctcgtccaaagcagcactggcccgggcggtgctcaaacaccggtgaagggcccaggcaagcgcagggctggggacctggatgactaggagggctggatctggaatcgaggctggcccagacctcgggtgtgtgctgggggtctgcaccttaccctgcaggccctgccccaggatggccaagctccgcagccacagggcctcatgggccaggcctcgggacctggatgcagcagcctcgcctcacttggccccaagtgctgccttggcagatgggctcccagccacacgtgcacagacccccagaccaccacccactccctcccaccgggtggcatccacgcccctgtgacaagctcagccccttcccgtcctcaggccaggggttccagggagcctggctccacaggccagggtgtgggaggaccgcctggccacacctcagccatgtggaggtggcacctgcacacccaagctcgcctgtccggctctctggccctgtgcatccactgtggctcccctcctgcagggccgcccaacttcctcccagggaagcccgccccccggcccccggcttggtcccctcttgggtgtgcccaggctgagctgcccccagggtcgccctcacctggtgtgcagggcctgccaggcggcgtcgatgtcggcatagaggttcctctcggaaggcctgcccgcgctggcaccgtagccggagtagtcgtagaagatgttgcaatggaggcgggagcccaggccaatgtagaagctgctcatctggctcaggtccacggcgttgccgtgcgagaagaagaccgtgtacctggcaccaggcacgcagcgaacatacatgcaggagacgcggttgccgcgggcgctcttggtggggaagacctcgatggtgtccagctcgcgctggctgtactggaagtcggcgcgctccgtcaggtgcagcttccagcgcccaggtgcgcccgaggaggcccgcagggtccccgagggggcggccccggccccaccaggccccggctcaggctcaggcaccaggaaggcgagcttggcagcgatgcggccggggcagggcgggcagcaaaggcagcagagctcactcagcgacagcccattcatggcgggcgccgcccgggccgggcctccaccggggcccccgccaacaacgccgcctggcctggcccggcaggggaagcgtgggggtgctccgagtcgcgggcaggggggagagcgcccccccagctaccgccccagacggcagccccgttaggaggccagggcccagccccatcgcggtccaagccgagccccagggagcctcgcaaccacaggtctccatgtcgtgccctgggaagcccatcccggcccgcgcccccgggccccagggccgcgctccatggctcccggccgcccgcccgtgcatccgtcggtccctctgcgccccggcccggcctcctgcaccgccaccgccgcagctcccccacggacggaagtgagtttactgaaattttcaagccacagaaagaacaaaagaagtaatatccattatattgtccaaaacaatagtacctggaagatctggaggcaaaaatgaagcctgagaatagcaggacatagacatatttcataacatagactcacagcagaataatggttatgttggttcattagggaagaaaacactaaacagctcttgcagatacactcaatatacagtaagatagcttgtgattttaacgagttagcaaagcagaacaatgaggcaaaagcaaacagaaacactaaaagaaatccattccctagaatcatttttaaagactttgctagatttaccaaagaattcagtattgacttattctgtctccattttatttcataatggaacccgtctaattttatgctaaatgtatgctgtaaggacaccttgctactctgaaaaaataagggatcagtggataaaagaccatattttattaaaaaaagagtgtgttttgatgcatgattttgtgactctacatttttaagtaaggatgaagaacttggtgattaattaaatgattcctcagttgctcatcaatgccatcagatgccttgaatatactgtgaggacagcatctggaagaaatggaggagatctgagtaataattcagatggagccaatttccacaatcttattttcccattacctgcagctctgaatttaactaagtctctgtgttaacaacttgtattgtttatctgggtgaatgacctcagaagacaccaggcagctggatgcctgcacttctttcgtgctaatggttcatatagtctcctcacccccaacactttgatacttccttgaaactggattacatatgagatagaaacaaagaatgcaggtggcataatgactctcaggagtcactgaatctgtgttcatgatgcattactgtgccagctgcctccctcttcttgtgaaggcccttctttattccttgagatgtgctcatcatgaaatagctacaagcatatcatctgcttgccttgcccgttatagcaaccatgaaaataaatttgcagcatcatatatagcccaaatattctcgaaagatgatcctaatagctctaataacaaaataagttttctacagagtagctatatgtacatgctctcagcttatgtaaacttgtgtttttattgctcttaaagcaaaatttttcctaaaattgagaaaagaactaaagttctttgtcattatatgaagaaagatacagcatctaatattgtgaacttctctattttgagatgttttcagacatcaagactggataataggctgggcacggtggctcacgcctgtaatcccagcactttgggaggccgaggcaggcggatcacgacgtcaggagattgagaccatcctggttaacatggtgaaaccccgtctctactaaaaatacaaaaaaattagccgggtgtagtggtgggtgcctgtagtcccagctacttgggaggctgaggcaggagaatggcgtcaactcgggaggtggaggttgcagtgagccgagatcacgccactgctctccagcctgggcgacagagcaagactccgtctcaaaaaaaaaaaaaaagactggataataaaattatttaacaattcggaacataaatttagaattgaaaaaagctttatactatactatactatactatactatactatactatactatactactaacacattttgtttgagcatggttgccttataagtttttggtagttcaatgaaaataatggctacttgtgagaaaactgaaatagactaggacatagtagatagagatagaaagaacaggtaaattaactgtctatgccacatggcaaagaaagtttacagtacgtagtcattaaacgtacatgcttataaatatataaccaatgatgaataattttaaatgcaatttagcagaattcagaccgttttatattaaacatatatttctgaatgaaatataaaatctattgaatgagggagacactttatatgtgtaattaatctcataaatagagaagacttttacaatagtttgtacactttagctataaactgtaattcaagagattcagtaagagtagctttttgtaacttaaatattctatattttccctgcatacatttttgcctttgatcatgtattttatttagcctgctaagatggtagagaaggtacagacagtaagcttttcaacctgacacataaattcaggttatttgaaaatggaatggtaaagtgttactgaagaacttttactatggttcgcatttggtaatatttcctaattattctataaacaaaatccaaaaaaaccttgatttcataacataaacttctgaggtctaaattaatcaataaaataaatttgttttaattaattattagattaaattatttatttaaataattatttaaataattatttaaataattaaattaattattagattaaatactagctgaggctcattagaggtaaactagagaattatcatcccattaagataaattttgattcagggaagtaacatcttggaagtttactaaatttaaatttaggaggaatttactaaatcaagtaccaagattttatttctgcaccaaatggaagacatatgtaaaatttaaatacattccattacttaatttactctttactatcatgagaattagtatagacagcatattttacacagagcatacaaagccttatcttcattgaattacaagtaaaatatatgtatgtacatataattatatatgtaatttagatattaaatgacagaatttacttatttacctgtgtgtgatggaatttgattctagtaattattccaggtacagtaactggttgaaaatgggacatgaagtaaactgatatgcttacaagtaattacagcaagcgaattcattgtaatgtctccaagcaaagcaagactacccacatgagataagaaatgagaggctacttattttgaccaagttagctcggtgacttggggaccaaggactacatgcacatggatgcttcttttgtacccctacccctgccaaaaaatatgtttccatggcaatatttgggaacccattatttcccaattgatgcttttactttcatataagacaacagttgatactccaaaatcaacttacattttaattaaccaaatacaatgttcctaaagacaaagagaaacatttcataacaataagagttaagccaacagaaagatagggagtatgaaaaaacagagaaaatcaataaaccaaaattaaatgcttgaaaagacaacacaattggcaaatgtttatttaggctaagcaagaaaaaagcagaagagactcaagtttctaaaatcagcaataaaagagaatccatcactgctagtaatacaaaataaaaataaaagacaatgcaatgaaaatcttatgctaaaaaaattagatagcctagatagaatgaagtcctagaaagacacaaactaaaacagactaaaggactaaggagcaatagaaaatctaaatagacctacaaaaggtaaaaagattggattgtaattttaagaacttataataaaattcccatctcaggtagctatcactctgagaaattaatatcaattgttcaccaactcttgcagaaaataaaaggggagagaacacttcccaattcatcttataaagccaggattactctgacaccaaagctatatcacaaaacaatatataacagtatctttcttttttttttttttcagatggagtctcactctgtcgccaaagctggaatgcagtggcccaatctcggctcactgcaacctgtttcctgggttcaagtgattctcctgcctcagcctcccaagtagctgggattacaggtgtctgccaccacgtccggctaatttttgtatttttagtagagatggggtttcatgttggccagactggtcttgaactcctgacctcaggtgatctgccaatctctgccttccaaagtgcgatataagtgtcagccttatatcacggtgagccactgtgcctggcccattgtttaaataaaattaaaaatcttcaacaaaatactggacaaactgaatccagcaacatataaaatagattatacactatatgcagatgtgatttaccccagcaatgcaacattgatttaatatttgaaaatcaatgcatacaaaaatcgcattaatagaataaaacacaaaaatacatgagcatctcaacagaaagtatttgagaaaatattacacattttcatcataaaacactccagagttatggacaagaagataacttcctgaaactagtggtagttatctatgaaacccacagctatcattatacttaccaaggagagagtgaatgactaatcagaatgaccactcttgcaaattctccctttttcaccttcctgctctcatcaccctcttttgctcctccatcttcccaaaaacattttcccccatcttttcccaaagccttctcccctctcctgctgctcaccaccattttatccccctccacctaccccaaaacttttttctcacacccccaccatcttttcacaatgccttctctccactcctgcttaccaacctcttttccccactcctgcccctctcccatatgccactcttttttcaccctccatctaccccaaaactatttgtcttcccaaccctcctccccctcatgctcgccaccatcttttcctcctccatctacccaaaaacttttctccccactgtctttttgcaaatccttccctccctcccgcttgcccattttccccacctttaccaacctctctttactcctcccacttgccaccctcttttccccctccatctgcccaaaaactttttacccaccatcttttccccaccctgttttcacaaaaccttttctccctcctgctcagccccccgtttttccctctcctatttgccaacctcatttccccctccatctacccaaaaacgtttttttttcccaccgtctttttcctattgcctttttgcaatgccttctcctgcttgccatcctcttttcccgttggtactcaccaccctgttttcctcctccatcgaccccaaaactattttccccctcttaccactccggtcgcactgcagtcgccatctcggccaccacccacagtgaggcgagccgcggtgccgcaggctgcagcctccagcatttggcaggtgtcttccttccccttctcctctgcctttaagttgggcacagaagagctgtgtaggcaaacaggaaagaacccgggatggtctgactcccccacctcagcatactttatatgcggagttatgcaaatgagttctgggactacatgttctgattggatgagagaaaaacctctaggcatacttagattggactttgttatcatgttctgactggatgagagcaagtcttaaaacgaccaatcagaacatgataataaagtccaatcagagtaggcctagaggtttttctctcatccaatcagaacatgcagttcaggaattcatttgcataccctccctgtataaagcatgttgagtgggcagagtcagggtcttccgtatattctccccgcaccatccgtgctcggcttagtgcaggaagaggagaagaacgggaagacaaccgcggcacagcagcttacgtgctgatgttggctgtggtgatggagcctgctaccggagccacagtggcccacagcgggagcatggccagagtggtggaaagacagtggggcaggtatgctatcagagctgcgctgcccgcggtgagggcagattgggggcgctatctggggttgcattgcctaggtgggttctgtgcagtatcggggactacgttacttgcggaggtggaacaggggaagggggtggggtgggggggacactattgaggatgggattaggtgtgctatcgggggccgtgctgatcatcaaggcagcttaggtgtgctatcggggcaggggacacgctgctccgagttgggggatgttacaggggctacactgcctgtggctggcaggggttaggggcactatctggggctgcacagccggtagtgggtggcgtgttagggacgctataagctactgtgttgtctgtgccccagggagggttaggtgtggggttgggtgtgctatcggaggctacagtgctagcagacaggttaggggcactgttgggtgttgcaccgcttgtgccaaggggtatgtttggtgtgctatttggggctacaaggggcaggttgggagcactgtcgggtgctgcactgcccatggcaaggggtgggttgggtgcactatcaggggctacactgcccagggcggggcgggcggggggggcgtgctatcctgggcttcactgcccatggcggggggctggttggggacgctgtcataggttgcattggggtggtagggggcgggttcggtgtggtattgggggctgcattgccagcagtgtgggggggggggtggttgggggcactgtcaggagcttgcgctgtcaagctagtagcaggttaggtgtgctattgggggctgcactgcccgaggtaggggggcggattaggtgcgctattgggggctaaactgcccacagctggcggggtttgggggctctgttggggggttgcagtgtcagaggcgggttaggggcattatcagctgctgcactacccgtggcaggaatcaggttgggggcactatcgggtgctgcaatgcctgtggtggggacgggttgtgggcattatcgggtgctacactgctggcggtggagtggttgggggtgctatcggggtcacactgtcagcggcgggggacaggttaggggtgctatcggatgctacactgtggtggagggcagggggtggggtgttgagagcgctatttgaggactacattgctggcagcggggggcggattaggggcactctcagggctgcactgccggcagcaggcagcagaggtggcagtgacagcagtggtctccacggaaaggacagtccttccctccctggactccaggctttacaaagcgattttctcctgcttaagtacagaggacatacagtgtttccgcaggaatactgagcacggcagggccccccacatctgctgtggtttcctgggttacaccctctcgctctgtgttgtggatactgcctgggacccccaggcaccgagtaacgtgcaccacgtgggggacggtgctctctgggtggaggctcaggaatgagagcccgcacttgggtggggagagctggctgggtctgactttttgctgcttccgttcccctaggaccgcagctctggtgggcccagtggttcctgcggagtggggagccgggcactgtggtgtctccagtccccaccacaggctccgattcatggccagcttgggccgaaaggggagggtgggtgtcagtgccttcgctgaaactggcacctgccacccagtggccagcatgaccaaggtgaggctttaatgctaccactccctgcatctgttctaggtttttctggctttgcctgcccagcagtctgtgcccacctagaggagtaggaggggccaccatgccgcatgctggaggctggagcccgcagcctgcagatggcacagtactacagctcgccttgctgcggttggtggcagtgatggagactgcagctcgaccccagcgatggaggctggaggtaggagggtacctggtggtggccacgtggtaggagccttgtagggtggggctggtgcattgagagcaacagcagcagtggttgtattggcatgggcattagtggtggcagcagcagcaagtctgtgagccgggaagggggtagtaggagccctgcaaggcccagctggcctggggtgggtaagaagcagtgggtgctgcagcatgggcctcggtggcagcagtggaagtgcagccagggcaaggagtcctcccccacctttctgcagtctctggagggcgcccacctcctgctggctcctgagccaggcatgagtggcagcattgtctcattcttaacaaaatttagggaatgactatttgtgtatctttttgcttgttttttgttgtgttaatcttggacttttcgaatttcatgaatcagggagtggataaaaggtatcataataggccttctaactctatcacctgatttttttcctttcttccagtctgttttttcttatcaccatcatcttgttctttattttcttatgctgctgcctatatttctggtttctattcttgtttctctttctggtcctcctgctttttgttttctttatcccaagcaatggccttaacaaactgaaactgagttaaaagtaaactacttgctagtgtgttgtatttttaaaataattggtccattactgtgttttagagatgagaaagtagttgcataatgatttagttacttgaatagctttgctttcgtgatcctgttaatgcgttgtaagtagttatgcaaggaatgaaaaaatgaagcatcaaataaaatactgatagcaaacagtcatttcatctctctcccatatagtctggagataaatgcaagtcagggggttaataagttccaaaaatttatgagatcattaagtgaaccacattcccttcattttatttttctgccacagttttcaagagcgttgtcatttgcatgagcaaaccttgttcaccacatctttgcaacagggaagggaaggggaggatcatatgtacaatgttttaaggcaaaaaaactcacaaccaaaagcaaggctttattaactttcaccttcgagaagctgcagtgttgagccctgttttattcctagtattactgcctttgatacgaactcttaagtgatcactttagaagttaatgcattttattgactgctttcaagaaacagtctatattgtatcatgcatgtttttcaagcccgcagaattgtataaggcctatatatacatagggcctataattttgacactttttaatgatttataaggttacgatcatgtaaaatcctgttgacacgtgagaatatgcctaagtaccgctagatagcttattttgaagagatagttattttgaagagatagaaattggttgcagtttgttaggtgtatttgtcaatgcattgcctcaatgctttaaagcatatagaagtttgaatatgctttaatctcatgtagtcctttgtttatagggtgtttaatatttttaaagactaaagatgtcacagccccctttaaggttcagtaatattaagattggagatttatagggttagaatccaacaaattcagaggaaaattgttaaattatatagctgtagagcaggaaatgaaacccaggttctaagctctaaggggaccatgagctgccataccaagtgcatcagtgactgggcatagagttggcagaattacaggatggttaagagagtgagctgtagagcctcactctatgtgaacatgaattttatataagtatgtatgtatttatttattttgagatggagtctcactctgtcgcccaggctggagtgcagtggtgtgatcttggctcactgcaacctctgtctcccagattcaagcaattctcctacctcagcgtccccagtagctgggaatacaggtgcacaccaccatgtctggctaatttttgtgtttttagtagagttggggtttcaccatgttggccaggctgttctcgaattcctgacctcgtgatccacccacttcagcctcccaaagtgctgggattacaggcagccactatgcccggctgtgaacatgaatttttaaactgcatggtgctttgggtcccagcttctccatctgtacaatggggacagtactaaggttttctttttcttctcagttgactgaattatttccatagtctgtctgtcttgccactcttgttacccacacgaaaggacctaaggtaatttctgacagcctgggactccttgtgcaaaacagaaggtgccacagacctcattttaggagaaacctttgttttcctcttggaaccccaagaactgtaagcagacaggtccatctcaaaatccaaggctctgctctgttttgctttgctttacctgactttttttttgatttgggtgggcatcaaaaattagtaggggagagctaaagaaagttgtggatatgaacatgtatttatggtaaggtaagttatgaaggagagaaatcttaggatcttgtatggcaaattcttgcactaaagtagataatgactaattaggaaagcaggaaatataggacaagtcagaaagtcataagatgggagagaaaagcttacgcctggtagatcctctcctgtctagaagtgtcgtatgtgtgatgtttatatgaaggagctctaattaattggattaaaagataatgaaagctctaaaattgtcagaaaaatagaagctctaatgccttttatttcacgtgacttcagcaatctttgggaaatgagagttttaaaattattggtggtaaaaagtcttcaaaaagtagacatttggtctaaattaagtcagaggttaaattggctaagtgctttaatgtcataaactgcttctttgactttggaaaattgttcagtttacctaatttggaactgttagatttctaggtaaggcctggggagaggtggagttagccatgtctcctagctatgctggaagagttagactttatctgcagttctgtcatgtatcctggactctgcacctggtatgtaattgaaactgcttacattgaaaagaaaaattatgtgtttttggttttaaaaggggtgggaatatggttttttccaaaaagtgagttttggcaaatttagaaagtttaagaattatttttagttgtaggaaaataaagtttaagcaagttatagaaggtttatgaaaattaactttgtaaagaattgtgtgtgtgagcaagttgactaaagggacagtaatgttagatgtaataaatgcaggtacccttccactttatcttctgtttcttaggttataaatattcactacctacgtttctaaaaactctttcactataatattaacacataactccattctccttgtattgcctgctttttcatagtatcctgaaattgcattagtagatttagattcagaagatggtggggaagcatcttatgagtgttttaagtaaatttaaggcaaagggttttctgtacatgggtggttatcacagcatcacttgttgcagcaaaacactgggtaacaacaatgtttatcaatgagaaattgttcggataaatgatgatttgtgccttgcgaggctcaactattcaaaagcaccctcttttcctcacttgctttacctttggttctgggcctggagcctttcagaggttactcaggaaatggactcctgtttcctgtgactaatctggacagcggcttcctatttcattcttcagcatcttccaaaaatttctgaagataatttcttcctttgtgaccacccatactcttggtttactttgcagttaacaatttcatgccttcactagattatctgtgtgaaggtgtggggtgtatgtgttcatactctggagggagcagaggaaaatagccacagccaaaggagtaatcttgcactaaatactcattataagaatgttgatacgttcatagatggtaaatctgtcagtaatttttacttgtatgattcttggttaagactgcactcactggtgataagcgtgctgaagggatcataggtgctatacttatgtgtgggaattgcattcaaaccaccaatgcctgtctactcaagttttgttgccttttgattaaaaactcttgggaatgtttccctggcatgcaaatatgggaactgcagtttgattctaggtagaaactctttggtagttgaaatgccataataagagacacagctgtcaatgggcaacaattcactgttggtaaggaatttacagtgctacttgccatattcttctttatccagactttgtgccaagaaaatgaaattctttttaaaaatttttttctagagtaatcctacaatattgctgttatcaagcctgatgctgtaattagtagaaaatgtctagaaattaaaagaaaagtagtattttccaactatggttaaattaattgcaaaataacttcctcttaattgtcagattggagacaagcttattaagagtgaaataaaacataatgtgttgctggtgctaggtacctctaaagcctttgagcactttcttctttataaaggctcaatctactcatgtgtcctgtaaataatcctgctctaccagcatcctatgtaaattttaaaaattatagttcatatattagattgtaacaaatgttgttcttctttaattatatgcaatgcaatcttgttatagactcacattagcttgccttattccctgtatgtttgctgtaaaatgtatagtccttttcaatatatgatagcttaaagatggacttaatattttgttttagaaccaaaatcttttatcttatatacaggaaaattacattggaattcagagatcagcaaacatttcctgtaaaggatgaaatagtaactattttcaggtttgctcagcatgtggtctctgacaactaaactctgaagtcataccaaggcagcatcagtaatgtttaaatgagtgaatggcgctgtgttccaataaactttatttacagaaacaagtggtgggccacattttgactgcagggtatagtttgtggacccctgaacaatggctttttctgaaacaacacaattgaattgagatttgaaagaatgttgaggcagcattgtttgtctggggtaatacctgaggtttgtcatctcacaccagggaaatcagggatgtggacacacaagaagtgagttcaagagtggatgattaataggtgaaagaaagagaaaagagaacagctctctctcctgcagaaagagagaggggcacctgagtgggtcttccggttttgtggtgaaaagcacaaggttttataaaggagcttgaggaggtggtgtcttgatttacacagggctctagagactggttggaccaggtgtgaacgtttgcatagcacagggagaagctggccattgcaccctaatcttttattatgcagatgggttctttaccttaccaggaccatattgtctgttccttactgtacctgtggttgacagagaaaagggaagatggagccaccatgttgaacatgcctggcccacaggtagccttttcctattggcacagctgctggcattcctatgagagcttatcaatgtctgcagcccaattttacaagatgctctttgttagaaaataaatgatatgggttttttttttcattagtaggaaaactttacactaggacttccttactttcagtatctgcctaaataatttctttttaattcctacatcaatgttgcatgtgcaatagagaaggtgacatgtagggagctgtgtcagcaggggttgcatatttcttgatgagcatcccatgatgcattcttcttcacttgtggcaacattagcattaactaatctacagtaaagtagatgggtccacaggtcatgggacatacactagctctgccaattacatgttgatttaaataatatcattctctaaggacagctttttttcccccagatcctggtatgtatgtggagttggggagagacaccaaactgtaccccatttcctcatacattgcttatacttttagaagtgtttgaaagataatatcacatactagtagtttactgtttcttattcaagttagttttaatagtcgctagggtgaatgttttcaaaattgtatagatattcgggttgaggcaatactataaattatgagttcatctcagtttttttgtgctagcgtaatgacatttcggagacataatgcatatgtgcaaaatacttcacctctctggaaaacagtaaagggctacataataggacagacaaaaataaaggcttggcgtaatggctcacacctatgatcccagcactttgggaggacaaggcgggtggattgcttgagctcaacagttcaagaccagcatgggcaacatggcgaaacccatgtttacaaaaacgataaaaataagccgggcgtggtggcatgtgtttgcagtctgagatacttgggggactgaggcaggagaatcgcttgagcctgggaggtcaagggtatagtgagccgagatcgtgccactgcactccatccagcctggataacagagtgagaccctgtctcaaaataagtaaaaatttataaaacaaagaatgtttctaactgtaataaaggagaagtgatcaagcttaagtgtagcttagatttaatctttgatttccgggtactatattacttaaaaatatgatttggatatttagaagttgttcaaattagaaactcaggagtggggtcactggtcactaaggtgctgaatatttttaataccttagtggatatgtaatcaacaaagccaacggaaccaatagagcatttgctttcataagaatttaagtgttgctgggtactcttaaatcgagctcacattattggtgtcatttaatataattactgaatttctttgaacccagtttccactttttaaaaattatttagctcattaggctgaaaacttctctttgttacattttattacacttcagtgtaatatgtgtaagatgtacattgcttctctctagaaaggtgagacaagttgaagcagggttgggggtgggtgcttccagttcataggtaaataggagacaaacggttgcattcttttgagtttctgattatcctttcactgaatacacaatttacatgcaagatgccatagaggaatagtcacttatgcctgagtctggcttagtgaatctgcatttttacataaaaaactgggcagagaaagccaatcagatacacatttgtctcaggtgaggagagggatgactttgggttctgtcctttgtcccccacctgtaaagataatctatcaattgccaatttatattgccagggtcaaattcaacagaactgttttagtgtaaagatcttgaggcccacaagaaatttcctttctgacaaattatgagggaggtatatagctttcgaaatctttgtagttatttttttattttattatttgggttttttttttctttattgacaaataattgtatatactcacagggacatagtgatgtttcaatacagaaaagttatagtgagcagagcaggataatttcatatcctttgttaaaggaaaataaatctccgggacaccccactaagccaaataatagttatcttatttagaaataaaatgggaggcaggtttgtttgatggagttcctagctgaggtgggagaattgcttgaacctgggaggccgaggttgcagtgagccgagatcgcgccattgcactccagcctgggcaacaagagcgaaactctgtctcaaacaaacaaagactatagaaaagctatttgtgaaaatgctttttgatgtgctgttttatgtcacagaatgcaacctgtgttttgattcagcaagttcaaaacactctttttgtggaatctaagaattgattattttgatcctattgagctttcataagaaaatatgaatatccagttgtaaaaactagaaataagctataagctatctgtggaatgctttgtgaggtgctgttttatatcataaaattgaacttgtgttttgattgaacaagttgaaattactcattttgtagaatctaagaagtaacgttttggaacttcttgagcccttattaaaaaatagaaatattcagtcctaaaaactagaaacaagccatccgtgcaaatgcattgtgatgttctgttttgtatcataaagttgaacctgtgtgttgattaaacaggttctgaacacttttttttgtagaatttatgaagtggcatttctgagcctattgagcccttatacaaacatacagttttaaaagctagaaacaagctatctgtcaaaatgctttgggatgtgctattttatgtcacggaatgaaacctgtgttttaattcaataggttcaacacattcttttggtagaatctgagaagtgacattcccaaacctctgaggcctttaaaagaaaatacgaatattttcctctaaaaactagaaacaagcaatgcgtggaaacgctttctgatctgttagtgtcacagattggaaactttgttttgattgagcaagttcaacgcactctttgtaggatctaagtagtgacatttccaaacctattgagcccttataagaaaatatgaatatttagtcctaacatgctatctgtgaaaatgctttttttttttttttttggcacagagtcttgctgtgttgccaagctggagtgcagtggtgtgatctcggctcactgcaacttctgcctcctgggttcaagcaagtctcctacgttagcctccctagcagctgggactacaggcgtgcaccaccacgcccagctaatttttgtatttttagtagagatgtggtttcaccatgttggccaggatggtcttgatctgttgacctcgtgatccgcctgcctcagcctcccaaagtgctgggattacagacgtgagccaccatgcctgactgaaaatactttttgctatgctgtttcataacacagaattaaacctgtgtttttgtgagacaggttccaaacactctttttgtagaatctaaaaaagtgatgtatccaaaccttttgagccataataagaaaacatgaatatttagccctaactgctggaaacaagctatctgtcaacacactttgtgatgtgatgctttatatcacagaaatgaacttatgttttgatgaaacagattcaaaacactattgtagaatcttaagaagtgacatttctgagcctattgtgaccttataggaacatacaaacatccagtcctaaagtctacaaacaagctatcttggaaaacactttttgacgtgcagttttataacacagaattgaacctgcattttgataaaaacacgttcccaactctctttttgtagaatctaagaagtgacatttcgaatctattgagcatttacagtaacgtatgaatatcttgtaataaaaactagaaacaagctatctgtaaaaacactttgtgatgtgctattttatgtcacagaatggaacctgtgttttgtttcagcaagttctgaactctttgtagaatctaagaagtgacgtttttgaccttattgagcccttataagaaaatacaaatatccagctataaaaactagaaacaagctatcagcgaaaacactttttgctgtttcatatcacaaaattgaacctgtatactgattaaacagtttccaaacactttttttgtagactcttaagaagtgatgtttctaaggcagtgaggccttatgggaacatatacataatccagtcctaaaaactagaaacaagctatctgtgataaccatttgtgatatgctgttttatgtcagagaatggtacctgtgttttgattcaacaactgtgagacactctttttgtataatctaagaagtgatgtcaccaaacctattgagttttataaaaaatatgaataaccctaaaaacgagaaacaagctatctgtcgaaaatgctttgtgatgtatttttttatatcaaataatggaaccagagttttgatgaaacagcttccaaacactctttctgtagaatctaagaagtgacatttccaagtcaattgagttcttacaaaaaaaatgcaaaatccagtcccaaaaaactagaaacaagctacctgtaaaaatgctttgggacatgcagttttatgtcacagaacggttcctgtgttgattcaacaagttcaaaacactcttgatgtagaatctaagaagtgctgtttccaaacctattgaacttttattaaaaaagtaaaaatatccatccccaaaaactagaaacaagttatctctgaagatgctttgtgacgtgatgttttatgtcacaaaatggaaactacgttttgatttagcaagttctaaacactttttctagaatataaaaagtgacatttctgagcttattgagctcttagacgaacatacaagtatccactcctaaaaatgagaagaaaaacctatctctgaaaatgcaatgttatgtgctattttacatcacagaatgaattttcaaacactctttctgtagaatctaagaagtgaaatttccaaacctgttaagcccttataggaacatatggatattcagtcttaaaaactagaaacaagctatatgtgaaaatgcattgtgaagtgctgttttatgtcacagactggtccctgtgttttgattcaccaaagttgaaacactcttttggtagaatgtaagaagtgatgtttccaaacctattgagcttctataagaaaatatgaatatccagccctaaaaactagaaataagatatctgtgaaaacactttgtgatgtgctgttttatgtcacagaatggaacctgtgttttgagttgacaagttccaaacactctttttgtagaatctaacaaagtgacatttccaatcttactgagcccttataggaagatgtgaatatccagtcctaaaaatgagaaaaaaagctatgaaattgcattgtgacatgttgctttatgtcacaaaatggaatctttgtttttattcaacactttcaaaactttttgtagaatgtaagaagtgacattttcaaacctattgagcccttataagaaaatgcaaatatttagtcataaatattagaagctctctgtgaaaatgctttgtgatgtgctgttttatatcacagaattgaacctgcattttgatgaaacagcttccactcacttttttatacaatctaaaaggtgacatttcctagcctcttgagcccttattggagcatatggatatcctgtcttaagaactagaaacaagctagctgagaacatgctttatgacatgctgttttatgtaacagaatggaacctgtgtttttagtcaacaagttccagacactctttttgtagaatcttaggaagtgacattttctatttttattgagcccttataataaaatattaatatttagtcctaaatattaggaaaaaacctacctgtgaaaacgctttgtgatgtggtttcatatcacagaattgaacctgtgttttgacaaagcaactttcaaacactgtagaatctaagaagtgacattactgagcctattgagcttttataggaacatacaaatatccagttccaaaaactagaaacaagctcttggtgaaaacgctttgtgacatgctgttttatgtcataaaaatggaacctgccttttgatgaaacagcttccaaacaggtttttttttagaatctaatagttgacatttctggccctattgagcccttatagaaacatatgaatatccagttctaaaaactagaagcaagccatctgtgaaaatgctttgtgatgtgctgctttttgtcacggaataatacatatgttttgattcaacaagttcaagacactctgtagaatctaaaaagtgaagtttttgaacctattgagacttgattaaaaaatacgaatattcagccctaaaagctagaagcaagcaatctgtgaaaacactttgtggtatgctgttgtatgttatggaatggaacctgcattttgatgaaacagcttccaaaacacttttttgtagaatctaagaagtgacattttggagcctattgaacccttacaggaaaatacgaatatccaatcctaaaaactacaaacaagctatctggtaaaacgctttctgatatgctgttttatgtctcagaatggtactggggtttcaattcagcaagtttgaaactttctttttatggaatctaaaaagtgacatttgagaacctattgagccgttataaaaaattcaaatattagccataaaaattagaaacaagctagctgtgaaaacgctttgtggtgtgctgttttatgtcaaagaataatacctgtgttttgatttggcaagttcaaagcacttttttttctagaacctacgtagtgacatttacaaatctgttgatcttttataagaaaatatgaatatccagccacaaaaactaggaaaaatctgtgaaaatactttgttatttgcattttatgtcacagaatgaaacctgtgttttgatgaaacaacttccaaaccctctttttgtaaaatctaacagtgacacttatgagcctatggagcccttatagaagcactcaaatacccagttttaaaactggaaactgtctcaaaaacactttgtgaggtgcttttttatgtcacagaatgaaacgtgtgttttgagttgaacaacacacaagtttccaacactcttgaatctaagaagtgacattttcaaacttgagcccttatagaaacatacaaatatccagtcctaaaaacaagcaaaggctatctgtgaaaatgctttgtgatatgctgctttgtgtcatggaatggaatctgtgttttgattcaagtttgaaacactctgtagaatctaacaagtgatgttttgaacctattgagtcattataagaaaatgcaaatatttagccataaaaatgagaaacaagctttttgtgaaaatcctttgtgatgtgttttctatcacagaattgaacctttgttttgttgaaatagtttctaaacatacttattgcagaatctatgaagttatatttctgagcatttgagcccttataggtacacatgaatatcagattctaaaaactagaaaggagctatctttgaaaactatttgtgatgtgctgttttatgtcacaaaatgataaccatgttttgattcaaaaagtttgaaacactctgtagaatctaagaagtgacatttctgagcctattgagcccttagtaaaaaaacaaacaaaaaacgaatatccactcctaaaaaccagaaaaaagctatctggtaaaatgctttgtgttgtgctgtttcatgtgacagaatggtgcctgtgttttgattaaacaagtttgaaacactttttttttgtagaatataagtagtgatgttttagaatgaattgagcccttataagaaaatgcaaatatttaaccataaaaataagaaacaaacaacctgtgaaatcactttgtgatatcctttttttatgtcacagaatggtacctgtgttttgatttaacaaatttgaaacacactttttgtagaatctgagatgtgacatttacaaaccaatcttaagccagttagatactctgatgagccagctgtgtgtgtatgtgtgtatgtgtgtgtgatctttgattattaaaactgaaaaaataatcgtatattcatgactagtagacacagtgttttaaaactgattctgaaagatttgagggttaggcttgttttaaaaacaattgcataggtcctggaaacaccaagaattagtggcttctcattcctagtcacatgaaaaatattttactactcttgtgaatggccataaataatatgcagaattttttctgtgtcctaaccttttatataattggttctacagtgtacatcactgtgtgcaactttgttttgtgtgctcagacttacattttccagttttctccactttgatacaattggtctgtgtttcatacattttgtattttctatagcgttcctttatatgactctaccacattttattgagtctcctcatgctgacaggtaagtagatgaattaataaatgaatgaataaataaaaatgagagcaaatttcaaacaggtgattaatttagtgattgtaaccatggactcagcaggttagaaataaaaactgaaagatttagaatgcaagcaggcacatcataccttctaatagccattggaactatgacccacaaaccattagcctagaatgatgggacatatcttgtctctaaaaaaaggtcactgttcagttctcaaagaatggatataaaaatggcagataccattccacattattctacttcctttaacctctacgcataaaacttgagctgcagggaatgttacctcctgttcttaaaaagacttgtagttcagtgaggaactcactcctttcttcattcatgtgttcaaataatatagggaaatgaatggaaaagtgaagagaagttgaagactattatggggatagcacaggattagtcagcctcatggtattattgatctgccttattccacaaatatttaccaagcacctgctacatgcaatttgtatactaggtgctggggatacaggagataacaaagtccctgctgtcaatgaaaggggtcagtcctttgattcatctttagttaattttaagcacacaacaactatctcaaactttcttcacactttccaagctcccgatccttcatgcactcttggtagatgcctgaccttacctcttaccttactagaacctaagaccacctggtataaaatcccttaagcacactcagatttgcgtgattttacaatgatgtctgttcccaaagcatcctcacttctcttggagctgagggtgaagagctcctctttcttcccatccgtgatcttggaacatgtacgactacacttgtgacagtaaatgcttaatacaggcagaaggtttgttccttatttcctccctggggcctccctccagtgaatatctcttctagcattgtcagttgtatccaacagaaaagcagagatctctccattggtccaaaaacctaagatggactctcactgctaaacttctcaaatgaaaattcctccactttagtcctgattaccactcaaacactgttagactgggcaggtcactacccctgcctagttctgtttccccatctacataacagagaaataattgcgccttatctatcctacagaagtgtgaagaggtttgatgtgacagcagtgaaagcaatttaaaaagcacagagtgctatacataagaagacattttcataattattccgctctaacatgatatctgtattcatacgatctcaaagtacttacccaagcatggattctaactcttgtgtatgtaagcaaaggtgtaagtctgtcaccctccatgcaaatagaatctcccctcccttggcccctgcatctcaccatatacaggaattaactcaagatgaatcaaagttttaaatgcaagaccgcaaactatgaaaatcctttaagataacctaggccatacccttcttgacaaaggctttggcaaagcatgtgtatgtctaagtccctaaaagcaatagaaataaaaacaattattgacaagtgagacctaatacatgaaagagtggctgcacagtagaagatattaccaacagagtaaacagacagccttcacaatggaagcaaatgttcccaaactacatctgacaaaggtctaatatgtacgatctaccttaagtccttaaatcagatcaaaaagtccaattaatggttagagacatgaatacacactgctgaaaagatgtaacagccaccagtaaacatgaaaacatgctcaacctcgttaatagagaaatgcaaatcaaaagcacactggtcaaaatggtgattataacacagtccacaagaacagataccagcaggacagaggagggcactggggcaattgatcatgattcttatggatagtcatttagtgttattaatgaatttcataacaaaatgatcaccatacaaaaaatacaaaatgtgttttcttccctgagaaaggaaaataaaaacttggaatgccgattcactatgccaaaaggaaaagttaagctgaaagctgagtcatgcaagaaactgcctttctttttttttcctgagcagacagctactgataaatagttaaatttctccacaggtagctactctatgttcatctcatcttacttaaagtgctgatttactgagcaggagaaaaatatataactgactattcctttacctgtttgttttctcttgcaacatgtggattcagcaacgtgaccatactctccctcttttccccgcagcctgcttttctcttctaaacactgaaaccctaaaatatttttggagaaaggcacagacctctgtcgcccagccatgtctttaaccttggaagaagaaacttctaaattgataagagatctgtctcagacactttttcgtttacatcccgttatctcagaaagcaaaacaggctttgttccaacccaaagtaatttgtgaatattcaagcggtatcattctgatgtaaaatttacataaattcttgggtttaccaaaatgcaaatgggcaagcagatcactatttacagataatggcctaaaaaatggtaagagtaaatgctgtggagctaaatgtttctgagtctgccatttcctagttttgtagtttctctcgggcaagttacccaaagttgctgtatgttattatcttgacatttaaaatagaagtaataactttattataaataatagttaataccatagggtcattaggaaagtgtctggcatatatagtcacaacccagtgaatgccattattgtttttgctattatcagtataataattgatactaattttgatgctgaggtaaaataatatctggcagcttttaatttgctaatgttaaataactgaaaatagctttaaaaagtgaaaatatccaaatcaatgacaatatttgatttatataaaataagcttcattttttttagtttttttgctcctaattattacttcactcatcacactgatatctgagcactttttaaaacatatccacccttctcagttgtactacttattcccttttcttgtaatcccagccttcaaagatcctttctcatttttctaactcatttcacgactccctcaccttgacccccagttatatctctcttgaagtcaattccattgaattgactacttggcccaaacttcaccccaactcagtctctcttcaggaaggaaagtccccacacaaaaaggaatgtgtctttcaactcatgcgccctttttgaagaagctttccagacagcttccttacagtgatctccgttatccatcctttagatcgctgtggagtcctacaggggcgcaatgtggacagtcattcaaatgaagcacacctaagtgcttgcattttctaaaggcccattgattcatgtaactcccgtacttgcacagataagatgttcctgcctgaatgcagcagatggaaatgaaaattgtattctctgtcaaggctgattgtattacagcttaatgatttgcattttaaaacttggaagttctcataaatattaaagtgaaagaacaattggctacattattaggtaggttcggctgttcgtataacctggtgctaactatctaacctgcctgagtgagcctcagtcttcattactgcagcatttgtaagatatcaatgcctgcttgaactcatgtcttactaagattatggccaggattgagtaacatatggatataaaagcacttgacaaatcagagtatttcataaatgtaataataatatgctacatttataacatctatactcttttcctgtgtctatcttcatttaaaccttgcagtttctatcataatcaaagattttgtaatcaggttacaatgagtaggatttaacccataagcaattttcaaatttcctagatatgttttcagttttcacatttatgttggtgacaaaattctgttttcagttttggtgtttgcatcttctaaaacagtgtcttgggtacttgctctttgatgagacactgtgcagacataaagagtgtaagaaaacagaacagtttatctcagctttttgtggtctagataacctgcacactgctttcttggctcactgcaacctcctcttcctgggttcaagtgattctcctgccttggcctcccgagtagctgagactacaggcatgtgccaccacgcccagctaatttttgtatttttagtagagatggggtttcaccatgttggcccggatggtctcgatctcttgaccttgtgatccccctgccttggcctcccaaagtgctgggattacaggtgtgagccaccgtgcccggcctgcacactgctttttaataagctgatctgtcttcttgtttacataggctgtgctatagtcatttaaagttcaaaattactgctaaaaagtaattaatcctttactgaaatattcctgctatttcatgagctgtcttacaatttggaggaatctatttgtcactgatgtttaaaaaagaaagtcacagcagggaggctttagcttcattgaggaacattattataaaataaaatgatcgagggtaatttttttttgtccttgtggtactgtttctgcagatctacattaatctgagcatttaaagtaataataaatttgttatatcctctttattattcacttcaccatggtagcccctagtggtaaaaggagatgtaaattgctcagtgctcacattgcagggaattttttcctcagttgaataaaaaggagttaagcctctttggaaatgagggctatagcctgtcaataactacatatattcctgtttttaagaaatcagaattctggtgtccagtaaatgtagatgccagcattattaaaaagtgattgagcagagaaatgaattgaatttttgacccactctggcttccagctttcatgggagcctatacagggggatgatgaagagggatataagagaataaatgattgctctattaatctactttaattgatactaaaatctgacagcgaattacaagttccaggcagtaaggcttaccaattcattggtaatttcaaggttctactttgctttctttttgccttcagctccttgcaaaggacacctttttttttttttttttttttgagatggagtattgctcttgttgcccaaattggagtgtaatggcccttaacatccgcctcctgggttcaaatgattctcctgcctcagcctcctaagaagctgggattacaggcatacatcaccacgcctggctaattttgtatttttagtagagatggggtttctctatgttggtcaggctggtcttgaactcctgaccccaggtgatttgcctgcctcagcatcccccgcccaaagtgctgggattacaggtaggagccaccacacctggccaaggacagccttttatagttcagtttctcagtttatctttgactattcttaattaagcttgacctggttctccaccactgacgctattggagttgcaaagcattttgctgttataatgatagctcccttgatggctgttcattattaactggttttcaaaagtgctgcttttaactttcattttataaatatttaactcaatttttataaaatgtgcatagactatagaggttctgcttacctgtttaatacagtaaaaaaatcccttttgtaatcttatataatattaagaatgtgtccttaattcatgcttaacataaattcttacacaactagcagtatctcaaaaaataaatgatttaatagtttatgacccttatacatataattaattgtagtaaaatatcttagaaaatagaatgagtattttttataaagataaaaaatcctgatttttttttctggtcttaatataaaattaaatgtgttaaagggaacttataaattacatagtagttcattgctcaggaaaagaaatgacaaagtaattaagagtgtaaaattaaaaggattaatttttcttaaaggccgatgagttaacaacacgcatcaatctctcttccttctccaaacttcagacaaatgatggcaaagtaatttttaagaagtcaatttatagaggcaaaaaacctgaagtacagagagtaggaaagacagtaatagaattgagagcagttgacatccataacattcctattattacctccattttctggataagaatatggagaagaggaatcgttaagcaatttgctgattgtcacatattcagtaagtggcaaagttagtattgaaacccaagtagtcttgttttaaagtcatacactcaatcactgtgccataattcaataaattgtgaaggatgggaagcagatggagaagtgattgatgaagcaggactgagaaagtgctgcctatgtgcccacagtgtgaagaccctacaagacatcagaacatcatccagtgaagctgtgagcagctcaccacttggaaaaactgagtgttttggaaggcagggataaagtgcagttctgaaaagagaaaaatccatcaagttctaaacggtcgcgctctcttaccccacagtgggcaatggtctctccattcatcattttcttttccctgagtcccttgaatcttaaatatactattctgtgaattaaacatggtaaacattagactttgaccagcgctattatcagaagttcacatacctaatcaaaggacctgtaaccttcttcccctccttagtttctacaccaccagtagccaattatactatcccagctcccatcctaaaatccccttctaaaatagaaggcaaaagatcatcagtcatttgagcaaaatttcagcatgacagcatgagtagttgagacctatagtaacaactaaaatggactgggataaaacaaataatgtttggaatcaaagaacaggaaaaatacaaccgatattggagcaagaaaaaataaaaaagaatatgaaaaatagataagaaatagctattggaaaggtacaagaaatacaattttaaaaccagtggaacataagacaaaccacaaaatgagaaaattctattaataaaaggtcgggggtcggggaactgtattctttttttttttttttttttttttaagacagagtttcgttcttgttgcccaggctggagttgcaatggcgcaatctcggctcactgggcaacctccaccttctgggtttaagctattctcctgcctcagcctcccaaatagctgggattacaggcatgcgccaccacgcctggctaatttttgtatttttagtagagattgggtttcaccatgttgatcaggctggatggtcttgaacccctgacctcgggtgatcccaaagtgcagggattatgggtgtgagccaccgtgcccggccactgtatcttttaaaaatgtaattgtcatggaaggcaagaaaggtttaggaggctttccatattgaagaggactgaggagacatggcaactaattgcaatacatgattctagactgcatgcaatactggaggaaaatcatgctataaagaattgactcaattgataaaatcagaatactagcagtagattacatcaaagtatcgtatcaatgttacatttactgaatctgactaccatactatagttaagtaagagaatattcctatttttaggaaatacagaagtgtttagaggtaaagggtcatgatatatacaacttaacaaaagacttagacaaatatggggtatttaaataaaggagaatgacgtgcaatctgagaacaagaagtccaacagagaaaagcaaaaatagggagtcagcgagcaaccagtgagatgggagcagaaggatggaagggtggaggagtgacatctaaacatattaagaactcaaatatgttgattattttgtatatctgaagtttgaaattatcactgacaatcttctaaacttcaggaaaaatgaggatactgtgctacaaatgtaaacttaagaacaatatttacatagtcatcataatgtaattatgaaatactgatttcaccaaaaccaatttgatttaacacatcgagagaacagtgggaatagagtcctgtaattggtgcacctgtcctaattcctatgtaggtattataatagaaagttaataggtaatgtttaaaattgataaatcaagataacaatatcagcatgttaggttaaaaacaaggtaattaccaaaagcaccagataaaagagccaaacattgctttctctattgaacgggactacagcatagagaagtgttaagcaagctgccattattcttttgctcttattataagcctcttaatactatttgattactagctcatgagctcctatttataaaaataaaagcaaattttcgaagtcagaacaattcatgctgctacaaaatccctaaagtcatttcaacaatacagcacactgatgattatatagacatttttcttgtctgagttctttgtctagaaactttttaaaagaaacgtggtcctgtattacatgtagcatgctttggaagaaaaactatctccaatcaaaaagtttttaaaagagcccagatgttatcgtcctttgtatctctaaaagcaattgcttttataaaattaggatctactcttttttgaaatttgaatgctgaagttttgtgggtttcagcaaaagataggcataacatacatctctacattttattaaatatgatggtgcagatgttaaaaatatgtttgaaatgcagtaccttctgttcttgctttcaactcctaccctagagtaaatgaaatgctaatcacctcttgtgttagtgatagaatttgtgagtttccacagataaaatatgtttactgtaatttccaaatagttgatagccagtagcaatatcttgacttcagcaactggtatgtaagggtctatattaaagtgtttatattatgactagtataacagatggtattatttgttacagcaggtcataacactaaaaaataaaactattacacatctacaatttgatcacaaattttagtggcagtgatcacttattttatgaaagagaggcagtaattgccgaagtactgcctaaaaatgtaagacaattctcattacagggtaaggtaaaattattgacttattaaccagaaattcacatctatcccgctacaggaaaaaaagtgtacatttaatatctactacagtcagttgagttttcaaagtaatctgtcatctctaccatgaatatggggaacaggagaataactgctggatttttggcatttgacacctaatatatagaactttaaaggaggttatctattatataaataatctttgaagaagagcaatttatgtttttggacaaccaaaaaattacttgtttagcttcacaggaattttaaagcatgttttcacttattattaaacagtaacattgaatatactgctcttttatcagttctcatttttttcaacattcagtagatgactttaaagaactctcaccttcctggttttctttctaaactgagattatttcttctctcacttatgcacctattttctaatggccatgtctcaaaaaatttttattctagcgtcttttttccttttatcttggttttgctgtagtgctagatagatggttacttgtgagactttcaaatctatataccaggctccaacttctctccctctccctctctttttgagtaagggtttggctccatcacccaggctggaaggtcatggctgattgcagctttggactcctgggctcaagggatcctcccacctcagcttcctgattagctgggactccaggtgtacagcatcatgactagcaattccattgtttttagaaatggggtcttgctctgtcgaccaggctggtctagaactcccagcctcaagcaatcctcctgcctcagcctcctaacgtgctaagattacaggcgtgagccaccacacctggccaacttctaagtttcagtgctgtagttttaaattgtttctcatacttatctaatattttttcccaccatgtcaaacccttaaaaactcagtatggacaaaataaatattaacttttttgagattgataattgtatgatagtgcttattacctcaaaagaattactggggcagcagtataatccagtagatgggggaaatagtggatattaagaccgaaatgggatcataactttttagttgtatttgcccacattaattgttttaaagggggtaaaggcctggaatatgaaaacaggaggatataaaatatatggaggttgtgaaagatgactcagaacttgaaacaattgtttcactgcagtaaatacatgttgaatgcatagaacagagaaaaacagaagaaaagaagaaggaaaaacaaactccatgatttaaaatattgatgaatgtgacaataattgtatctttaaaataactgagaaatggtagaaataaaaattataagcttcaactgtatattacttattcttgacaaagatgatagttgcaagctgaagccaaaatttctaactaggactaatgcaaagatttcaagagaaactttaataaagaattattgatgcaagcgctttcagaaagcaaaggtagggactaaccattagctcttgtttagaaagataaaggtcacaaataaaatttgtgttttaatctatacattttcagcattatgtcatcataaatttgcatgttgtttattacaaatgggaaaaggtttcctgtaatatatcaagatgagttttaatagtttcaaggaccattgatttgtaaacttaagactattatagtgttgtggaaaattaaatataattggtgttttaggaaaagttgttcattgaagtttccattttatgtgccttaacagattaattttgcttattaattctgtgatatttaagcactgctgtaagcttcacagatttggcaatagccactatatacttaatgagtacaaactatggagtatttccatattaaggtagaagaaatatttaaaagcacttctacttgtgatgtcattgggggtgcaacacaatataaagtacgcacattgctggaggagaagcataaaataaagaactcacggggcagaaacttaagacacacctaaatcaaatctttgttttcagcattatctttcattactattctttgttacaaaaaaacattgctatctgtccttttctatatgttctctacattaaaacttattatttgtatacatactgttccctacatctgcagtgccattcccagctcacatatctgccctcttaaatttatatcaaattcaactcccttcaaaaagccttctcagttgctttaacccaagccagtagtctgtcttctagaaaacagttgatgccgatgcctccttttcctttagcaactgaaaataatattatagttatttaatgtgtgtgtgtgtgtgtgtgtgtgcataacatcatactatttagtagtatctatatctatcaagtatctgctacagtggatgatagatgacttaaagacagaaatatgttattcatatctacttctcacaggtctagtgctgttgcaggatattttttaaggaatcagagagactgatggggttcaggaggatatttattatttaggtgcaccagcccagtcggattaacatccaaaggactgagccctgaacaaagagttaagttaccttttaagcattttgtagggtgggaggagatctgtgcagggggaagcatgttagagaagtgagaaacaaagacagttattcaattaattgagaaatgcgttacatcatttcttacttttcaaggaaaaacatgttttgcgacttttgtttatgtgtctagtgactttgcagctgcccagctagggaatcagggtcttcacaatgcctgggaatggaggggagagaaagctcattagccacagaaaaataggccgttagttttttaaaggactctagctctttctctttctcagggggaattggattttcttacatacaactgaggttctgcttacacattctttaatttcttttaattcctgttccagtgcagtgcaatgttcatagtagatgcttaatattttttgaattattgtatctttagtcattgcgagccatcattttgagagtcagtctcattcttttagccctagattatttttattttcttgagatacgtgaataaagggcacaggaaaaaaacacagttgagagttttggataatagtaacctaattcacccagattttacttcatattggttggaactctaagttgggtgcaactaacatgagacttgttttgatttattgtaaacatattcttgaatgactaatgaacagtgcttcatgtgaacaaattttcaccttctgataatttccaatattacactttgaaaaacattcccattgtagtgctctagaaaatataatttcaattgttaaaattcaatattactgtaattgaggatattaaataacttgttgttacatgatgctagctgcagcttaaatttcagatcatgagtgttgttaatattatatagttggaattagttctgagatcaatgaatcaatgctgtcttactgttttgtctttaatttttataccacatttattttgtgagtggatttcataaaaggaagttgctttatgttgccaagctcattatcttgggtttttgtccagagctgaattccctttttcatcaaaggacagagagagcccattataaactattgagtaatgctgatttgatgggtaggccacttacctttaagtggaaaggaggccaggcgcggtggctcacgcctgtaatcccagcactttgggatgctgaggagggcggatcatgaggtcaggagatcgagaccagtctggccaacttggagaaaccctgtctctactaaaaatacaaaaattagccgggcgtggtggcgggtgcctgtagtcccagctactcgggaggccgaggcaggagaatggcgtgaacctgggaggcggagcttgcaatgagtcaagatcacaccgctgaactccagcctgggtgacagagcgagactccttctcaaaaaaaaattacacaaaaatgttagactaataaatattaataaacactaaaggaagaaatttagtggaacatttatcagaggcaacagaccaggaagttatagttaccctgtgaaaaggcatcatctaggattcatagaaaacatttgcaaattggcaacaaccaccaccacaacaaactaaaacaaatgaaagaaatagacatttatacagggaaaatataaatagataataagtgtaataaattttgtgactttccacttgaaaacaaagaaatggaaataaaacctatgtaaagaagtggtggagtgagccgagctggggtgggaggggtgggggcatcccaggcagagggaacagcagatgcaaaggtctggaggctggagcaggctgtgaggggtgagagcagcaagtacatgaagtctagaccacaaatcgatgcttcaccctcaaaaatagcctctcactggccaccactcaggcccagatacatgtgtaaggtgggcagccttcaggaaaagtgaccgcaaaagtgcaccacattgggaattctgaggtgtttgagaaagttatggatgaagggtgaggtagactctagtggggaatgtcctcttgccacttggacttctctgtctatttcatgggctattatcaacttctaaagagccagtggtttgggtgcacatttaggtgtaagtacctcttgcctcaagccttaactctctttccaatgagtcaagtgagctgttgtgtttaagtaacttctctttattgtgaaatctttcctatcactttaagaaccttcttcttcagacccaagtaatcccaaggcacctataatgtccctcctggagaagacaaaagggtgtcttctatttctgtgtggcccgatatttcagggcccctaaccaggttagttcaaggtgctcagcataaccatgaatctgctacccatgtttctcaggtgggtcataggccctggagggattgtggctgtggaccaagcagggggtgctgtgggctgttctgagaaggagggttttggagtgtccaagctgagaacatagaggccccagatgttgtatgagtaaattttcatctgacagaattatattttcctaactgaaaacatgaaacagagatgtaacaactgtgcctctttggctctgtctttgcatgctgtcatcagccactgaacaggagctgagagggaagacataaagaacagaaaacccatgagggggatggtccatgtgggtgtggaagtgagggtgagtggggatttggccaaagaggcctaatccacaggagtagagtctcatgtgtgactttcagaatgagcaggagtgagataggtggagggggagtgttggaacatctcatcagaggtgagaatccatagaaggagacactggtcattacagtcagtgagaaaagtgactttagcctgagcctaaggtcattggatcaaggaaggggccaggaggagctccttgaagggaagctgtgagcttgagaggcaggctgaggcagatcagtagaatgagcccccgagaagggctcacagagtcactgaaggactgtgaggtggcagggacaagctcacatggcctttggtcagtgagtctccagctgtaatgagaatgaaatggggaagatctgggacaggaagacaagctgggggcgctggtaccatcatggggagatgatggtgggtggctctaggttagttagagttggaatgaagagcagaaagcagcttcgtgatacctttatgtcataaaatacatttggcatggagaggacttggactttgtgcatgaaggatatggatgtttctaggctgactcccaaatgtttctaggctgactcccagaaactaggatgtttctaggctgttcctggctgagaatttggatggtaactatagtccaaagaaacaaagaacactgaaatcatatcttattttttttaactcacaaaatagaggcaggtagatatttatatgtgttttgttggctcaatgattttttttagtaataaacatatttacttagaaactactgggtgtctgtatgctctgggatttttttctcctgtcctgatgacatctctttcctttctctgggttcaggagttacttcccaggttgtggtgacacaggaacattcactttccacaactcctggaggggcagtcaccttcacctatggctccaaaattggggctgtcatcagagcatctcgacagctgggcccaacagaacatctggcaatgtccccagggcaatggtgggcacaagcagtcaggtcctgggacccctgcacaatcccctggttctcttcatgaagaaaaagccactctggttataatgaggactagaccaagaatgaggcccagtgttacatgctcggtgtggtgatctgaaatatcaccacagggacaaatacaaaaatacaagtgggaaactacactcaaacccttggatcaagcctcagtcctatgcttctgaagcaaatttcttgtttttggagtctggttttcaaccactgtagactcagatcatttattcttcaggcccccaatgggatcatcacaagcactttttctatcaatcatggcagtcacttgagatcaaaggtgaatttcttcttcctcaagttataagcaacactttggcatatttggtgaacttcaaagaaaatggctaagatagaggatgagagacataagaggcttcaggaatatttcagcagatgcaaagcagactacagggtaactcatttcccatatgatttgattgattgcaaaatgtgaaattaaatgcatacaaaggggaatgtgtgtcatttttcctcttaatgacaaagtaaaaaaaaagcaataaaacaaaaacaagcactatttcatgtgtcttgataaacttgtagaaagtcttataatatccacaatatctaggatacagtaaaataactttccatatgaagaaccagaagaacacaacttaaatgagaaaagacaattgatagacaccaatactgaaataatttaggtgctgatgttatgtaactgagattaattaaggagtaattatacaattccttcagtgagcaattttagacattattttttgaagttttaggttcaggggttcatgtgcaggtatgttacgtaggtaaacttgtgtcagaggggacattcttgaaacaagtggaaaagaagcaaatcccgaaaagaaaaataagtcatagaaacaaaccaaattaaaattagaaaacagaaaaatgcaataaattaaaaagaacagtctggagggactctggaacaggtaacagtgaaattaaagttcaggcattagaggaattatttaccgttaagtagggaagaaagtacaaacaatagccatctaagcccagcagagggagctgtggatcttctcagaggtgagcaaggccggaaatgaactcccggggctctcatttatggctcctgggtccatactcactggcccgaattggggtttagagcaggtgctttctcccaaagggcaaactcagagttcccagcagcccatcctccctgacagagcggctgctgcctggctgagcactcagaacttagggagccggtggttttggtagaggccccatgtttgcataatgtcctaaccaaacacacatctacccggggaggtgacgaggagttagaggaactgtcccagggtccagaagtagccgggggttctggggatccttggaaagtccacaccatagcttggatgtctatcctcccctctctccctcctcactgcccaggttcatgtagatttcaaagacaggactttggagggatctgtctgctgtgattcctcacacataacatgtatctgttttagtttcttggttcagttctcaggctgtggtgactcaggagccctcactgactgtgtcctaaagagagagacttattctcatgtgtggcttcagcaccacagcactgaattcagcagaagcctggtcaagtcctcaggacattgatgtgtaacacagataacaaacacccctggatgcccacttgattctctggctccctcctgggggaaagctgccctgacccctcaaggggcccagcctgaggatgaggctgagtatactgtgggctacaccacagtggtccttagcacagtgagagacccagatggggaagcaggacatgaacgagcttttggctgatccggggtacaaacatgaacgtaggatatcaggatcacgtggccagacacctgagctctcaaggacacctaaattttaactatccgtagagagaaaggtgggtggagaggtgtaaattgattcctgtatctgtttgaattttaaagtggaaaatatttgtgaatcatttgggagatgcagattcccaaaaagaagaatttatgtttatattccaaacagaacagtaatagtgagatcaactctaaagactaaggtcaaacacacttcatccagaaagatggatctcaaaagattttgttgttgttttgcctattaaaagctaagagaggaaattatattaataaagtttatttcatgttctatgttaatagtgtgtatttcatagctttttaagcattaaaaattataaaagtgttaagagggattctcttctctaatgttatataagaaagtatccacctaggaaaatattttgaaggtctaacccccagtacttctaaatgtgaccttatttttaaaatagtgttattgcttatgtaattcttaggatgaagccatcctagagcgaggtggcctcttgatccaatgtgcctggtgtccttataagatgatggtagtaaggagattggaagacacagagagaatgccgtgtgacgacgaaggcagagattgaatttacacagctgcaagataaggagcactaaagattgctggcaaaccaccagcagccagaaagagggaaggaaggatctcccctcaggtatatatggaaacattgccctttctatgaattttgggaggctagcctccagaactgtgagacaatacatttgtgttatcttaaccaaacttgtgtttaatacattctgacagcagttctaggaaaccaatacaccagacaataaattacacaatacttctgaaattgattgtacttctttcattttggcaaccagtttttccatgaatatgattatatctgtgctcatatttctaactttataaatatgcttgtaatttaaggttaagataagaaatccttgtgtcttaaaaatccctaaatatatgagaactgaataataatattaacattatgagatctaatggaaaattgtagcttttacataattccacttgttcactagtatcaagatgtgaaggtgggaagatcaccttgttattaacaaaacactcctggtcatctctgtggatttgagagtgcagggggagacacctacatattgtttgggaagtcacaaatgcagcatgcccagagcatcatgtacaacagtgtgagtttgctggacatgtgggcaggaagcagaacagactggggcatgaggaaccacctatcaccaaacccaccagcgccttcctccctggatcagcccagagctgctcagacttgaatgtgcacatggatcatgtgggatcctggataatgtggattctgatcagtgggtctggactgtggactgaaattctgcgtttctagaaggccccttcttccaaagatccacatacatgttttaatattaccatattcataagaatggtgggaaataagggaagccactttcagacagaaaccaaatagaaatttatctgagagggagctaaaggattatgatcaaagagaaatccccaattccaggcagggagctgatcacagagggcagatgggaagttgggagaggttctatttttttttttttaagaaatagaaatgaatgcaaacacaactcaaacctcctcttgatccaacatccctgctggctcctgcccaatttctgcactggcttcttctccagtcttttcccaagcatggaccctcctcaccctctctgcttccccatctcaaactcacaacttcccttctcagttctcctgtttctctccctttcattccacttccttcttctctgtgacctccttagacaatcaccaaaatatttctagaagaaaagccatgggtatttttcatcttttcttgaaagttgtcactcacattccctcttcgttcttcagcctctcttaccccttactacaaaagatgcctgaggccactgtttctcttttccatcccctcaaatagcttctccttccaacccgtttctctcctcagttactagagcattcagtgaagcactcagtcaggttaaaggatcctcccaaatgctcaccctgctctctatgtgtgatctcctgaagaatcaagtagggagagaaacatggcttcatgagtttgtggggaagtgggtgcatggctgaactgtccttgttctcagcaaatgtactttatttcatgcacagtttgtatatgagacaaccttctcctgcggactccttataaaatgggaagaattatgtgttgtgttttcacagaggaagcccaaatattccatgctcatgggtaggaagaatcaatatcatgaaaatggccatactgcccaaggtaatttatagattcaatgccatccccatcaagctaccaatgactttcttcacagaattggaaaaaactattttaaagttcatatggaaccaaaaaagagcccgcatcgccaagtcaatcctaagccaaaagaacaaagctggaggcatcacactacctgacttcaaactatactacaaggctacagtaaccaaaacagtatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctaagaagaaaacctaggcattaccattcaggacataggcatgggcaaggacttcacgtctaaaacaccaaaagcaatggcaacaaaagccaaaattgacaaatgggatctgattaaactaaagagcttctgcacagcaaaagaaactaccatcagagtgaacaggcaacctacaaaatgggagaaaattttcacaacctactcatctgacaaaggggctaatatccagaatctacaatgaactcaaacaaatttacaagaaaaaaacaaaaaaccccatcaaaaagtgggcgaaggacatgaacagacacttctcagaagaaggcatttatgcagccaaaaaacatacgaaaaaatgctcaccatcactggccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaaccattgtggaagtcagtgtggcgattcttcagggagctagaactagaaataccatttgacccagccattccattactgggtatatacccaaaggactataaatcatgctgctataaagacacatgcacacgtatgtttattgtggcactattcacaatagcaaagacttggaaccaacccaaatgtccaacaatgatagactggattaagaaaacgtggcacatatacaccatggaatactatgcagccataaaaaaggatgagttcatgtcctttgtagggacatggatgaaattggaaattatcattctcagtaaactattgcaagaacaaaaaaccaaacaccgcatattctcactcataggtgggaattgaacaatgagaaaacatggacacaggaaggggaacatcacactctggggactgttgtgtggtggggggaggggggagggatagcattgggagatatacctaatgctagatgatgagttagcgggtgcagcacactagcatggcacatgtatacatatgtaactaacctgcacattgtgcacatgtaccctaaaacttaaagtataataataattaaaaaaaaaaaaagagagttaaaggctgagatgaggtaggaggctgccctgaggaagggtctcatcctctggcatctggtcacagacacgatgggcctgggcctgggctgcagagagcacaatggggctgctggtgggggctctgtgcggctctcagctgggaaataaagtccatgaactttgttttgcctcacggctcactggggccagcagctgggtcctctctgggtgcttggggagcttcaggccaagctcagcccaggctgactcctcctagtagtgtcacccagccacagaggctgtacacaggcccagggagagttaggttaagcaggggaagaggagcacatttgcatgaagggcccctccctctcctttgaggctagagggtggataagagagacctgcagcgtggctgcctcagcagagctctggggagtctgcaccatggcctggaccccactcctcctcctcttccctctcctcctccactgcacaggtcaggaggaccctcagcatcctcatgccccagctcactgacaccatctcccaaactcataccagaaatgttgtttgctcttgtccttccttcaggccataatgagcgtctctgttttcagggtctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactcacacagtgatacaggcagatgaggaagtgggacaaaatcctcaacctgctgaggctattgttcagtgacaatttttaattttaaaacattttctgtatgtaaaaaatctatctggatgcatcctctgatttagaacaattttactcacaatttcccatttaatgtttcagaagtctcagaagaaattaaaacataaacaagaacataagcctcctgatgacactgagatgtctgcttatccttatgggctgataccaaagtctgtgaagctcaccttttctcttgaaagaaaaaaagaatgagccttcccttgagcaaatcttgctcagagcccaaacttcaagcccacaaatggacagtcccctgcagcatgggctcttgttcttcaaggggtcaatgaggagacctccctttcccaccccaggtgtctgtagtcagggctgcctgatgttccctgcatcctgggactaggcactcaggtgtgtaataccccagaggacaggcctgggagtaattccaaacacagagctggcctgattcactttcaggttcctttattttaagttaaaatgtcaggatagaaagaagttgggtatggggttattcatgaaactgaggccagaagatgtctttgtgggctgtgagagggtgacatggtggctccaccattgctaggggaatgttgagtgagctcctaagaagtttggggaaatcggtcttgtgagtgtggcttcccttcagctcattccactcagaaacatgaggacacccatgggtggatttttctgaactcacaaacactgacttgtgtcctcttttttcttatcccattggagatattcagtaatctactctgtgagatggggtctacaggagatcatggagaagaaactcttcaacctgtgcaagtgaaacttccttgtgtgaagctcttgatgtgtccagattccaaggtcaccttctcctgcacaggggtcagcagaaacattgaatattaccatggaaactggcccaatggctccagagaaatcctgaatttgtgactgagaactgcagtaatcaaccttcagggatctcagcctgattctcctttttcaacttgactttccttgactgtgcagcccgagggtcaggatgactatcactgtcagagctgaatacaacccgatgctgccatgagctcccattccatggggaagtgacataaacatctgtcctccatttcccccatcaaatccgtcactgccctgtccctgcctgtgaccgacacctgctcaggttgtggattctgctgtcacttgtgattccagcaagtctgatgcttttaacttggtgcatcattattagggaagccactccctctaaatcctcagaagatgcccccaaggagttcccggatcccaaggtgcaggatcaacctcccagtaaggaaggctctctgggccccatcactgttcatctgttctactttaatcctaagaaccttgagccttcattatttcccctttctgcttatttggctggaacgttgctggaatgcatctcagttctttggggactagagggataaaaagcacagcccatagaaagctttcacctggttaagtagcatttcctaagagccacgagggcatctgctcactgctcactgctcatccttgcatcataatgggttcctggaccctgggctctcctggctcattgagtttaccaatccctccacactccactcattgctagggctggctagagggaaggatagtaattgtccaatagggagatagttttaggggggattacagaaactactccccataatctttgttgataacatcttcatcttgatgtttgctccccaggatctgattgtgacagtggaagtctgacacttgaagaaatgtaggtttacccttctgaaaggcctggccctggcttggcctagggctggaaggaagaggtgctgagctttgggcaaccaaggcacagctgtcaaggggctgagctctctgcaatgtgggcctcctgcagagacatccctagggaggctgagacctgacgatgatgcagaaaagcaaattgaagtgagcaggggatggtctgtgggggaatcagatgacaggtggggggccagatgtgatacagatggtgcaacatgaagaaaagtgtcttttgtgattgttctgaggagaagggctcagtgctagagcagtgataatgaggcaggagctgggtcctgaagccacaggggaaccaggtcttgggtctttttctgagggtccctagggaagatcacatgacaaccaagtcccatgttatatgtccagtgctcggtatcccagatgctgtccctcccagagcctctgggtgtcctcgtcccactcttccctgtgatctgttttcagctccaggagcaggttcatactctgtgccaagagtggggcttgcatggctgagtggagaacagatttgcaagaagatcccaccttgcagtctggctctgtgtcctgggtgtgggtggtaactgaggagatgtaggcatttgggctccactagagaccacagggagcagagctcacaggggctccccacaacccgggctcctcccttcatcctcctcccattgccttcctcactggggttcgggccaggggagaacccagggctgcttcaagggccctgctctgcaaccatggtctttatccaagtcattgtctccaaactctgtaagggctttctctgaaactgtaggagcattttttttccatatgcccaaggcaggcttacagggtgctgaccccaccccttaaaagtgctaatagtctctcaatgctcaagacaggagggagaattaggaatcaggagcctacccagagcttccctctttcctcactttcaaaattgcactgtgtctagacatagaatttatgcctgggttgggaaatatttatttacttattaatgtattcattcattaatctcactttctgcaatctgtgtaagtgaggggcagaagggaagaggggcacagagggagaggttgaacccaagggcaggtcctggcagtctgggcacaggctctgatcagccagggggaaggaagagggagcagctcctggtgccctggagggaggggatgccctgtccctgctgggcctcccacttcgttgtacccagggaatgcttttcagagaggcagagctcttagcagagtcccgtaaaccatacagtgagttgggcaggtgagtccaggggtaggggctgtgtggagacctgagaccaggtgtggcctggcatggacactgcccagctccattcttttagggaggacaaagtggacagaggaagagacaggagacatgggtgtgtctgagctttgggcagcaggggatgctgtggcctagccctgagggctgtgctgtggatcccagctgggagccaccccctggtcctggcctggagccctctgtcccctgctcactgggactagcagctgtgtcctcacaggtccctgagtacccacagaatagccacacccaggtccacactctcccggggttagctttccaggcagaggtcaagagtcagaacccaaggtggggtttagacagcccaggagaggaggctggtttgcaagtccctcctaacccccttcgccctgaactgctggaaggataggagagacttgaagaatccaggcccacctgagggtcctcaggacacagctgtgtggcgggtccccaccatggcctgggctcgtggcctctttccttttctccttcactgctcagctggctggggccaggcgtcagggctgaggatgaagggaccaggattgctgtgtgtgtccctgtccactaacctgtgtctcttactctttgtctgtcatgatattcagggtcctgggcctgttctgtgctgactcagccaactgcagtgtccaggtctgtgggacagatgaccccagcacctgcactgggagcagcaccaatgatgggagtatgcacgtgttttggtaccagcagtctccaggctgtggtgcctcagaaaccctcctagtcaacaacaccctgcccagcaggagcgggccatgctctgattgcccatctggggtagtgtcagtggggctcagtgagcagctgagctttcaccccaatatcctcaaccaggcgagcatggcagggctagtttgagctggtttatcctcccatccacctatgcctgattttggcagggcccagtcaggaactgaatttcagcccccatccccagcaatgagttgaatgaaatggtacaaggcagagcacaccagccctcagtattccctccctgaacccagactctggtggttatgggggccagggaggaccagagctttgtctcccacctggcaatgagaatactggttggggatggaagtcagtgtcgttggcacacctgctgtccccctccctgccctggtgtcagtgagtcctctttttctcatgaaagtgtcagcagcactggagtactgagagccagcgttctgcctttgctttggcagtgggaagctgaacctacaaacctgtgtccttcaacaactcaacaagaagatcacctgataaaagggagattagtggtgcctagaggctcaaaatacagtatttaaggtgtctagcattcagttcatgaaatcattgtcacatcaagaattaggacattcagaacccaaatgaaagaagacagtgacacgcatggacactgaagcaaactcagatgctaaaatcatatgacggatttttaaagcaacaaccacaaaatcccttcaatgaataattaaaaacactcttgaaacaaatggaaaagaagaaaatctcagaaaagagaagttataaaatcaaaccaactggaaattaaagaacctaataaactagagcacatttaaaaagaaagttaaggcaggactcaagaactggttacatttgagattcagtcactgggtgaggtgttccacacgacataaaaatacagtaaaaataagtaggtaaacacatgaaaatcaatgattctggtttgacttgggaaacattaaagtggaaaatataaagaataaaatagcatttatttattgaaagaaagaactacctttagctttttatcgtttccccattaatactctcttgaagatgttcccaggggacactgtgagtcttctcagaggtgagaaaagcctgaaataaactcccacgaatctcatttaatgggtcctggggcccatgctcactggtctgagttagaggtgatagcaggtgcttcctctcaagtggtgaaattagacctcacagcagcccagcccccctgacagtagagctgctctctcagctgaaaacaacagaagcagatggtgttggtgatggttttggtaaagtgcttattaatgtgtgaaccaaatatatgcccttcatctagggagctgcataggagataaaagaaccatctcagggtccagcagcatcttagagctctgcagatttttggaaagtttacatcatgccctggatgcttctcctccacttccccatcctgttcagtctttgcccaggttcatggagatttcaaagaccagcccatggagagagccctctgttcttccccattcctgtcgtgtctgtttcggtttcagtatccagttcttagggtgtggtgactgaggagccctcactgactctttcctgaggagggacagtcactctcacctgtggctccagcaccagagtggtcaccaacaatttctatccacactggatgcaacagaagtctggccaactttttgagacattgatttatgatgcaagcaacaaacattcctgaatgaccacctgattctcagaccttcctgggagcaaagctgccctgagcctctgggggacccaatccataggctagactgagtactactcaagctacacgacagtgggggttactgcagtgaaagatccagatggggagccaagacgtaaccctgcctctgacagcctggggagaaaatgatcacgtgatatcaggatcacatgaccagaaacctgagctctcaaggcggtctaaatgttgcctatccttaaagaaaaaggtaaacagaagggtctacatcaatatttattcctgtttgtgtccaaaagttgaggaaatccatcaatgaggaggaactgttccagaaaagcggattcctaatattttgtaatccaaaaggaatagtattgcctacatcagatccaaggaataaatttaaatatatttttttgcaggaggaataatcttcaacgatgtactttgccagctaagaacgaaaggaagaaacgttctttggtatattaataacattttttattaggttgtaattaaggtgtattgcacaatttaaaacatattaaaatgattttttgtaagaaattcttttttctatatgttatgtgttgtattggactctaaagaatatatgttaaagccctacaccccagtattcaagcacataaaatcatttgaaaatcggatcattgaagatataatagttaagatgaggtcattctggagtagggaggtctctttatcagtgttcctgggtccttgtaggaagtcaaccatgagaagacagagaggcacagggagaaagtcatgttaatatggaggcatggagtgaagttactcagctacaatacaaggaacaccaaagattactagcaaagaggaagagctgccaggaagaatcccaggaaggttttctctacaggtgtcagagggaacatggccccgccctatggatttggatttctagcttccagaactgtgaaacaataaatgcctttcattttaaatcacatgtgtagggttatttttatggcagctcaaggaaattattacaccaaacagtcattgtaactatttctgagtttgcatgcattctctcatcttgtttctcagttttttcaacaaatgtgaccatgtctgtcttcgtatttcttccttgtataactggcattgaaggttgacgtaagttattctcgctgtcacaaaaattatataaacatgtaaataaggcttaattttattttgttcgtaggtacaaatgcaaaactaattccaattgttttgtaagaaatttttgtaaatatttttctcatgtaaattagaagggtctcttgagttactgaaacacttctggccatttctgtgatcttgtggtgtcaggatgagatggctaccatgttcaatgaaagcttcaaatacattattattttttctaggtttttaaaatttaatacagtctaattaaatagtaacagcagtaactaaatgcactgaaaaacagacaggtgcctgcctatatctggaataaaattacatcaaactagtctccatggtaaaaaaaaaaaaaaaaaaagacaactgctgatatccatggttagacaagtcaaggacaacttggaatttctaaagccatttttctaaaaatcaacagcaacagggacacaactacttcaaggggtaaaatatctatatctacattgttttttattaacgaagattgagttgcacctaaacagcatggcattcttatctttagccttaaaggaaaagtgaaagtattttccatttgcaccagtttgaaatatttctgaaataaggattacttcaaatgaattattacattacttatacacataagagggtctcacatatagtgaaaaggcaaacccaggattttaacgtcaaccttttaaagttgatttgattgcataaaatgagagagaaattctcacacgcataatctgtttaacaaaactcctcggtgaatcaggatgcaaaatataaaatgttctaagggagactctgatgagcaggcatataaaattgaagtgaaacccatgtcagcttcgttcctcccacttctttggtgcttctatgaggagctctttctctactgcaagagcctggacttttgacctaatggagaagaacctcaggaaggcaaggcattctgataaaatgccccttgagaccttttattttttaatttaaagggatcaactggtcttgttcagccttaggaaagaaagcatcactcagataaaagtatttggggaaactttaaatacctggctacctcttgatatatttaaattagattgacttcagctgttcttagaaagcattctgcatagttatccagagcagccactgaagttctggttctccttacatggctgcattcagaggtactccacatgaggcatgtttagaaaaagaaggacccttatacttgggagtttttgttcttccacgtaacctgttagtactgttggtaaaggcagtccccagatggcaccagtgcattttgtcaatggtgagtctagacagtgttgcaggggtgttgctgatgagtagaacagtgagcagataaaggtgagcagtgttgatctaaaggctttggggtccatctgcttatccttgcacacctgaacaaagtcatcagatgtgccacaccatcaaactgttgaagcttggacttgatacatgatagagttccatgccaattgcccatcttcatattcaacttgcagattagttggtccagctgatattttaacagatactgttagtagatcatctgaatgtgaactatctctaaccaagaaatttccttctggtgtctcttttaacttttctttggcttcattaacaatcatccttccccagtgccatcctgtttgagctcctacggggacttcaccagatgcaccacctccagggaaggttcctgtgctgaccctgctcctcactggctctgcatctattccctgccattcccagagggctggagacaccacagggtcatggaagtaaggtcactgaggcaaagacagatggccacccaaactgggtgagaaaggagctttcatttttcctggaagtcagtgggaacccccccaatcaaccctatgggtttctgaaatggtggaagatggggaaggaatgaaaagctgcctgtttttctcaacaggtccaggttgagggatgacaaagttccttgcagatgcatcacccacagatcaccagcaggaggatcctgaggctgcggtcagtgccctggcacaggacacatgggccatgtcccatgcagcaccggtggctccgagtgagagggcttatgctgcaggggaagccaaagattcctgagccacagcggtaagacatgagatgacttaaatatctgtccctcaagtatattattcttaatatttaatgcacaaaatagtgaaagaagagattagcttgcagtgcaaattgaacagattcagtatagcttgaggcatgagaaacaacagctctattaccatttaccaaaaatacaccctgaatggacagggggtgcccgtgagctggagatagggtgccccaattgaggaaatataaatactggttatcagttaaatttgaattcatgtaaacaaccatttaatagatttttatttttagtataattatgtcctatgcaaagttacttatctttaattctaatgtaactggatgtcttgcatcttgtgagataccattcccagcattcccagctgggctctgacatctgagtctatgctatttacctcaaaaacagagttcctgtaacaaagttatccccaagtaagtacttcggttagaaataaatatgtctgggctgggcacagtggctcatgcctgtaatcccagcactttggtaggccaaggcaggcagattacttgaggtcaggagttcaaaaccagcctggccaacatgatgaaaccctgtctctaccaaaaatacaaaaggtagccgggcgtgggggcacctctgcagtcccagctactggagaggctggggtgggagattcacttgaaccgggaggtggagcttgcagtgagccaagattgcaccactgcacttcagcctgggtgacagggcaagtctctgtctcaataaataaataaataaataaatacataaataatttataaataagtgtgtcatcccatccacctcaaggctgtaaaacctagcatgccttatccctcctcactttcttttttttttttttaattatactttaagttctagggtacatatgcacaacatgcaggtttgttacatatgtatacatgtgccatgttggtgtgctgcacccattaactcatcatttatattaggtgtatctcctaatgctatccctcccccctacccccatcccatgacaggccccagtgtgtgatgttccccttcctgtttccaagtgttctcattgttcaattcccacctatgagtgagaatatgcggtgtttggttttttgtccttgcgatagtttgctcagaatgatggtttccagcttcatccatgtccctgcaaaggacatgaactcatccttttttatggctgcatagtattccgtggtatatatgtgccacattttcttaatccagtctatcattgatggacatttgggttggttccaagtctttgctattgtgaatagtgccgcaataaacacaggtgtgcatgtgtctttatagcagcatgatttataatcctttgggtatatatccaataatgggatggctgggtcaaatggtatttctagttctagatccctgaggaatagccacattgtcttccacaatgcttgaactagtctacagtcccaccaacagtgtaaaactgttcccgtttctccacatcctctccagcacctgttgtttcctgactttttaatgattgccattctaactggtgtgagatggtatctcattgtggttttgatttgcatttctctgacagccagtgatgatgagcattttttcacgtgtctgttggctgcacaaatgtcttcttttgagaagtgtctgttcatatccttcacccactttttgatggggttgtttttttcttgtaaatttgtttgagttctttgtagcttctggatattagccctttgtcagatgagtagattgcaaaaattttctcccattctgtaagttaactgttgtacttagttgtactgggtttgatcgtagtttcttttgctgtgcagaagctctttagtttaattagatcccatttgtcaattttggcttttgttgccattgcttttggtgttttagacatgaagtccttgcccatacctatgtcctgaatggtattgcctaggttttcttctagagtttttatggttttaggtctaacatttaagtctttaatccatcttgaattgatttttgtataaggtgtaaggaagggatccagtttcagctttgtacatatggctagccagttttcccagcaccatttattaaatagggaatcctttccccatttcttgtttttgtcaggtttatcaaagatcagatggttgtagatgtgcggtggtatttctgagggctctgttctgttccattggtctatatctctgttttggtattagtactatgctgttttggttactgtagccttgtagtgtagtttgaagtcaggtagcatgatgcctccagctttgttcttttggcttaggattgtcttggcaatgcgggctcttttttggttccatctgaactttaaagtagttttttccaattctgtgaagaaagccattggtagcttgattgggatggcattgaatctataaattaccttggggagtatggccattttcacgatattggttcttcctatccatgagcatggaatgttcttccatttgtttgtgtcctcttttattttgttgagcagtggcttgtagttctccttgaagaggtccttcacatcccttgtaagttggattcctaggtattttattctctttgaagcaattgtgaatgggagttcactcatgatttggctctctgtttgtctgttattggtgtatgagaatgcttgtgatttttgcacattgattttgtatcctgagactttgctgaagttgcttatcaccttgagattttaggctgagaggatggggttttttattttattttattttattttattttattattattatactttaagttttagggtacatgtgcacaatgtgcaggttagttacatatgtatacatgtgacatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatattttactgagaatgatgatttccaatttcatccgtgtccctacaaaggacgtgaactcatcattttttatggctgcatagtattccatggtgtatatgtgccacgttttcttaatgcagtctatcattgttggacatttgggttggtttcaagtctttgatattgtgaatagtgccacaataaacataggtgtgcatgtgtctttatagaagcatgatttatagtcctttgggtatatacccagtaatgggatggctgggtcaaatggtatttctagttctagatccctgaggaatcaccacactgacttccacaatggttgaactagtttacagtcgagacgatggggttttctagatatacaatcatgtcatctgcaaagagggacaatttgacttcctcttttcctaattgaatactctttatttctttctcctgcctgattgccctggccagaacttcgaacactttgttgagtaggagtggtgagagagggcatccctgtcttgtgccagttttgaaagggaatgcttccagtttttgcccattcagtatgatattggctgtgggtttgtcataaatagctcttattattttgagatacatcccatcaatacctaatttattgagagtttttagcatgaagggctgttgaattttgtcaaaggccttttctgcgtctattgagataaccatgtggtttttgtttttagttctgtttatatgctggattatgtttattgatttgcgtatgttgaaccagtcttgcatcccagagatgaagcccacttgatcatggtggataagtttttgatgccctcctcactttcaaacagtacaacagttaacatttcctaaccattggagatattaaagcacagatcttttatatgagattagttaaaatttttatctttaatgcacaagagtttgggaacattaggaatttgtacatatgctaaattatatgtaaatgaaatgatacgatgtttggaatatgttttaaaattagttgagtgtgtggagtgaggggtaaagagggatgtaagatgaataagacaattttatgttgatgatgatttagttgggatgctgggtccaggacatgcaatgggcttttctccatagatgtctgcaacttcaaaaacatccacagtgacaaatgtgtaaaaaaaattctgtgaactcttctgtggtggtgtgtgtattgaggtggataagggaccccctattaagggcctgacttctccccctgaagcacggaaataaaggagaatcttgagtttcttcaagggaaatttcaggtacctcactgtccctgagaagaaaacctgactagcaaaaaggttaaaggagcttaaaacaaccaaggaagttagaggcatgggatgtctgggtccctatagaaactaaaaacaacaacttaacatatgcccctgagttgtttttcaaacactcagaccacctccaaaagtctcggctgtcagtaggcctcagataatgggaaactgaggactgaggtctgactgcccttctttgttctaagtctcttactgaggggccctgaggaaatcacgcccatgagccagagctaacatttctttctgttgaccccaattttttggacaaagctttacgaccttaaccagttgcaaatcaggaaatttctaaatctacttacctttgatctgaaagcccctgcttcaaaatactctactgttttaggccaaatcagtgtataacctctatatattgatttacagttttgactatgacttctgttttctgaagatttcccctgcttttaaacacctttgctttcaggccatcagggagtttgggtcttaagcatgagctgcccgattctccttgcttgatgcctgtgataaatgtctcattctcttgctgcaatcctgatgtcagtgcttagatttgtatacctggtcaatggattcaagtttggtccattaatagtgtgtcttgcttttaacagacactcagagttgccagatggtgtgcctccaccctgacctccagttgaagctcatctcctccccgcacacagaggaggacttggtgagaaggccacagaatggaaaggagctcagggtttcccaggaaagagaagtgagtgatactggaggccccagagcaagaggaagggctgtgaggtaggcaggggccataaagtgaagggcatgctggtggggctgcaaggtccagggtttatgtaaacagcaatgaagaaccacaaaaggagtttaagcccaggagtaagatgaacaggctgaatgagaaggatgtctccagctgcctcgaggagaaaggcctgagggcaccaggggatcctggtcatagattattcactaagagaacctgtgagtctagaagtttgaagactatttgcacagttaaagcagatttgcatctgggatacagtgaagaagtgataatttctgcattaatctgtccagtcattcaacgtttctgcagaaacattaaaaggtcacacttatctttcttagtaagccatgaaaaaaatgtaagtagggaaaattaggtttagaatataaacaaattgtattctatctaaaacaaaattctattgagaagtagatgaaacagataagcagaaaaataaaaaggtaggaagacaaaactcacttcataaaataagaaatgtgttacaccatgaactggtaaatgttatgcctacccaactattattttttcacaaataaaatctagtgagtatcaacatgctaaaatcatggtgtgacttaggaaatgttttctgggccaggtgcggtggctcacgcctgtaatcccagcactttgggaggctgagatgcgcggatcacgaggtcaggagatcgagaccatcctggctaacatgatgaaaccccgtctctactaaaaatacaaaaaaaaaaaaaaaaaaattagccaggcgtggtggcaggtgcctgtagtcccagctactcaggaggctgaggcaggagaatggcatgaacctgggaggcggagcttgcagtgagctgagatcgcaccattgcactctagcttgggcgactgagtgagactccgtctcaaaaaaaaaaaaaaaggaaatgttttctgaattgctggatgttaaatctatcactgaggtgattcctgaaacagtccccttctatgtcattgccttgaacaaccccttcatgccactcaagtcagcacaactgtttcagcatctgtggtggtgccatagtgacgtatgcaggtcacttagctttttctagaatgtactcttggggcactggcaccttaaaaggttataaaatttttaaacagttataaacgaacatatttgctcctctcatagatcaagactacttataggagtgagatactggctaggcatctagtagaccacgtcatcatcacaggatataggattcaggacacagatgtgtatacagaggaatagtgtcctggtgagctgcagagatcagctgggctctctggtctctgagccatggggaggtgagtgtcctgctatcagcaggctgcactgtgggacttgcctgtggtgtctgcacagctgctctttaagaaccattcattccaaggagcctaggtctaggggctgggccttgtgctcattgatggggactcggcagctgtcttctctggtctggcagagtctgctgaacagggacctgtgtatggtctcagcaggtgatatctcctagggcccttccaaggagggaaagcaaatcatcttcctcagtctgcagtgtgagctgggctccagccccagggctcaggaagggactgggcagtccctgcatagaaacacatttgcatgagcagcccctcctctgctgggggttgggaagaaaaggaggcctggggcagctcaggctcactgtggtggtcaggggctgtgtccaccatggccagaacttctctcctcctcctgatcctctttcactgctggcctgaacttctcttctccttatgctcctctctcactgcacaggtaaggacaggcctcggagatcaggactcagttttcagcctgcatcagtccctcaggctcaggaacccatgacaaatttcatcctcatcttaaccctgtctcttatttgtgtctgtgtttacaaattccctctcccagcttgtgctgactcagctgtgtcctcccccctacttcctgtatctctgggagcatcttccagactcacctgcaccctgagcagtggctgcagtgttgacatttatctcatatcccgctgtcagcaaaagccagtgagcccttcccagtatctcctgatctacctctcaaaagtcaagtaaaactagggctctggagtctccagctgcttctctaaatccaaagatgccttggccagtgcaggcaatttgctcatctctggggtccagccagaggacaagactatctgttctatctattactgtcagacctgggatattgatacttcagttacacaggcagatgagaaagtgagacgaaactcagcctactaagaatggaactatggctctttttccaattgtcaaataattttcacatacacaaactattttggaagtagctactgattcacaatggttctctcaatgtcccattcaatgtttctgagtcctcaggcaaactaacaacaaaacaatgataaaacatatgacaaaacatatgataacactgactctttccctgctgaaccacatgtaataaaaccagaggagctggtttaataaaacctgaggagctgacttttcttttaaaagaaaagatgacagtcttttggagtctttttcttggtcaaaatttcctagaccatcccagcaggtggacagtcccctacagaagacacgatcctgggaggaatcccaggtacagagctggcctgcttcacttgtgggtacctgccccttcaattgtgaaatcagggaggggagagtaagcatagggggtaggtgaggatcaggaaaggggcaaggccactacatttcattaaccacctttggactccagtgcaagatagaggctgatgatcccatcacacaggtgactacaacctccttgtcatcaacagctcctgcccatggggaagcgaaatgaaaatctatccccatccctctcttcttacatatccctgtcctgcccctgccggtgaccaacaccagctcaggttgaattttgttttgtcacttgtgctattaaagaaaataactccttctcttactggtctcctagttcagacagaatcagtttgtttccagaaatagaaaacgctgctcacacacatgagtgtaaagtaaggatgacaaaaagaaaaaatccaggctatgtggcccagagacccaggtgccctctgattggcctcatagatgtcccctcctcctggcccaggtttgcttgtcattccttaagctctggaaccttgaactacatgggttctgtcttcatagatacagaagaaaaccctccccaagaaggagatggttcccagaaccagcacatgctcacttttctctgtttaattccacacatctgacttatttttgcttccatgagcctttgttgaagatatctctgaatacctctcatttctgttaggtctacagcctatggacctatctccattatatttgtgcttatttttctaacctttatgactgattatcatttaagcttaatatgagatatgcatctatattaaagatatataaatatgtcatcaatggtcaatattattaaagttataagtagtaatgcaaaattgtagctattatatcatttcacttgttcactaacattaatatgtgaagtgagaagatcactttattaatcacgcactcctggtcatgtgtgcggatgagtaagctcaggggggatgctgccatggtccatgggaagcctcaagaacagcagacctggcacatcaggcacaacatgggacacagggagtgagccatgtcagcagaaagcagaatagactgaggcatcagaaacaacccattgccaaactctccactgccttcctgcatgggtcagaccagagctgctcaaacataacgtgcacacagatcatctgggctcctggaaaatgtggactcaggggtctaggatgaggactgagattctacacttctaaagatcccttctcctacaaatccacatatgtgtttctgtatcacaaaattagtaagaatgggggaaaataagaaggaaagccatttgtagacaggaagcaaagaaacatctttcgcggagagaactacagaattttcatgaagaaagacttccagttgaggcaggcagacaaccagagaggacagccgagaagactgaggaggctcctctttcttcacaaaacaaacaaatgaaagcaaaaagacaccaagcctcccccttacctgccctgccctctggctcctgtccaatctccccaccagcttctccttcagcctcttctaaattgtggaccctcctcaccttcccttcaggagatgccctgagtccactgcttctctttcccaaccccactagcaccttccgctacttcctgggtttctcctcagctaccagagaatgcagtgaaccatccaatccaaataaattatcctgttaaacattgaccagtaggtctcctttgtgcggatctgaggaatcaagcagggagaaagaacctgactttgtgagctgcctgagaaatgagttcatggctgaagtgtcccttttctcagctaacatgttttatttcatgcacagggtgtatacagagacaatcttcccctgaggactccataaaagatggggagaattgtgtgtccagttcccattgaggagacacacacagaaaactaaaggctgaggtgaggtaggaggctgccctgaggacgggccttgccctgcccttggtcagggagtgagcagtgttcaagaccctggtggggacaggaggctctgtcaggaccccggcatctggtcagagacacggtggacctggacttgagcagcaggggatgctgtggccctgctgctgagccctctgtggggctgtcagctgggaaaccagaaccctgtgtggtctgtgctcagagatcactgggccaagtagctggatcctctgtgggctcctggggagcctcaggccaggctggatcctctgtgggctcctggggagcctcaggccaggcccaagttaggcccacccctcccagaaatgacacagccattgccgctgcatacagccccagggaggggtacggttgggcagaagagagacaagtttgcatgaagggcccctctctctcttctgggactaccggatggataagagggacctgcatcatgtcagcctcagcagagctctggggtgtttgcaccatggcctggaccccactcttcctcctcctcaccctcctcctccaccactgcagaggtcaggatggcccttagcaccctgatcctgcagctcactcacactgcctcacaaactcataccaggaatgtccttccctcttatccttacttcaggccataatgggcgtctatgtcttcagggtccctctcccagcctgtgctgactcagtcacccactgcatctgcctccctgtgggagcctcggtcaagcttacctccactctgagcagcaaatacagcacctacattattgagtggcatcagcagtagccagggaaggtcccttggtacttgatgtatgttaccagtgatggaagccacaaaaatgggatccccagttacagttctcaggatccagctatggggctgatcggtaggtcaccatctccaacatccagtttgaggatgaagctgattgtatctgtggtgcagatcatagcattggtgtgacatatgggtaaggcaaagtgaccccagtgaatgaggaagcaggacaaaaactgttttctctgctccactatgaaggctgccacgtggccctgagaaacagtgcctgttttccttactactcaagaaagatagatagatagataggcagatagctagctagatagatagctagctagacagataggcagatagctagctagctagctagctagacagatagataggcagatagctagctagatgctagatagacagatacctagatagctagatagattttttgctttgggttccttaggaacaagtttgctaggccaagctcctaaggagtacacaagtctgtattaatgtggccaatattaaggcagatcctgtcaccccctgcatgtcgatacattgtcaccacatgggaactgcaaggacatttttccctgtggatttaaacactggaactctgctgcatggcacacccctgccacatcaagtttcattttaacaatcacccataagatataacttcttaagaaaattttgaattctaacaaaatgctagaaatcacactgttgatacacagcgatggaaataatgaaaatttatagacagtgaaataaaaagatttaaaatttttggtggtttataaaggttttctcagttgttcagtgcgtgggttttgggattaggagaaaatgaggagaaactgcctccaccacattgaacatgacaactgatttgcaataatctaacaaagaagaaggatataaataatcattaatgtcatcctgacagccctgatcctaaatgtcagaattttatttcttaacttttttctccaaaaaaaaaatgtagcttcagaaaaacttctggaatggtggtatgaggccatcagaaaacctgattcaccatacaagcaatgagaacagcagtaaaaatgatataaatctacttttcagaactctgtacattaccaaaagcttacaaaattctgggaatcataaaaaatagtaataacagccagacatggtggctcatgcctataatcccaacacattgggagctgaagcagagcgattgctttatcactcctgggattttgtgatcagactgggcaacagagtgaggcctcttctctaaaaaacattttaaaaaagtagctatatgtggtggtgtgtgggtgtagttgcagctactggggaggctgaaggtggaggatcacttgagtctgggaggtggaggctgcagtgggctgtgattgtgccactctacttcagcctgagtcataaagcaataccctgtctgaatcaatcaatcaatcaattaaaataatgtggaatctctgtaagaatctgaagctttgtggtgattttatttcttttgctctctcccaagttccacagtagccttaaaaaccaacagcctcaaatctcctggatctagggaaactagaaaaatagcattcactgaagcaaccaaataccagatctggaattttctcaaaagccccattcccgtgcgactgtcattatttgagctttccaaagctcagaaaagcttcacgctctgtacttttctaaatgtgaattgtctcagagctcgcttggtttaaacagcttcatcctcaatacatttatcaaaacaatcagtgagatctgttaaggtcctgagtcagtgatacaagatggggtcaataaaaggctgaccaaaaaccttgagagaaaaaaactgggtgtcagaatctgtagaagattttgatgagctctgccatattcctggaaagacagaagatcactctcatgctcagagttatgtgcatggccaggtaaaaattaggaaagtccttaattttcgacactggctgaaatcaacaaggaaggctaaaatagagttgtaaagtggcggggttttgcagtcatgacccaacccctgcacagagcattcggcaaatgctgaggaatgtgttgttcgaggcgtttaagaacatgtctgtccaataataagctaatgactgatataattgagcagagactgcagtggctgcacaagcaaagaaaacagacttagagaattattccagtaccgtgaaacaataaatcatcatcaacaataacaactacaacaaaaccagaagcaattatgacaaatattttaaggaaagaatctgatttccagaatcgtcacattgtgtgactgagaagctccatttggcaaagtgaaattttgaggcagggacacagcaaagtactgtccatacacagggttaaaaaggaaagcaaagcaaaacataaaaacaaacaaacaacattaaaaataagttgacaaaatgatgtccagagatgcatttggtggttactacataaaaacttcaaattagcttttgtaaatgtggtcaaataaataaataaaacaacgttaacaattgttaaggaaagtacggaaagaatgcctcattacagagagaacattggcggggtgcagtgcctcacacctgcaatcacagaactttgtgaggccaaggcagacagatctcttgagcccaggagtttgaggctagcctgggtaacatggccaaaccatgtctctacaggaaatacaaaaaagctagctgggcatggtggtgcatgccagtagtaccagctactcaggaggctgaggtgggaggatttctggagcttgggaggcagaagttgcaagagcaaagatcatgtcaatgcactccatcctgggggacagagcaagagtctgtctctaataataatataataataataacaatagagaatactaataaagaggtatagaagaaaggatcattgaattaaagacagataaattgataattattctgttccaagaatagaaaaaaatgacaaacagtctgcacaacctgagagacgatgtgacaccaatcaaatgttccaatacacacatagtaagtttcagtccttccaccatgtgagctcgcagtgagaagatggcagtctatgaaccagtaagcacatccttaccaaacaccgaagtatctgcttgtactttgattttggaccttccagcttccagaactaaactctgacctattttttttggacatttgcatagtgtgggcctcagaaggaagctggctggaatttgacatcacagccactagtagtctgtgggttgtaaccccacagcataacatggggcttcagctgagcgtagtgacagaggatggagtccacatccaccctctagctgcagacctggtgggcagagacagcacttaggctatgcagcccttcatggtggctttcttcaaagtcattgtggtccatgtgtgcatcaccaggtcagcctctggctggcgttgacagcagagttgtactcactttacccagtcccactacgtggctcaagtctccagtacttcagattacatcagcagcaaattaaaaacagcctgcaggaagcatgagctatatgtgagcttccaagacctggatggcaggactggttcatcgcacccaagggctatgctgctaattactgtgatgtagaatgctccttcccaatcaatggacatgtgaatgcaatcaaccatgtgatcattcagaccttggttcaccttatagatcctgaatatgtcccaaagctgtgctgtgtgccaactaaactcaatgccattttggttctttacttcaatgacaattccaaaatcaccttgaaaaaaatacagaaatatggttgtaagagcttgtggatattgctaacttgaaaccagatgctggggacacacattctgccttggattccttggtcatagctgccttaaaaaacatacagaagcacagtggaggtggagggataagactttgaaaccatctcatgctgatgccttactgcccgagaaaaattttaacggaccttgctaataatttgctcacttggtaagtaacatgagtagttgttggtctgtactaagctgagtttggttgtctggtaactacagaaacttaaacttaaaaggtaccccccaagcccaccaaatttaattttagctatagttcaagctatttgggttattagtgagtaaatagggaaaataatctcaatggagttaaatgtattcttgggtaaagtatcagctggtttattagtgtctatcaaaggtacattttacagatagtgaaagttggggaagtaggaataactcctctattcacagatttcattcccaggaaggcaaattttatactggatccacagtccaggccatagcccgggctccttggggatgcctctgtctcagtctttgctgttatgagtttgtgctggagttctgttggtgtgaaaatatacttatttcagtcaaaacaaaccatatcattttcacatctcagtcctccatttgctgtattctttgctagtacccaaagtagactgattaaactttgaagtgaggcttagaggagtggaaagcatttgtgacaggctccatggtaactgtgtaacatgtgaaagcaatgctgcacctcttctttattggaatgactttttgaccagcacattaacttgaggactgccgactctaatatctatttcaggaaagcggtgctttgtctttttactacagagcataccacgtgattgggttagaaccaacaaaggaaataaaatgggaaagggtgccccacctttaagaatggctttagggggatgagtgtgccatttatgaatggaaattatgattttctcttgtagaaaggaaggctcagattaaattttagaatatttttaaaatatctttttcaccaacatgtactgggaaagcaatttcatactaaactgattaaatgatagttttataatctataactgcagtaatggttttttgtaaatatgaagtataatttattttatatctgttttgctgtaacattgaaggaaataccagacattttctttaagtgtttatttagaaagtaccaggagatggttccaagatggccaaataggaacagctccagtctacagctcccagcgtgagtgacgcagaagatgggtgatttctgcatttccaactgaggtaccgggttcatctcactggggcttgttggacagtgggtgcaggacagtgggtgcagtgcactgagtgtgagccgaagcaggatgaggcatcgcctcacctgggaagtgcaaggggtcagggaattccctttcctagccaagggaagtggtgacagatggcacctggaaaatcgggtcactctcaccctaatactgcgcttttccaatggtcttagcaaacggcacaccaggagtttatatcccgcacctggctcagagggtcccacgcctacggagcctcactcattgctagcacagcagtctgagatcaaactacaaggtggcagtgaggctgggggaggggcgcccaccattgctgaggcttgagtaggtaaacagagtggccaggaagctcgaactgggtggagcccaccacagctcgagaaggcctgcctgcctctgtagactccacctctgggggcagggcatagccaaacaaaaggcagcagaaacctctgcagacttaaatgtccctgtctgacagctttgaggagagtagtgattctcccagcatgtagcttgagatctgagaatggacagactgcctcaagtgggtccctgacccatgagtagcctaactgggaggcaccccccagtaggggcagactgacacctcacatggccagatacccctctgagatgaaacttccagaggaatgatcagacagcaacatttgctgttcagcaatattcgctgttctgcagcctccgctgctgatgcccaggcaaacagggtctggagtggacctctggcaaactccaacagacctgcagctgaaggtcctgactgttagaaggaaaactaacaaacagaaaggacatccacaccaaaaacccatctgtatgtcaccatcttcaaagaccaaaggtagataaaaccacaaagatggggaaaaaacagggcagaaaaactgaaaattctaaaaatcagagtgcctctcctcctccaaaggaatgcagctcctcaccagcaatggaactaagctggacagaggatgactttgaggagttgagagaagaaggcttcagacaatcaaacttctccgagctaaaggaggaagtttgaacccatcacaaagaagttaaaaaatcttgaaaaaatattagacaaatggctaactagaataaccaatgtagagaagtccttaaaggatctgaaggagctgaaaaccatggcacgagaactacgtgacgaatgcacaagcttctgtagccgatttgatcagctggagaaagggtatcagtgattgaagatcaaatgaatgaaatgaagagagaagagaagtttagagaaaaaagaataaaaagaaatgaacaaagcctccaagaagtatgggactatgtgaaaagagcaaatctacatctgattggtgtacctgaaagtgatggggagaatggaaccaagttggaaaacactctgcatgatattatccaggagaacttccccaacctagcaaggcaggccaacattcaaattcaggaaatacagagaatgccacaaagatactcctcgagaagagcaactccaagacacataattttcaaattcaccagagttgaaatgaaggaaaaaatgttaagggcagccagagagcaaggtcaggttacccacaaaggggagcccatcagactaacagctgatctctcggcagaaactctgcaagccagaagagagtgggggccaaaattcaatattcttaaagaaaagaattttcaacccagaatttcatatccagccaaactaagcttcataagtgaaggagaaataaaatcctttacagacaaacaaatgctgagagattttgtaaccaccaggcctgccctagaagagctcctgaaggaagcactaaacatggaaaggaacaaccggtaccagccactgcaaaaacatgccaaattgtaaagaccatcgaggctaggaagaaactacatcaactaacgagcaaaataacaagctaacatcatgacaggatcaaattcacacataagaatattaaccttaaatgtaaatgggctaaattctccaattaaaagacacagactggcaaattggataaagagtcaagacccatcagtgtgctatattcaggaaacccatctcacgtgcagagacatacataggctcaaaataaagggatggaggaagatctaccaagcaaatggaaagcaaaaaaaggcaggggttgcaatcctagtctttgataaaacagtctttaaaccaacaaagatcaaaagagacaaggctgttacataatggtaaagggagcaattcaacaagaagagctaactatcctaaatatatatgcacccaatacagaagcacccagattcataaagcaagtcatgagtgacctacaaagagacttagactcccacacaataataatggaaggctttaacaccccactgtcgacattagacagatcaacaagacagaaagttaacaaggatatccaggaattgaactcagctctgcaccaagcagacctaatagacatctacagaactctccaacctaaatcaacagaatatacattatcagcaccacatcacacttattctcaaattgaccacatagttggaagtagagcactcctcagcaaatgtaaaagaacagaaattataacaaactatctctcagaccacagtgcaatcaaactagaactcaggattaagaaactcactcaaaactgctcaactacatggaaactgaacaacctgctcctgaatgactactgggtacataaagaaatgaaggtagaaataaagatgttctttgaaaccaatgagaacaaagacacaacataccaaaatctctgggacacatttaaagcagtgtgtagagggaaatttatagcgctaaatgcccacaagagaaagcaggaaagatctaaaattaatacccttacatcacaattaaaagaactagagaagcaagagcaaacacattcaaaagctagcagaaggcaagaaatgactaagatcagagcagaactgaaggagatagagacataaaaaacccttcgaaaaatcaatgaatccatgagccagttttttgaaatgatcaacaaaattgatagactgctagcaagactaataaagaagacaagagagaagaatcaaatagacacaataaaaaatgataaaggggagatcaccactgatcccacagaaatacagactaccgtcagagaatactataaacacctctatgcaaataaactagaaaatctggaagaaatggataaattcctcgacacatacaccctcccaagactaaaccaggaagaagttgaatctctgaatagaccaataacaggatctgaaattgagacaacaattaatagcttaccaaccaaaaaaagtccaggaccagatggattcacagccgaattctaccagaggtagaaggaggagctggtaccattccttctgaaactattccaatcaatagaaaaagagggaatcctctctaactcattttatgaggccagcatcatccttataccaaagcctggcagagacacaacataaaaagagaattttagaccaatatccctgatgaacatctatgcaaaaatcctcaataaaatactagcaaactgaatccagcagcacatcaaaaagcttatccaccatgatcaagtgggcttcatccctgggatgcaaggctggttcaacatatgcaaatcaataaacgtaatccagcatataaacagaaccaaagacaaaaaccacatgattatctcaatagatacagaaaaggcctttgacaaaattcaacagtccttcatgctaaaaactctcaataaattaggtattgatgagacgtatctcaaaataataagagctatttatgacaaacccacagccaaagtatcatactgaataggcaaaaactggaagcattccctttgaaaactggcacaagacagggatgccctctctcaccactcctgttcaacatagtgttggaagttctggccagggcaatcaggcaggagaaagaaataaagagtattcaattaggaaaagaagaagtcaaattgtccctgtttgcagatgacatgattgtatatttagaaaaccccattatctcagcccaaaatctccttaaggtgataaacaacttcagcaaagtctcaggatacaaaatcaacgtgcaaaaatcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacaaaataaaagaggatacaaacaaatgggagaacattccatgctcatggataggaagaatcaataccgtgaaaatggccatactccccaaggcaatttatagattcaatgccatcccaatcaagctaccaatgactttcttcacagaattggaaaaaactgctttaaagttcatatggaaccaaaaaagagcctgcattgccaagtcaatcctaagccaaaagaacaaagctagaggcatcatgctacctgacttcaaattatactacaaggctatagtaaccaaaacagcatggtactggtaccaaaacagagatataaaccagtggaacagaacagagccctcagaaataataccatgcatctacaactatctgatctttgacaaacctgacaaaaacaagaaatggggaaaggattccatatttaacaaatggtgctgggaaaactggctagccacatgtagaaagctgaaactggatcccttctttacaccttatacaaaaattaattcaagatgggttaaagacttaaacgttagacctaaaaccataaaaactctagaagaaaacctaggcaataccgttcaggacataggcatgggcaaggacttcatgtctaaaacaccaaaagcaatggcaaccaaagccaaaattgacaaatgggatctaattaaactaaagagcttctgcacagcaaaagaaactaccatcagagagaacaggcaacctacagaatgggagaaaatgtttgcaatctactcatctgacaaagggctaatatccagaatctacaaagaactcaaacaaatttacaagaaaaaaacaaccccatcaacaagtgggcgaaggatatgaacagacacttctcaaaagaagacatttgtgcagccaacagacacgtgaaaaaatgctcatcatcactggccgtcagagaaatgcaaatcaaaaccacaatgagataccatcccacaccagttagaatggcgatcattaaaaagtcaggaaacaacaggtgctggagaggatgtggagaaataggaacactgttacactgttggtgggactgtaaactagttcaagcattgtggaagacagtgtggcaattcctcagggatctagaactagaaataccatttgacccagccatcccattactgggtatacacccaaaggattataaatcatgcttctataaagacacatgcacacttatgtttattgcggcactattcacaatagcaaagacttggaaccaacccaaatgtccatcaatgatagactggattaagaaaatgtggcacatatataccacggaatactatgcagccataaaaaaggatgagttcatgtcctttgcagggacatggatgaagctggaaaccatcattctgagcaaactatcgcaaggacagaaaaccaaacaccacatgttatcactcataggtgggaattgaacaatgagaacacttggacacagggtggggaacatcacacactagggcctgtcgtggggtgggggtaggggggagggatagcattaggagatatatctaatgtaaatgacgagttaatgggtgcagcacaccaacatggcacatgtatacgtatgtaacaaacctgcacattgtgcacatgtaccccggaacttaaagtataataataataataaaaagagtcagccccctagcctggcagtgctgctctacaggcaccctcagccctgatcccttcactgcacctaggggacacagtttacaggactgagtcagtgggacaccctgttcctttacattcccagtcatgggctcagattctgcacttgtctcactgctggagggaggagcctgcatcagtcaccctcaaagaagacatgaagttatttcacctgtaaaggcaagaaactgttcgcagcactgggggcaggcttggggaagatgaggtttgtgaggatgttgagaattcatgcagctcatccttcagccctatagctttccagagaagtgtataatgggggtcactaggcatgtgagtaactgatttggtgaaagatgccacttcagatcaaaagtgcatttccccttccccaaggtgtcagcaacactgaaacatatttgactaactttatagaggaagattaagatagaggatgagagagacataaggcctcaggaatatcttagccaatagaaagcctgctggaagatgcatttccaatatgattagactgattgaaaaccttgaaactaaacacttccaaaggagactgggacccatttctcctgagaatgacaacacaaaaaatagtagaggaaaccaacaaaccaaaagcagacactgtttcagatctattgaaaatcctcaagatagtctcataatataatattcaaaatatctaggatacaattcaaagaaacacttgttatatcaagaagtagaaaaattcaccatttgaatgagaaaaggcaatccagacatcaacgctgagatgatttagggctgaaattacctgacagatatattgaaatcagccaccataaaatcctgttgatgagcaatttcaggcattcttgaaacaaatgaaaaaggataaattctcagaaaaaatagaagtcataaaatcaaactaaatataaatacaaataaaataaatgaaaaatttaaaaatacctctctggagagactcaagaacaagtaactatgaaactaaaatccacgcattagagaagacacttaacactgttaactagagaagcacaaaccatagttatcacagcccagcagggcgagcaatcagtctgctcagaagtgagaggcctgaaaaaaaactcctggtgtccctgatggtgaaatctggcccctgatcccagggttcctccctcttcgtgctcagagggctagacctagcagtgaagggttcccaacctcaccctatgcggcccctccagaaggcagagcccattcttgctgatattcccgatctccaataacacaaagtgaaagagaatgtcttaaccagagtactgagtcttggcctatctgaacatatttcaaagtttaaatgtacagtgagcataggatgctgagcagaggccccctggacagtggctggagttgggagcagtgcaggatggaaggacaggtcaggggccctgagcacctgtacctgcacctgcacctgcccagggtggacatgactcccgcatccaccagagggcgttgtggtctaagcaactaatcagagctccccagatcctctgctgttttccctccacctgctggtgtttctgtgccctccagatggtgttgctcctcccccttctatgaccacttttcagccataaccttgtctgaggtcaaaggagggggttgtgcaaccttcagaaagggagaaatttgcatggagccctaccactctgaggatacgcgtgacagataagaagggctggtgggatcagtcctggtggtagctcaggaagcagagcctggagcatctccactatggcctgggctccactacttctcaccctcctcgctcactgcacaggtggctgcctgcaaggaattcagggagcgttcctggatgtcacctgggctgatgatctgttcctcctgcctgggaaccagtcttcatctctcccgactgatctctgtgttgctctcttcttgcaggttcttgggccaattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcacacagtgctccagacccatggggaagtgagacagaaactccccagagcatctctacctgggccagtctcagcctgtctccaccagagagggtagctctcccatctctcctgtctaagtgcttgaggtgaactttgcttatgacttcctcttttccttttcaaaataccaatctgtttttccacaccttgatggctgattttctgatatgtgcacgatcaattgtgggataaatgtagtttataatcgggtctctgagccacaccatgattgatgttctggttggggctgccttgcacagtataagttattgacttgcatctctggcctctacccttagatactattaacaccctcccctcatttgtgacaacaagactgtcttgagacactgccacatgtcccatgcttggggacaaaatcagcccaggttgagatactcagttaaagagcatgtcttcagctactaagaagcttggctttgaaatgtgtttatgccattctgctgagcatgaggctggttttctaatttttgtttctggttcccatctatgagacaaaacaataacaccaaacttcaatgttttgatggttgaatggtttttccaagcaacaagaagtcagagattgtgctacttagaggtgtagaagccctaaccagatcctgtaacacagagtttagctctgactaggacagcacacaatgccttccatcaatctccaacccacagcccgcaggctgcatgcagcccagaaaggctttgaatgtggcccaacacaaatttgtaaactttcataaaacattatgatttttctgcaattttctatagctcaccagctattgatactaacagttagtatcagttttatgtgtgttccgagacaattcttcttccattgtggcccagggaaatcaaaagatgggacacccctgctttgcacttttgtacaatgcacatggaaatataatagagccttcttccttctaaggtcatgtgactcagccattgaaaggtggaagtgctgaaatgagctccatatgaacggaccttgaaaaattatgctcagtgaaaggaacaaatgcaaatatctagaaatgaaatgtctggaaatgactgtatttataacaaatgtccatgatacgtaaattcatggaggctgaaaagatcgagattatcctcaaaccttgtgataatttaggtgaaaaggatgatttcagaattggatagaaagtgatctacttcaaaaataagctggaaatgcctccacgaacagaggcgatgctttgcggaatcctaggtggagaagtgtatcaggtgcagatgaggtctttaagaatacttcttgttttgttttgtaaaattaaatatgaataagaacactgtgggccaggcgcggtggctcacgcctgtaatcccagcactttgggaggctgaggccggtggatcacgagatcaggagatcgagaccatcctggctaacacagtgaaaccctgtctctactaaaaatacaaaaaaattatccaggcgtggtggcaggcacctgtagtcccagctactcgggaggctgaggcaggagaatggcgtgaaccagggaggcggagcttgcagtgagctgagtttgcgccactgcactccagagcctggctgacagagcgagactccatctcaaaaaacaaaacaaaacaaaaaaacactgtgcttgctcgcttacctcctcctcaggtcatttcctgcagtctctaagaacagtccgcctggcttccccatctcctccctgagcgccagcatctggggcgtgaacagcacaatcaaggccacacctgtgagaccctcagtgcgtcagcagagctgtgtcctggtgatgtcaagggacacggggtcagcaggggacctgtgaggctgtctcagggggtgagcatgtctggccctgccagctgggaaggccctcaggaggttgaggggagctgagcacacagtgagctcactgagctgagatgggaagtgactgcagctgtcaggaccttcagggacactcagtctaggatcaggctctctcaccctgtggggcctggttcaggtcaactcctcatcctcctcttcttcctccagacaagagagacattgcctatggctgaggggtcctggaggtgatccgggtgcagggacttatttgaatgtaggaaattctctcccagtgagacctgtagagactaaaagagcgttaggaacattcactgttacggctggagtcttagggtgcagatctcttgagcacctgcaccatggcttggcccctctgctttttgacctcttccctccctgcccagctgaggcacatcctgctctggggagaagggtctatgcggtcctcagcccacctctgctccactccctttctcacagggctcattgttttctctttctctccaccctcctgggtctgtggtccacatggcactgacagcctctttcactgaccaagcctccgggactgacaattacaatcacccaccctggaaacagccataatactgtcaatcaaggcacagcttggattcaggagcacctgggacatgtccccaaacctcagacccagagggggtaacaaccatccctcagggacctcagggaatttcccagccccatgttaggcagtttggcctccctggccatctctgggctccaggctggcgacggtgctgattttcactatttagcacagaatggcagcctcgctgattattctctgattatctggatgctctgtgactccttctgtgcatctctgggatcatcattcagactcacctgcaccctgagcagtaacatcaatgttgtttgctatgacatttactggaaacatgacagggcagggagccttccctccctggtatctactgagattctactgagattcaagcagaaccagggctcagggtccccagcctcttctccgtgtgagtgggtgccgtcgccagtgctgaggctttccatatctttggtctcaagcttgaggatgaggctactcatggcacagtagtgcctctcacagtgccatggatgggatgttctctctaaaatagaagtctttttttttttttagtttggcccctttgataagtagattctataataattaaagaaaaaaagtaatgtcttttttggagagtagaaacactggtgaaagagaaaccgggaaggacttggcatggggggtgggtgggcttcaggccacggctctgacccccacgaaaggagagaaggaagggggattagtaggaactgccccagcccacaggcaggtcagacctcagacaaagcctcagccaactgagtgggttctttcccacgggtgcccattacaagtgccctgcttcctgcaggaagacctgcctggagggaccctggggtccccattgcctggagccagcccacgggcaggggacatgttagtcacttgtggtcctcctgcacgttctcccaaagaggcatctgagtgggacacttccacagccgccaccagcactgctgctgcattccccctcaggacaggggcagtgccttccttccccggctcatctacctgagccccatgtgaagtcaaagcttaggtgtctcagggctttcctccaacaggccctgcagccactgagacccttatataccctgagctgcatgctgtggagagagggtctgtggaagaccttggctcttagccatcgactcctctggggaacaccatgaaatcctcagactggggatgtcctctggagccatctttatcctcttcttcttcccagtatctcctgctccatgatctgggtcctgtccctggccctgttgcatctccagtgtctgatccatgccagcccttccttaaatatgtgttgaacccatttcccatttgcccaagaaatgagtgctggcaatgagctgcactttttttttttctaaatgggaaatgggtcaataaatgaatgaatgaatgaataacaacgcaacctgagtctcctgtcacatggttattttaagacctgcgtttttctttacccaggaggaaaatgagtacctgcagccgttattgcctctgaattgagctaacttgtttctacactgtcatgccatggtcacagtgggacagatgtacaccaagcctaccatagctttcagccctgcccttccacccgccccacctgtggcagtgatggcatcaaggcttccctcagagtcggcctctacccaccacacactctgggccatctcctgctctccaacagcctggggttcagtgatccctgtccatgtgttctacctcagagacacctgccactcctccccttccctaatttctctgccatcctgtttctccagcctcccaggaatgtcccctgcccaatctcatgtctcaggttctagaacttgtcctggaacttccccagagctgagtctctaataggagagctgatgacaggcacagccgtggtcaagccctctagccagcagatggaggagaatcagcctgagggccctgtgcatcctccctgctgcacacctgggcccatagccccctccaccctccatatgctcctgcagcccccacctcagtgtctgcctcagtgtctcctcccagcaccttcctcaggaagggcctgagatcttgcatggtgtgtttccccttggtgaactcctagtcacagcagcatcccgagtaagagcctcctggtgaagagatcgtcttggtgctccaccctggcattgtgtcctcagctccagggcaggtcacacgctttcctggaccaagattacatgcaggccacccctgctggcccctgccccacagagggaggcccggggtcaggggtggcaccaagaccacagctccattgatccctgtaggaattcttcctgcatgtttgaaagacaagagttacagaaacaaagcagagggaagattctgggtcattgcaaaaggagaaatttgcctgcagaccagcaggggacgcggtgagaccttctctgtgtatttctgcaggacaggtgctcacagctggggagccctcaactgacagaggcccagggctgctccttcatttcctcctgggactctgcagccttgtcccatctgtgcctggcagagtcctctacacatgaccctgtgtgtggtcccagcagctgctgctttctctggtcccacccgtggggcaaactcttgcttcatgccagcctccctgtccaagggcctggtccctgcgagtgcacctgggggagaggcaatggggaaacacatttgcatggtcagcccctcctctgtgagcccagtgacgctgggataagagaggcctggggcagcccacccctaggtctgtggcctcagaggcagctgtgtccactatggccctgactcctctcctcctcctgctcctctctcactgcacaggtagggacagggctcagagcccagggtggtccccagcctgatctgtccctcatggctcagatccctcagcagctgcgccctgaccctgctcctcactgtgctgtgtctgtgtctgcaggttccctctcccggcccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgctaatcacagtgagacagatgaggaagtcggacaaaaaccaaggttttaagcttgtcatttttactgaactggttaagaacttcagtggttaataaaatcacattaaatacaggattgttgttaaaaatggtggcacattataactctctcccatttttttcacataatgcccatagtgactctaagcagctaaaatcaaaacacaaaaacttataccaatactaagaaatactaacattactaaccaatttccactagtaaaagagttgtgaaacagctgaaatacatccagatggcataatacataataccactatatacaagagttgtataaaattatgtatcatgtatatataaaattatgtatcatgtatatgtataatatatgaaataaaatgtcagcagacattaccgtcttcccaccagtagccagcaattctgccctgcctctagaataaatggttaccacgggttgaataggcgaacagccctggcagctctgcaggatgactctcactgtttgttattgttttatttttaagattgcttttctttcctattttttttgaggcagagtcttgctgtcagccaggctggagtgcagtggagtgagctcggctcactgcaacctaagcctccctggttcaaacgattctcctgcctcagcctcctgagtagctgggattacaggcgtgcgccaccatgcctggctaaagtttttgtattttttagtagagacagggtttcaccatgttggtcaggctggtctggaactcctgacttcgggatccgccgtcctcggcctcccaaagtgctgggattacaggcgtgaaccaccgtgcccgacctcttttttttttttttttagtttggttttgttagtttagttttgttttatctctttaacttgacagtcagagatgatccatgtggatctctgcatgggtctgggagctgcaaggctcctggtgcatggcccggtcccgcctgccttggcagggctcctccacctggctcctggaggagcagctgcgcccgactaccctgcatggagcccgcggcttagcggcagctcgggaggggcctgatagaaacttccccctgagcaagcagcgccaaacccaggccgccacccaggatggaggctgcatcacccccggggagcccggatcctcgccagggtccaccaggagaagagcacatggcggagatgagcctgcggggctgggagagagagaagacacggcgaagctgcaggtgaagacgctgcactaaggccccacccagaggctgaggttccccgaccagaccagcagcagcgaggctgcccagagcggcgccagcaaggtggttctctccaggtcggatcacaggagaagctagccttgcacctggcccaggcaagaagcaggacatgggcttacgcagaagaatcagcaccgattccacatcattccccatggcaacggcctctacggtgctgtcagcaagacccagtgctagacccgagcctgcaccaggagctgcggagcggagggtgcgccccatcccgatcgtctccaccactttagctccctgggtgagggtgacacggggaagcttattatcgcggctgcccaaaacggggcgtggctgggtaccctgtgtacatagggtagatgctgaatgtgaatagcactgaactactagagggaggctggagaggcccacagtgtctatctaccatgattcattatttgggcccagaggattgcctaaggcctagtatttggctcagttggctcagtaacgggcactaggatgcagtatttgatcactcctatcctaaccaagtacgacaactggtgcaaacagactcaaaagcaaaggcaacgcaatgaataacttgctcactctggggccacatatgctgaataaaatgcctacccttgaaatgtctgaaaaccttacaccctgggaaaattgcatacagaacttgtgcttggagaatgacatgaactctaatcagggtaataacacttgtaaagttcctaacagcttttctttccttttttttttttgtttttgagatggagtttcgcagtgttgcccaggctggagtgcagtggcgcgacctcggctcactgcaagctccgcctcctgggttcacgccattcccctgcctcagcctcccgagtagctgggaccacgggcgcccaccaccacgcccggctaattttttgtatttttagtagagacggggtttcacggtgttagccaggatggtctcaatctcctgacctcgtgatccacccgcctcggcctcctacagcgctgggattacaggcgtgagccaccgcagctggcacttcctaatagcttttctgtgagtgtaacgccataatcatcttttaaaatgttttctcggaactaaaagttgctgggcgcctaaatgatgttgcatgatagttttgggtgattttactgcatctgtaattttctgtttaagtgagcaccgcttaatttgaaagctaatttctcacagtgtaaatctgttcattcctggtagtctattttctacaaaagtgtatttttacacaacattaaaaaatggtgtaccttcatctatgacagtacattacttttgacaagcagctttcaggcagaaattaagagaagtgttttatataaaatttattattttgaacagagtttgtgatttggtagttacgctgttgaaatttgaattttacaattcttagaaacttatattgatgcattcttgttaccaaatgattggcccattacattttgatacaaatagatttgttgttttggaaccattatttgtttagaaatggtcaatcttttagagagaaatacttaacaaaggattgtgggaagttttttttttcttcttctttaacggattgtaccaggtcttacttgaatgaaagtctgatgcttgctgatggcagagtgactaatctgcactagattgatgtttagagcagaatgttgggtgatctcaattgtttttatttatgtttgtgattttgttttaaggtaatcttaacatggtataagactctgtgacaagctaaacctactgcaatatagcatgttggagtcccctaagagttttaaaagctaatggcataaatgcctggagccaacctcggcagttatttcatagcagaagataccgtcttaatattccttttaaattcttttaaaaggcaaaataggatcatcctattttataatgtacaaatgtctgcagagattgtatggtttgttgtgttaatgtttcccacctaaaatctatcatattgccactttgcctaattgtagtcacatttattaagtaatgcagtttgtactttttattttgtaacattctgtgatttttgtacaacattgtatttgtacaatacagcaattcccagttgattgaatgaataaataaaatgtaaaatcatactttataaaaagatctatgtggctgatagaattctgacattcccctccaaatggaaagtgatgtgtttctttaaagtaaaggtagaggagtcttaaatataggtgttcctgcccctattgagaggttttcaaaacatgctcttaatttaacgtttaaatataccagagtcttagaatgtgagaataatgaaattggtttgttttaattttgtgataatattaaatctactggaaagaatattctcctttgaaaagattctcagctcagtgatcatagaacctgtacttgcgtttaattcaatgaggaaagacatagaaatgccacgttaatatcctcatttaggtggtttctcccttcactgatcagcctatgaatgtgtcaatgcagtactccccagtttaggcttaggtacttattgaaaggatgctgcctgagcatttttaataattgctatttcaagatcacattttggccatgaggcaggctgccactcactttaggctctgcctaggcaggaatgggtcctggaagacacatgttctctctctctctctctctctttcacacacacacacacacacacacacacacacacacacacacacacccctctcttctctctgggtacacattattctggacatcttcagtttccaggattctctatgtctccagctagaagtcagggcttagcctgtggtgatccagccaccctcaggttgaatctcgatgaagtcacaggaaccaccagtggcatggagggtaagggatcctgctatcaggttcagccaggaaatgctctggacacctgctggtggaagagtttaatgctgggcaatcacaagtcaggtcccttcttccagtcggcagttcagcctccctgactttctctgggttccagtcagtgcatgaggatgatggtgacatttattcaggggcagcacagcagcctcagtcaccaccaacagtcactgtcatatgagaaaattagatagaaattggccttccaactcttctgtcagatccatctttgccctttttctgcctgcttgagtgaatacgaccaagaccagctcaggtttttgctgatgctatcacacgtgctcctaaaaccagaaggcttaatggtattttctgtttatctttacggattcaatgaaaagacaccttttcttactggtctcccaatgaaaacataatcactatgtccacagtaacaaagatagccctcgttgttgtctgctgggatgagaagagcagcagaagtttggcaggtatggccctcatgggcttcacatgtccctacatctggccctggctttgctgatcaccctttgggctctgaacccacagggaagttaggtttctctttcttttgagattgcctctggaagagctgctctgttcccaggtgcagggcagcccctccgcagtaaggacccagctctcagagccatgaaggcctcaagcctccaggttgactccacatttctagtgcttgtctctggttctttggttggaaagatgttggatgaatagaagttctctgagacctaggctttgtgaatccaacccccattaaatccagggatctttttaacgaataaaatgaatcagggcccagtgatggtggggaaatgggacgtgagggttcctcaggccagtagtatggggagaacatccaaaaagaaaggaggggttccacttttgagaattgtctttttatatccatccacatattgacgaaaattataaaattagactaaaataccttaaatatataacatggtcaaaagaaaagaggtattaccaggataatattaaatagtaaaagaagtcagaggcgaaacagagcaagagacactttttttctgacagcatcattcttatgggctataatgccaaggcttgtgcagtaggagctgaaggaatctcacaggcgaccctcacgacaataatgacaataacaaaataagtcaacctctaaaagaagcccatgtagaattatccccaggtatgaaccacctggaggctcagcagaacattaagccttagattgggttcaagatgaccacagactggtgatgaccacaggcccctgggagcaacacactcacacgcctggtgatgctgatatctggtaaatcatcactgtgcatcctgaaacacattctgtgattagctctttgcagaccataactaacatgaaagaaataatgcctcagctgtaaacactgcagagaggacccactcattctactcccttaggtcatgagttgaaagatccatttgcaatggtcaggatgtccttccagaagagctgggtctgttctgaggggccacccgacttgggatcggagcccagcagggggtgctgttggactgttcctgagagggcagggctctgggccaggccacataggaaaatactggttctcatacacttgagcaagcagtgtcctcactgaagtatgacttcctgcacctgcaccaccgagcaggagccacttcctgcacctcaggagccactgagcactagactcacacgccaatgcttcctattttatcctccgccctcatggagtccttgtccaagcctgcccttcaagcagagacaaatcacacagcaggaacaaatttgctcaaaggaacttgaactacaatgtttcctgggcacagaatgagaaacacttggaattggggaagttcccatcctaacaacttagactcaggaagaagaaccctggagcttctccagcatggccagaatctcagtccacttcaaaatcctcagtctttagatcaggagttcttttagggatgaggtcaaggtttctgggtgcacattaccactgcctttcagtcctatcatctgggcatgaggagcttgttatctcgttctatccattatttctaaacctccttgtagagggctgggttagagagtgctaactgccatttatacagtctggacctttgtataaaattataaacacacacacatacacacacacacacaaacacaaacacacatacttattttgatgttccagcgaaagagtaaaactaaactcaacagaaacagaaacagatttgaataatacaagacaatctcattaatgaacatagaagcaaaactctctcagaatattagcaattagagtccattttatatcaatgaaggattatcttgagcatctgggaggatgtgggttgagacatttgcacagtcattggaagacagtgaacatgatttttgaaaaaacagcatgtttagagatatcaaccagaggtcagatgcttcaatcagagaaagatcctctgagttctcagggctgcttccctgaaaagctacgggagaaggaaatggagtgactggacacaatgccaggggattcattgaccctttggcttcccatgggcagcatgcatcagcatggtcttacaaggatgaaaaagggcatccctcaaaaaagaccgaccatttccccagaaattaataaagaaatatcatggccgggcgtggtggctcacgcctgtaataccagcactttgggaggtgggcggatcaggaggtcaggagatcgagaccatcttggctaacacagtgaaatcccatctctactaaaaatacaaaaaattagctgggtgcggtggcaggcgcctgcaatcccagctactcaggaggctgaggcaggagaatggtgtgaacccaggaggcggagcttgcagtgagcctagatagcaccattgcagtccggcctgggcgaaagagcgagactgtctcaaaaaaaaaaaaaaaaaaaaaaaaatcacagtattttcaccagtgcatttctgtttgagcgaatatgttgggtgaagaaatatataatatatacttttctaaatgaaatttttatctcacaaaattgtagaattaaatttttgttttggataagaaatcaagaaacaatcacacacattcttatgatctcatgaaaaccaggtataggaaaggaagtgacgaccccaaaattcatctaaaaagtgaaggttttggttcaaagataagagggttgtcatgttcaagacaaagtcactaccattcgtggtatttaaagctgttggtacaagtgcctatcattgccgattcccttcaaatttcttgtgtatgtttggatcttaaacatgagcacacacaaaaagagaaacagcaaaactagaaaacagatttacctttttgagtttccaactggaggagaaaatgaacaaagagtaagaatatcacatgataatgggaggaggagtgttaggaaggtgatgaggagcagttcagccttcccagcttggggacagtcttagtggagcagagaaacctccttcctgctgccacctgactctctagagtagatgaagaataaataactaaacataaaaagcccttaggaaaaagattgtcatgatgtcagtgctattaatagttcagttaataattctgtaagaatatgcaaaaacttactggctttttaaaaatttttatttatttatttcttttgagacggagtctcgccctgtcgcccaggttggagtgcagtggcgcgatctcggctcactgcaagttccgcctccagggttcaggccaacttactggcttttatatttggaatcacaacctgaaaggctgcagaacatgaaaggaagaaaactcagattgcagtgttcattctcttttatattatgagtttcctgcaagagctacatctgttattatgcaaaaacaaacagataaggaaacaagaattatccagcctcaagagtggaataaaacatgcactttttttgcttgtaggcataggtgagtaattcagacacggctgctgtgggtgactcatttccccttatgatggagcctcagcaaaaaagcttcacagattggggctgatttggtatgaaggggttggaatcgactgaaggtgacctcattgagagtctgcagtgaagccggccttggctgaatgacctacctgaggcctcccatgtggcctgggtttccaggaagctgggcagtcccagagaattcagagctctgacttggtttataaagtgtcacttccacagaaactgtcagtgccgagagatcactagtgccagatctggttaacagggaggggcctgatctcacccctcaacggaaggtgacgggaaaacaaaggaaaagctgtcttcacatcaacatgggcagataccactttaaagcatattctgtagcagggttcccactccagaagctgtggtacaggatgtgtctcctatggcatgggccaagggagggtaaaggtgagtttgacatctgtctcagtcaccatgaggtttttctgacaactaaatataaatatgtaaggtgtctcacagcacaatcatgtgacaataaatgcagtgcgtgccttcaatattgctctatcaaggaggctttccctccactccaggtgtgagcacgtggcttgcatgtccctccactccaggtgtgagcacgtggcttgcatgtccctccactccaggtgtgagcacgtggcttgcatgcccctccagcttcctgcactgtggtcatactgctgctgcctcattctcagcctgagcatccctacacaggcacaaactctatggctcaggctggtcatcactctgggtccacagtagctggtcagagagaaactgtcttcagccctgcccagcaggagaaaagagcattccagactgatcagctgggttcctgccatccagaagtccttgtctgtctggaggctcaaaacatgactgtgattcctttgaggactcctcccatacccaggctgtgggcttcgctgccctcctcaggacccgtgcagcctgttctatccctgcctcagctgcaggcaaagctgcttgccacaagctccctgctcataggatgccggagtcctcccaagggctgctcttcctggagaagaaggagaaccaggcagtaaggtctacctgagcatcatgggaaggaagtgatccgattctgactccggtgggcgcacacccttggtgctttgtgtctcctgctatcccagccacaggagtgggggaaatgtgtgagttgtagtcctagccgggaataatccataaaaggtgaaggtgagagaaggacactatgcatggtgtcaccttgttttcctcgttgtttcagcggcctgagtcctgtgtttcctgaaagatctgtggctcgaggtgacacgccctatcaggggacaggaatcaaagaggagaatctctgatggaaaaattcacaaaggaagagggagataaaaattgggcaacatgctcagggtgagaacgatggctttttgtccttgtgatagtttgctgagaatgatggttttcagcttcatccatgtccctacaaaggacatgaactcataattttttatgggcaaggacaaacaaccaaacaccgcatgttctcactcataggtgggaatcgaacaatgagaacacatggacacaggaaggaggacatcacacaccggggcctgttgtggggttgggggagtggggagggatagcattaggaaatacacctaatgtaaatgatgagttaatgggtgcagcacaccaacatggcacatgtatacatatgtaacaaacctgcacgttgtgcacgtgtaccctaaaacttaaagtaaaataaaaaaaaaaagacggctttgtgtcaagggctatttatttagtgtctctcgttcccattattaaataatttaacaacaaaaattgccttttctatgaattttcaggaaattctaaccatcattcctttattaaatatctagatatgtacatctacacatatgcatatacatgtgcatatatagacatatattatattatatatatttgtgtgtatgcatgtgtgtatatatttatatatatatacatgcatgtgtatatacacacacaaagacaaattaagaaatatgggaatatagtatacttctttaatttcttaataatgtccatttatatctaaaaaaaagatacccctaaggttgaaccactagaatcattttatttttaatgtggaacaatagaaagcttatggcccataaagatattggataacatatttttctagcaatatgagaaataagcaaaagtgtaaaacatttaaatacaataatttaattcaaaaatatgaaataatttgtattttttagttgctatgtttatctaccaagaaggcattatattattctgatgttcttacacattgttgaattaaagcttgttaaatacaaatgttatcatatgtgcaaatagcatatcaacatttctttttctctcatatattttcagaaatcactttaaaatgtagcagttcataatgttgacaaaatatcaaaatctataaactctgggtttaaaaaacaatgaaatacacagtacacataagaaaatagtgtcaaagctcactactataagagacaatgatcaatattgaaattttctcttacatgaagacgctcaaaacattttagcagtgactagtgaggttgtatccattctcttatgtttatatttatgtttaaaatattgtccttgagaaggagtgtaggtaggtataagcagaggtggctgtgcggatccaagattctagcctgcccccttgatacagcccattaccctagtcccatccaatctcacacatggcccatcatcatcttctgacttgagcggggagagagacggtgggtagagagggaggaaaggagttagttcagagcataggagacgtggtcagagagttggcagagggagggagggaggcacattctgtgggttcacgtggtgctttgacaactgtggatttacttctgaatgaagcatgaagtcattgagagtgtggaacagtaaaatgatattgcaaaataaaataaactaagattccagtgagcatgttgggaatcacaaacactcacagctgggtgaataaacaagtgctgccatctggagaaaagttcctcagcacacaaggagaagtgtgtttgcctctgtcaagcagaagtccacctatacagagacacaaggaaatgtttataaagagatccttattcggagcaaagtattggaagcaacataggtgttcaacacaagtggaatttataacacaaggagaagataaaatgctagccagttggaagtaatacaacttcttatgcgacacgaataaaaatataattatcagttgaaaaacaataacaacaaactcccaccaaattaaacaaaatcaaaagctctcaagaaaaaaacaatgtgccacttattttaaagcagaaacatgcataacgaattcttcaagcttatataacgggctttttggaaagtagactggaggcacattatttcacataaatgggtgtcttaggaagagatggagacacgtataatggctaaaaaatgaaataaatccatagagaggtttttagtgtctagtgataaaagtactaataatattacgtaattaaattccaaaaaattaatacagaaaaatattcttgatttgggggtggtaacagatgattaagtaaagcgagtctacatgagctgctgatgcagtggatgacaagctctctgcagctcattgttagtgagaaggcactgctttgccagaaaccccttttatttagatttctcatggtccctgggtccctctccaacaccatgagcagcttcagaagaggatcaggataaccagtgactctctggctaccatggcccagttgtgtccgagaggtaagaaaggtttgggatcttggacagagtgggacagtgggagaaattcctgagatggccccaaccagcctggaaaccactcagaacctgcattgaagtttagccatcagggtgctcttgagactcggtttgggctgcaacacagacctgtggggacaggggtcaccataagccaggccacctccacccctgggtcagctcatctcctccctctctgcttcagatctttgagtaaccagcacatggaggcccgggaaaagtcagagagcaagatcttatttaaatgctgtgactccacccccatgaaggctttgggagctataaaaaagagacttaggggagcccagtctccaaacagagcttcagcaagcatagtgggaatctgcaccatgccctgggctctgctcctcctgaccctcctcactcactctgcaggtgagagtggaccttacccagggatctgcacccacctctgctccagcttctccactccctggctcagtggactctgatcctgctctcacattcctttctgtcccctctacagtgtcagtggtccaggcagggctgactcagccaccctcggtgtccaagggcttgagacagaccgccacactcacctgcactgggaacagcaacattgttggcaaccaaggagcagcttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcattggacagcagcctcagtgctcacacagtgcctcaggccagtggggaagtgagataaaaactcaagagctccctcggcctcactgaacaggcctcacagagcactgtttaaactggaccacccaaaagacaagggatgcattcacaatagtgtacactatttaggactgttaaaaataggaacatgaagtgaaattagcaagcctgccttattaacaaatgtgtgtagggaacatcattgtttatatattagtagttacatatatataatactagtgcatgaacatacatatgcactagcaattagtaaaaaagaaacactaggtttaactaaggaaatatttattattccagagttttcttatccattccatttgaagatgctgggatcaagtcaccgagggtgctgctctctggccttgagaatccactcagcagggccaccagcagcccctcccttctgtggcctgctcatgccctgtcttctcattagaatccccttccctgctgtcacagggatccctggactcctccagatccaaatatgtccaatacatttggttgaggcctcctgggccccacattactgtgtaatctcaacacccacacactcaaaacagtgttcccatgcgtattcttctttcgactcatcactgtcctctaacagccatgggcagtgtgtggagagagcaggtgaagttggagctttggggtacagttgacagagatgttgacattttgagaaaaagaaaacacctatatagctgttttcaggataattttccatcaagataaaaatccacgcatgagagcatcactcttccagtgatgaatgcatggaggatccttctcactctattgttgggtagtgacacctgggaaacttactgtgttatttagtgtgcagacagctggtaaaccactcagctgactctagggaagttgaccaaacagtgtccccactgatgtgtgacttttctccacccatgaggccccactaccctgtcacctcctgagtccacctttcccattgcgttgctttagatttgaggcatctctctcttacctctttaaagtctttacccaagtctggttcaggaagtgctgatacacggtgagaacccagggtgcatatggatggagtgattctgtgcctaggagagcctggccaggggatccaacacagcttgtggccatcctccccgcagtggagcttctggagacagagctctgaggtgtccccaccacaccctggggcctttctccctcagttctttataaaagggatatttgtcatgggcttaggggaagaggccgctgaggtcacacaagacctgccttcttgctctggctcacaaggcacaagtgagctgtgaccctggactctgtgtcagtgctgtggtcacttggtcagaactaagggaagctggagaaatgtgggtagctttgatgcagtctggcaccagaagctccatcctgaagcactctgaaggtgctgatggctgttcactgtgctgcaccctgagcaggaggatgatcatcatcgcagacctagggtgacagcctcagagctgaaatattcctcctggccctgagaaaagtgggctaaagttctcccttctgcgtgtgttacccagtggtttgcccccctttcatcacctgtgaccaacatgggctcattggggatatttgtgctgtcatttctggcacaagaacccaaagatctaagaccataaaatgcatttggtctttcatactgtctattcccatcagggcagacatctatccattaatacattttatttaattttcttgtcttatattttcagagcaatgatgagtaatgagtgaggtaaggggtacctttgcatttttttgatctcagggaaaatgtcctccatgcagtaagatgatgactccggaccaagacaggtgtgtgtgtgtgtgtgtgtgtgtgcgcgcgcgcgcgcgtgcgcgtgcacacgtgcacacgcatgtgtgttaccatatcataaacaaatttatctgtttctgtattcttacgtgatttttattagggatagatattaaaatttgccaaacacattaaaaatctattgatacaatatgatctttggttgtgatgtaataatatggtattataccaaaacttttattaatgttgaacccaaccattattttaagtataaatcccacttgacaatggtgtataaatgcgtaaatctggtgttgaaatcagttcgttcctcaaatttcctggttcaagtgatcctcccacctcagctccttgagtagccgggattccaagtgggtgtcaccatgcctggctaattaaaaacaaatcttatttgtctcaacatattgcccagtctggtctcgaactcctgggcacaagcgatcctcctgcctcagcctcccagaatgagttaacattttattttaaaattttgcattaatatgtttattttattttttatttttaaaatttttaacttttattttaaattcaggtggtacatgtgcaggtttgttacaagggtatattgtgtgatgttgaagtatacaattttatctttttaaattgctcttaatacatatttttaatttaaatttcaacttttattttaaatatagcaggtacacgcgcaggtttgttacatgggtgtattgcacccgggttgtgagcattgtacccaacaggtagttttttacaccattccctcctctccctccccctcctagcagtgcccagtgtctattgttctcatgtttatgccatgcgtgctcaatgtttatctcccacttaaaaatgagaacacgtggtatttggctttctgtccctgtgttagttgcctaggattatgtccccctgctgcatccatgttgcttcaaaggacattattttattcctttttatggatgcatagtattccatggggtatataaactatattttctttatccaacccaccactgacgggcacctaggttgatcccatgtctttggtattgtgaatagtgtggtggtgaatatacaagtgcatgtggcctttgggtataatgatctatttgtctttggatagataccctgtaatgggattgctgggtcaaatggtagctctgttttaagttctttgagaagtcttcaaactgctttccacaatgcctgaaatacggtgtatacgtgttttctttactctacagcctcaccatcagctgttgtttttttactctaattatagccattctgactggtgtgacatggcgtctcattgtggttttgatttgcatatcttgatgattagtgatgatgagcatttctccacagttttgttggccactaatatagtgcagttttaagttcatagcaaaatacagaagaaggtagaaagatattccctatcctccctggctccacacatgtccagccttcccccttatcaacgggtcccatcagaaatgtacatgtcctgtaattgatgaaccacattgacaggtcattatcactacaagtcagtattttccttaaggaatttttctcgctgatgcacatcctatggctatgggtttgtgcaaatatataatgacatatatccaccattacagtatcatgcagtgtatttcccttccctacaaatcttctggctttactgattcatctctctctctcccctaacctttggaagtcgatgacttttctacttttttcctttgtttgactgtaatacacttgaaattatttccccctttttggactgtaatatacttggaatcacgtatcatgtcatttgcaggtcagctccttttacttactaataagcatttaagtttcttccatgtcttttcgtggtttgatagtgtgttgtccataaacatgtagaatatattaatataaagtactttggagctgatcacatcactggccattcaggtttttcaattactgtttgttgaatgacagtgaccagtcagatgacaggaagtcttagaccccctgagaacacagaagatggactgaggatgtcagggtcaccgaggactgcactgggtgctctcatggagggctcagtaggggtgtcctctagttccagtgagcctggactgtgatgggcactcagagaagggtcctctctagcctagcagagcccctgctcacaggcctaccagctgtcccagcagctttccctcccaggtccttccgtggggcagacagagtctcactgcctgttagcccttcctacccacaagaccctcagcaaaagatccttattcagtgctcagggagaggtggggcagatagcagctggggccacacctgcatgaccagctcctcctcgctgaggcctacagcaggtaataaactcaatccatcccactggaccaaagggagctgtgtctaccatggcctggacccctctcgtgcttgtcctcactccctgcacatgtagggaaaaggcctagagacctggggcagttcccagcttgtgtcagcccctctggctcagacttgccaacagcttaaccctgacacctgctccaacaatgtaaatgtttgcatttccaggttccctcttccaggctgggctgacccaggtgtcctcactcccagcatcttcatgcagatcaaacactcacctgcactcagagcatatcggctttcatatcggtggcaaaaataccttcttttccctacagaatccagggagccctccaactatgttctgagattatgctcaggctaaaatgagtaccaggcctctggggtccccagacaattctctgggttgagaggctcctccagagtctcaagttatttggtcgtctctggccttcaccttgaggatggagcagatcatctctctcagatgggctgacagggcatggcttacactgtgctctaggccaatgggaaaatcccctctgcttgtgctgcctgggctcccactaggcccctgctgtttgtgacaacagccagcactggtggtgacgcttcagccatgtatgccctacggtgagagtctgcagcccttccacgcaactatcacttgcagaatgtctgcatcattgctaatagcacattctgagcctcctcacgtttctgtgggcaacaatttccttcccaagacgtgcacatgatacaggagatttatttaccaaataagtttattaggaatccaattataattagaagatattcatcagtgatcgggggaaatacctggtataattaaaatagaatttgatgaaaatataaataaagaactaaattatgaaggtgtgggcagagagtctggacaccctaagggagatggaaaaccattcatccttgccaggaatgaatgtctctgggatgcttctctaacaggaggaacctggagtgagaccaggaacctggagaactagcagctgggtgactggaaaggaaaccatctggggtggggttgggtctgcaaggcaggaggtgtctgggcagagaaagcagggctggggcggagggtcctgcctcatcccattctcctgctcactccttcctagatccctgtcagggcagtaaccatgagcaaggcttgaggctacttcttataaactgtggccctgggcacattccttagctcacctgagcctcagtttcttgatgagaaaaaatcgggacaatagcaaccaacctatctcagagggctgctgtgagaccctgagccactgtttctcaaactgcccctgagatcacctacaacagaatggctgtagggtgaagtttgagaaccgcagtataggtgaggtggtgcgtggggcaggccctcccacactgtaaagtgcagtgtggtgcggtaaaagctgatattcccgcaggcatcctcagagtgggcccaattagactcttgagcactgattccattcaaggtctgcggcttagagaggatggcaaagtgaggcaccaccaggagcttgtccctatgggctccaggccaaggacgtgcctggagatgactcctgccttgtggcgctgtcactgcctcactgtccacattccatcacgcctcagatcctggcttccaccctggtgaaaggaatctttcaatatcacccacccagccacagacgcttctctgcttctctggcaaggctgcaccccctggctaggtgggcagggccaggggctccttgagacagtctgcagccactgagctctccagcctccagggcagaggtacagtcccatggagcgtggctgatctgaaggcagttctggcctaaaaggggtcttgtcccttcctcgtcctcattgctcccaaggccaggttggcagcagtagcagcggggttggatgctattggatgggagaaggtgaatggactcggagtgcagaatcaagctgcggaagccaagggccttgaaggagggtcacacacaagggacaactgcagaggaaaataaaggaacactttgtgattagccctgcctgtggctgaaagcgcagtgcagaagcatagtaaggaaggactgggtggtctgggtttaagacctaggaaccgtctctgctcctccaagcctgaatgagccctataacctaagggtcctggaggtcttgaaaccttctgcggagaaggctccaggtccactgggccctgtgggtggaagagcagagtcacagccccgcactggggacctaacaggtgtggccttgctagggccccagaatgggaccagagtgggtgggagggggcagaagctctgagagcaccccctccttcctgaagcctgtgcttctgagacacatcccaggaccctctatgtggttccccatgtctctgtattttcattcagcttcgagtagctctccaaactgtgttccagggaacccccgtgttaacctgtgagggcctccaggaagggggtccaggtggggtatgcttggtgggctctgggtttccttacaggagctctcatataagtcctggtgcagcctgggaatctactactgagttggggcgggggcgggtctgagtccgaaacattcctgacctgcccctcaaagaaaggtcccactgaacagtctggaaagctgttttgctgagctcccgtcatcactcaatgaggcacgggcggagtgtggagggagtttccaacacacagtggatcccgcacaggtgtctctcctcgggtggctggggaggggagcacaagaaggcactgaggtcagagggcagctgccaccagcacctggcaccacagggcagtctggcctacagggtattttctaaacctggcatgtgaatgggttccatggggcacccagctgcctctaagaccataaggccttgttgtgagaatgggaattgcagcaggtcctgggaagctgccagacgcacacgggcaccatgtacagggcttctcagagatgggagcagggagcaggggacggagaagcgtggggtcaagagcgtggccctgagcagggggctgcagcgaagaccaaggggattcataagccagatccagggagggggtctcccagccccacctgctccactaaactcctctcctgccggagccacagctgtcaaggccgccttccttaaggcatcagggccactgcttgtgcacacagctaccatcagcagcacggattgagatggggtgtgagtgcaaactgggtctattccccagggcttcagggttggggcatccctgcccgtactgccagggtgtagggatagcagggagcactctgggcacgtgtatgcaggctgaagggagacgtattgggtttcggagagggaaagagggccccacaggtgcccagggacacggtaacgctctgacatcgctgcaccagcaaaggggccccagctctggataagataaaatgcattttaatagtttgaagtgccatgaggtgtctgcatggcactgcagcctgggtgagggaggacagggtcatcatacaaagtaggcggccagggctgacatcttgtccttgggccgtctggggttgggcttcccagggggcctcctggcccggccccgccctcgaccctgccttctccctggtccaccgcggtgcatggggtggcaggaggccgcatgcttcagctccaccagctcctggaagacggggtcacaaaagacgcagcccatgtgctgcgcctcatcgcccgggagtggggacttggccttgttgaagtccacatcaagcaaggcggcctcacagacactgcaggtgtcggcggacacccgcacgcggtgggcgttctcgaagcagtgcgctaccacgttgcacttgttgcaggccaccttccacttggggcccgaggtggggtccagcaccagcaccccgctctcacattccacgcactggccgatgcccagcatgctcagcgagtgctggcaggaggggtgcgtacactcgttgcagcccatgcctggcgggagaagggagccctgtaaaggcacgcccactgtgcccacctgccctctgctgcctgctcccaatgcctcaagctcctggatccctcgtcccagcagaaggaactcttcttggccttgctcttggggacagccttgctcatgtttcggctcctggctgccattacccctgttttctgcttacctgaaacctcctcaactttcaaggcccctcgctggcgccatcccagtgggtttcagctgactccatcccccctttgctttgctgccagcttgttactggtaatgccacatgaccctcatgtcactgggccacatgggaccaccctgtcagctactctggcggcagcaggagggcagggatggggtctcactcccggggcagcctgggtgcagactgaggcctgagggggctttctgcagagcacacggtgaatgtgggcagatgcctcactcccgctgattcctggtctggctcggtgctctgtcctgcctgcctggacatgcgctccctcctccagtaatgaggacgaggatgaggatggaggacagtggtggacgctgactgggggtgcccgctcaccgggtgggtcccccgactgctgcatcctcttgctgactcagctccagagggagcactgcacacctgcgcccaggtcctgagggtggactagggttgcctgctcgattctgacacagagagagggtggcaccactggctgaggcctaagcagtgccccagctacatccagggtctctcgtctcagtgccaatgagtgcaggaaaggccagggtgaggggtcccctcagagtccagcctggtgcaaggcaggggttggcactgaacagagactgcagctacctgtggacaggagggagcggctgcactcaccttgatgctgctgttcaacaatggattgctgttgcgcctaaccaactttaagacttggtgggcttgacacaacttaccttgtgataggcagatgtgaatgtgtggtcaacaggtatcttatggtcctccgctagggccaacagcactgcagaagttgttttacaaaacacatgcaattcattactgcagactgcacttagccctgctaagtgcagggctggagggcctgtgctgtgattctcccactggagctcactgcaaattccacatggcatcttttcttaccaccgacccctccagtcccctaaattctgccgagtcttatggcccaagcagcagggctgttttcactgcagccttgtcaggcagcagatgacttttctacgccaggctgcattcaaaggtggcagccttctgtagaccaacgacataggccagaagtggaacatgctgttcccaaaacctgaagagttctgccaggcattatgtttggacgatctgacccatcctgccttgaccacttaggcactcaaaactgtactcacgtgacagttccctgaatcttcatacagattatctcctaccctttatagtgcatgtttcttatgaaggcctccaacatgctagccatttcctactaaactaactcaactagcatgatgtcaacaacacagtcaatcaatgggatattttgtggggtgctcagatggcagaatgctcccacatcaataaaactcacccttatctaatcttcatgttctggtccccctctatcacccaccctcatgatccagtcccatgcctagtcccttgactcctgctggtacctgctggttaggtcttatggctcctctggtgtgtagtcccttttcttccccttttaaaaaatgttttgagacagggtcttttctgtcccctagactggagtgcagtgtcatgatcatggctcactgcagctttgacctcctggggtcaagtgatcctcatgtctcagtctcctgagtagctgggactacatgtgtgagccgccaagcctggctaattaaaaaaaattttttttttttttttgtagaagtgaatgttccgctatgttgcccaggttggtctcaaactgctaggctcaagtgatcttcctgccccaaactcttaggctcaagtgatcctcctgattttccttatccccgtgagcctcctgaagtgctggggttacagatgtgaggcacctcacccagccttttctctcttctcaaaatgagcacatctcctgctgtgttgtgctgggacttaaccctagttctaggccaagagggaaattgggcaagatggtgaagaaggcatattttgtcctagtgagagaggcctctgcaaacaaaggagtttagctctgaataggctgagtttagtccacttctgcaggctcaggggattaaggaaaatcagtgacttaagattttagaggcctcaatccaaataactctatcaatatatatgagggtgttggccgggcacggtggctcacgcctgtaatctcagcactttgggaggccgaggtgggtaaatcacttgaggtcaggagtttgagaccagcctggtcaacataaagaaaccccgtctctactaaaaatacaaaaaaagaaaaaaaaaaaaacaaaaaaaaacaaccctggcggggcatggtggcacacacctgtagtcccagctacttgggaggctgagactcaagaatctcttgaacctgggaggaggcagaggctgcagtgagccgagatcgtgccactgtgctccagcctgggcaacagagcaagactctgtctcaaaaacaccaaaaaaaaaaaaaaaaaaagaaaagaaaaaaccctgacttttctccagcagtctggatcaatcaccccaaacagtccagtgacccctgatggttgagcagcagcactagaaccccaaatttctaggggagacccagcttccagtttattaagttccatgcacttaattcttgttctgcttgattttgggtcagcagttacatgaactcacgtgtttctcaaccagtgttctggagatctggctcagtgcagggctgtggtttcaaagttattcaagcaatgccaccaaaagcctgtaccccagaatacctgccataggccatcctgtctatccctggagacagtcccttcttattgaagatgaagcactttggcccgtagctggttgccagagctttcagaaaagcgtcggagtaaaacaaccatctctgatgacaaaagacttaaaatggctgtgaagagctctattaattcctcaaatattcattgctctattttttatctccttttataactcctactgccaggctattggcctttctacttctatcctctccccgacattcccatcttagtaaatgactccacaagtacttcagctcccattcaaggaccttggattacccttgggtcctctctcttactcaacagcccatcctatgccaagtctcaccaattcttctctctctctacacacacacatatacaaacttatttgtaaacaattattttaaaaaatctctcttctgaggttccagctttcttcttcttttatttttttgagactgagtctcgctttgtcacccaggctggaatgcagtgacacgatcttggctcactgcaatctctgcctcctggtttcaagtgattctcatgcctcagcctcctgaggagctgggactacaggcatgcatcaccacgcccagctaatttttttgtatttttagtaaagacaggatttcactatgttggcctggctggtctcaaactcctgacctcagataatctgcccaccttggcctccaaagtgctagtattacacgatgagccactgtccccagcctctctctcttttttttttttttttttttttgagacagggtcttactctgtcgcccaggctagagtgcagtggtatgatcttggcttactgcagccatgatctcccaggctcaggccatcccacctcagcctcctgactagctgggaccacaggcatgctccaccatgcccagctaatttgtgtattttttttgtagatacagggtttcactatgttgcccaggctggtgtcaggctcctaggctccagtgatacccccacctcggcatcccaaagtactgggattacaggggtgagccaccacacccagtcacagctttctttttagagttcaccacagtttgagtgattatttggaatttttaagtggcaaaaattacaacaatatatttgtaaatgaaagagaattgtgaaatgtatttgaaattttaactttaagattttctttaaaatacccatattgaatgaagagtatcaaagtaactattgcttaaaaaatggggcttcatttgggttaaaacacaagaatcatgaacatgatcaaaattcttcaaagtgcttgcttggaatgatacagagaggattagcaaatacaaatagtttttttttgtttgtttgttttttttttttttttttttttttttttttttaagagatgcggtctcactatgttgctcaggctggtttcaaactcctgagctaaagcaatcctcctgtcttggcctccccaagtgctaggattacaggcattgagtcaccactgctggccaagatgctgatctttttgttgttgttgttgttgcctaggctggagtgcagtggcctgatctcagctcaccacaacctccgcctcccagattcaagcaattctcctgcctcagcctcctaagtagctgggattacaggcatgcgccaccacgcccggctactttttgtgtatttagtagagaggggtttctccatgttgcccaggttggtcttgaactcctgacctcaggtgatccacctgcctcaggctcccaaagtgctggtattacaggcatgagccaccgcgcccagtgatgctaatcttatgaaagacaaccaacaacaaattctgaatactaaagtgtgcgaaatgtatttaattcttttcatagcacagatgagttaacccacgatgtgttgtcccaggcactatggagtcatcttgaatttcatgttctaaacaaacacccttggcctggaggaatgcacctgcatatcacgacaggacctagtgtctcagatttagtccggcagctttgaatttggaaatcctctttggagcttcttctgacacagcatcttttctctctgggaaggtaggtgacacctgagaacagaggcatggtgtggcatcagagatggaggtaagaattatttttctaccacaatcccaggaaaagactctcctgttcctggtgagggtgagagctctggctgaggatgtcctctttcttctttcttctccagaggatttttcagtctctctgcaaatggctgcttcacagccagggttcatcgaaacccctggatcgtcatggccagtggtttgcgtctctccagcgccactccatacgagggtctttctgcatcctgctctcatggtggacttctgagggccatgctcctcatttgcagggctcacaaatattctgtaaatatccaccagtgttctgataacggggtgacccaggacaaactgaccgtctccagggttcaggtcccaggcatgtctagctccctctttcctttcactgaaaactaatgtcctgtttttttccgtatctatatggacctttctgggttcagtggtgtgggaaaaatagattgttggtgaagactcatcttcatctcctgaactgccatcattgcagtgttcagagtggggatggtgcttggaatcattcccttgaccttgccttcgaccttgcattagttttgactttaaaatgtccttatgaaaattcccccaagtacggaagcccatagtctcatcagagatcccaccttttccctgttcccctccatttttttttcttttttgaaatggagtctcactctgttgcccaggctggagtgcagtggcgtgatctcggctcactgcaacctccacctcccaggttcaagcgattctcctgcctcagcctcccgagtagctgggactacaggtgcccgccaccatgcccggccaattttttttatttttagtagagacggggtttcaccatattggccaggctggtctcgaaattctgatgttgtgatctgtctgccttggcctcccaaagtgttgggattacaggcatgaggcactgcacccagccccttcccctctgtttgtgaactccatcccaggatcatggttgagttcacccagcaggttttcttgcctctccagttcttccagtcgagcccacagttcctcatttgtaagtaagcatccttggacttgagatcattttcaaaacctgaggttttggattttgaatcaggtttatgtgcaatccagggttttctctttaattcagacttgttttgaacatgttttcttaggtcaacaagatctccatccccatcaccccatccctgcagatctgctgtgaatgcaactttagattcaaagtttctcctggcttttgtaaagtcatgtagtgctttcctcacacactccttcctatgctccactaaccccactgcttgctttgcagagcactggcaaaaccagttgtccccgaggagaagagtgattttgctggtatccacaagccttcctggtatagaaggcaagaggcccagttggcaccatgagctcgtaagacagcctattgggcaaggtttggagtcgctcttggagggtattacagtccccctttaccttttgccagtgtgcaatttcatcttggcacctagagatcatcttttcctgttctccttggggcctcataacctgttgaggatgcagctgtttgaaggtggccgaggaggctgcacggtggggcacacggtggggctccatggctcctggttctgcgtgtgcgctgtggtcggcactgctcaggctgctgcccccagtcatggcgactgcagtgcccaacttcctccagctgagtcctcatgagatccttcctgcaatcagtgctcccagctcctcagtcccttcaaaagataaatcattccggagatgggcggtggtgatgtagcatgacaatgtggctactttcaatgctaccgaactgcataccaaaaaatggttaaaatgctgaattttatgttatgtatattttaccacattaaaaaaatattagctgggtacagtggctcacacttgtagtcccagcactttgggaggctgaggcaggaggattgcttttagtccaggcatttgagatcagcctgggcaacacagtgaaacccccatctctacaaaaaaactcacaaaattagctggccaagttgattgtgtgcctgtaatctcagcatctctggaggtggaggtcgggggattgcttgagcccaggagttcaaggcctcagtgtactgtaatcacaccactgcactccagcctgggtggcagagcgagatccagtctccaaaataataatagtaataaataatagtaataataataaataaataagtgataataaataaaaatatccacttgggataattatcacaagaactttgctgtcatggttgtgattttttggaacaaattctcatggttctaactaaaccaaatcaaatacaacattgatttgaacgcccatgctcacagcagccttattcacaaaaaccacaaggtagaagcaacccaaatgtccatcgacagatgaatggatcaacaagatgtggtctctccacacaattcagccttaaaaaggaaggaaattccaacacatgcgacaacatgcaggaactttgaagactttatatatactaagggtacccaccccctacctcactgtattcatatgttgaaatctcaacccccaagctgatggtattagggtatgggattattagattcaaagtttgggacataattaggtcatgagggtggagctcccatgatgggagttgtgaccttataaaagggattccagaggcccctcttaccccttctgccacgtaacaatacaacaggaagtcagaagtctgtgaatgaaagagggccctcaccagaacccaaccatgctagcccttcatcttggacttccagcctccagagccatgaggtatcaatgtctgttgtttataaaccacccagaccatggtactctgttatggcagcccgacctcactaagacactaatcaaaacaaaccggtccacaaaaggacaaacactgtatgattccacttacatgaggtacctagagtagtcaaattcctacagacagagtagaatggtggtttccaggggctgaggggagagggaaatggagagttgtttaatggcatggagttttagttttgccaaataaaaaagttctggattagttggacaacaatgtgaatgtacttcatgcttctgagctgtacacttaaaaacggttgcctgggcatggtggctcatgcctgtaatcctagcacattgggaggccagggcagaggactgcttgagccgaggagttcaagaccagcctgggcaacatagcaagactctgtctctacaaaacatttttaaaaaaattcaccaggtgtggtggtgcacacctgtagtcccagctacttgggagtctcaggtgggaggactgcttgagtctggatgttcgaggctgcagtgagctgtgatcacaccactgcactccagcctgggcaacacatagtgaagccgtatctttaaaaaaaacaatggtgagactgggtgcgttggctcacacctataatcccagcaccatgggaggctgaggtgggtggattgtttgagcccaggagtttgagaccagcctgggcaatgtagcaagaccctgtctccacaaaaagttagctgggcatgatggtgcatgtctgtggtcccagctacttgggaggctgaggtgaaaggattacttgagcctaaaagattgaggctgcagtgagctgtgattatgccactatactccagcctaggtggcagagtgagaccttgtctcaaaaaaaaaaaaaaatggataaggtggtaagttttatgttatgtgtattttatgttttttttattttttaaagaaacagggtcttgctatgttgcccaggctagagtgcaatggctattcacatgtgtgatcagagtgtactacagcttccaactcctcagctggagttgaggtgattctgcctcagcctcccgagtagctgagaccacaggtgtgcacagctttgcctggctccattttactacactacagtgtctctctttttacatggttgttgcagtaaaagaaaattcagtgtatatagaaacatcacaagcaattgttttaagattatatgtaaagtggaaataagttgtagactcatatagttgtcaataggttttctaacataagaactttgggtggggcacttgagaactgattcagatggaagatggctctaggctggtggaacagtgttgagaattcctgaatgtgtagtattcctagacctctgtccaccaaattaaagcaggtcccccatcaccatgatcctacagggggcatcccccttagtaacccatggaatctggcccggcctctttctctagcctaaattgagacattctcctccttgtttctctaggcctcagccacactggccttcttctatttccaaacacacaccaagctctctcctgaaacacagccttcccacacaccgcatctctgcctagttcatacactgccggcaaattgtgtattggggctgggcccttcccactgttcagctgtcatcctatttttttcctttgtcaggggtcctttgaaaactacgtattccagaccaggtgcctggacattctctcttatgacacttattaaaacatgttgttggctgggtgcggtggctcacgcctgtaatcccagcactttgggaggccgaggcaggtggattgcctgagctcaggagtttgagaccagctgggcaacatggtgaaaccccgtctctattaaaatataaaaaatcagccgggcatggcagtgtgtgcctgtagtcccagctactcgggaggctgaggcaggagaattgcttgaacctgggaggcggaggttgcagtgagctgagattgcaccactgcactgaagcctgggagactctgtctccaaaaaaaacaacaacaaaaccaaacaaaaccaaaacaaaagaataaaaaaaaatgttgttgtcattattttcccgctagactcccacaagattccccactagactctaagcttcatgggaggaggggctatgcacattcacagtgtctgctcttaccagagagtctcacagagcagccctaacaggttagaccaaagaacaggtcatataaaaacccaagttccaatttctcctgagatgtttttctcctaaaaaccaagttaagaactctaggcctctactgggaagctgcctccccattcagacagggtctccccattaccacaatcccttctagtcctctcttctacttgcctccctaggtgatcattgcaggcatctgagtttgtaaacccgagtttacaaaaggggattagagaaatgcccacatcaaatgatctcattcacccatttctcagattctaggtcctgatggttggcacatgttgcaatgagttggatggggggagtccagccaggacctcagggtagccacagacttcttcaatttccaccctctaaggtttggtcctcagattggaattatgtttcctcaattctctgcagacaggaagtgttgagatctgactcttagtagtaatttaaatgagagaaagagaggaggagggaggtatttttatatcctatttgtatctaaataccagaaaaggtagggagtgggggcttacacctgtaatcccgacactttgggaggccaagacgggagaatctcttgagcccaagagtttgagaatagcttgggcaacgtggcatgaccctatctctacaaaaaatacaaaaattagttggacatggtggcatgtggctgtagtcccagctatttgggaggctgacatgggaggattgttttagcctaggaggtcaaggctgcagttaactgtgattgtaccactgcactccagcctgggcgacagagcaagactgtctcaaaacaaacaaacaaataaacaaacaaacagaaaaacaaacaacccgggaaaatggtactttgggaacaaggaccttggtcaacccaattccttattgaaggaaataacgtatacagtggtccatttcttttttttttttttttgagacggagtctttctctgtcgccaggcttgagtgctgtggcgtgatctcggctcactgcaaccaccgactccctggttcaagcgattctcctgcctcagcctcccaagtagctgggattacaggcatgcaccaccatgcccagaacatttttgtatttttagtagagatggggtttcacaatgctggccaggatggtctcaaactcctgacctcgtgattcacctgcctcgacctcccaaagtgcgtgctgggattacaggtgtgagccactgcacccagcctacagtggtccgtttctaagacaaaatgctttgaattggcttaggtcagcaacctacagaagaaacatgatacactaggtccctgcttggatagccagccaatgcctgcttgtcagcctcccccttccccaccttcgccccttagttgccttcacctgaaccaaagtagtttagtctaagatgaaagtttactagcctgcaaaatagcttgttttgtctgttcttagcctgcccagctacttaggtcataagtctaacacttgaagagcccctaagctaactaagattacaatgcattgtgggctgcaacaaaatgcagcaaaacgaccctaaaataaacaaaaaacaaaaaactcctggcgctcccacccaacaatcaacaggcgagaagtttatgaccccgtagtactcagcctatgaggaactgggggagggacctgtgcactaggggataaactgcttgttgaaagtgtgctgggtgtgcctgtcagacacctgatcttgcaagactgtcattaaaagtctcactttcactgttctccgggtctccgagtccattctttgggttgggatgggcgagactgtttctcacattatgaaaagctgaaggttaagtgaacttggggaatactgcctcctgctggctggatgtcatggaagcctggcccatcagcagagaatgataagctggagttctggagggtctgatttccaaggaatcacccccttggaagctcctctaatacaccctgatgagattaacctgattaggtccattgtttgataaaaagaggaggaagtttaatcacttccacattctttgcccacgactaaccctgattggatttggggctatggttcaaatgtatgaccgattgatttttttcacttcttctgttggacttttgaaaaaaagttctctgaaaaggaatttagaggaaagagacttattccagtgaacagttacagtttgcaaacccaacagacacaacttttggtacaaaaggaagttacattccagagaacaaggggaggctttgtcttttctagagaaaattcccgctcagaatcccactcaggtctgcttatgcaaatgaaagattcaaactttttagttctgattacttggctctagctgggttctgattagtcaaagcaggtcacagtctactggtggcgtaaacaggaacaggcagctatgtaagtcccaaagtttttccagaaactcaaagtatgtgtgtgacctctggtcagcaaataaccacttgtctcaaatttaaattcaggcccaggattcatcttgaggaattggctctttcagggttcagagaccaatcaaaatgtctatcagaatggatgtgttaaaaggcaaataatgggcagggcatggtggctcaagcctgtaatcccagtactttgggaggccgaggcaggtggatcacctgagctcaggagttcgagaccagcctcgccaacgtgatgaaaccccgtctctactaaaaatacaaaaaaaattagctgggcgtggtggtgtgcgcctgtaatcccagctacttgggaagctgaggcagaagaatctcttgaaccctgggggcggaggttgcagtgagccaagatcatgccactgcactccagcctgggtgataagagcaagactctgtctaaaaaaaaaaaaaacagcaaataacgttgtcctgtgccatgagccacatactcaaatatttacacaggtccaggggaagtaaagagtaaatatggccaccaggcgcggtggctcacgcctgtaatcccagcactttggcggctgaggcgggtggatcacgaggtcaggagatcgagaccatcctggctaacacggtgaaaccccgtctctactaaaaaatacaaaaaaattagccaggcgtggtggcgggcacctgtagtcccagctacttgggaagctgaggcaggagaatggtgtgaacccgggaggcggagcttgcagtgagccgagataatgccactgcactctagcctgggcgacagggtgagactgtctcaaaaaaaaaaaaaaaagagtaaatatggcctgatgtgaaaaaaaattataaccaccagaatttcctaaaatgtattttattgatctatagtgttattgcacaacatccacaaatatctatgatgacaattgtttaaaattcaagttaaaatacaaaatttaaaaaagtttacctacttttacgttgttaatttatgactctttgggtttgaaatgagatttgatgtcattgtatttatagatattccttgacttcttgtgttatgtaccaataagcacattgttaagttgaaaacatcataaataaaaaatgtgtagctgggccaggagctatggctcatgcctataatcccaacactttgggatgccgaggcaggaggatcacttgagctcaagagttcaagaccagcctgggcgacaaagcaagacccccatctccacaaaaaattaaaaaattagccagttgtggtgctgcatgcctggggtcccagctacttgggaggctgaggcaggaggatcatttgaacccaggatgtcgaggctgaagtgagctatgacggtgtcactatgctccagtctgggtaacataatgagaccttatttttaaaagaacacacaatgagtagctgagtagggctgcggctcactgccactgccagtgtttgaagaacagttcccactgaatgcatctcaattttgcactgtaatcaagtagaaaaactgtaagtccaatcattgtaagtctgggaccatcttgtccatagtcttatgacagaatactgtttaaaagtgtagatctatccgaatgttgatgaatttattgtgaaatgcttccccttgtgttgcttctatgtgatctatgtgcagcagtggacattttttttttaagtgaaaaacaaatcatgcccctcccttcattctctcccccgtgatgtttcccttagagaacattcctcccttcccttcccagtccccacctcagagatggggcaactcctccctttttatcacacttcttccactctgaggctctaggcaatcagttctcggtcactcccacccatgtgaaggtttttttttttttttttttttttgagttggagtctcgctctgtcgcctaggctggagtgcagtggtgcaatctcggctcactgcaagctccgcctcccgggttcacgccattctcctgcctcagcctcccgagtagctaggactacaggcacctgccaccacgcctggctaatttttttgtatttttagtagagatggggtttcaccatgttagccaggatggtctcgatctcctgacctcgtgatccgcctgccttggcctcccaaagtgctgggattataggcgtgagccatcgcgcctggccccgtatgaaggtttttgatgatgcttgctagaatggacccagataattttcgtgtggacagaaggtagatttttagtagctcttgttagaggtcatgtaggagattgtctcagcttgagctgctattgcaaataccgatactgtagactgggtggcttgaaaacaccagaaatgcattcctcagagttgtggaggctggatgtccaagataggacaggtctgagatcagggtgccagcatgcttcagttctggtaggaatcctcttccaggctacagactgccaacttctcgtgtcttcgtgtggcagaaaaagggctaaaaagatctctgggattttttttttttttttttgagacagagtctcactctgttgcccaggctggagtgtagtggtgtgagtggcatgatcttggtatactgcagtctccacctcccgggttcaggcaattttcgtgtctcagcctcccgagtagctgggactataggcgtgtgtgaccatgcccgactaattttggtatttttagtagagactgggtttcaccatgtttgccaggctggtcttgaactcttggcctgaagtcatgtgtctgccttggcctcccaaagtgctggggttgcaggcacgagccaccgtgcccagcagggcctcttttgtaaaggcactaatcccattcgtgaggttctgccctcatgacctaattacctcctacaggtcccatgtctgagcaccatcacactggcatttaggatttcagcttatgaattttgggaggacacaaacattcagttcataacagcattgtgttgtcacccacttttttttttttggtaggaacagtgtgtcgaactctggtctcaagtgatcctgctgcgtcagcctcccaaagctttgggattacaggcacgcactgccaaggccagccacatccatattcttaatctccaccatggcctcatgagcctggtcccctgtcagtgggctagggcctcgacatgggtaatacgcatattagctgaggttcaggaacccaactgacttgtgtaagaatttccagctggccccgcagaacaagaggctaaagagtggggagcagtgctagtgttgccactgctacagctctcgggcagtattcactaccctcatcctgtatgtgtgcccaggtgctgggtgagcatttcactccacacgagaggcatcatgcattccttcattcgttcgttcatgccgttatactatagtgaacaataaactcttgaggaatgtcgggtttaggggagccagtcccctgttcagttgaaaatctgcctggctatgtataaattttgactcccccaaaacttaactactaatagcctgctgttgactcgaagccttactgatgatatcaacagtcaattaacacatactttgaattttatacgtattatgtactgtatgcatttttttttctttgagatggagtctcactttgtggccctggttggagtgcagtggcaccatctctgctcactgcaacctcccagatttaagtgattctcctgcctcagcctcccaagtagctgggattacaggcatgtgccaccaagcctggttaatttttgtatttttagtagagatggggtttcaccatgttggccaggctagtctcaaactcctgacctcaagtgatccacctgcttcggcctcccaaagtgctgggattacaggcgtgagccactgcacccttcctgtactgtattcttataataaagtaagctagagaaaagaaaacgttattaagataatcttaaggaagataaaatctatttactattcattaggtagaaacagatggattatcctacaggaggaggaggaagaggagggggttggttttacagtctcaggggcgaaagaggcataagaaaatctgcaaataagtggacccacgaagttcaaattcctgttgttcacagttagtggtacacaggagacactaggtaagctaaaggttgggctgggcatggtggctcacacctgtaatctcagcactgtgggaggtcaaggcgggaggatcgcttgaggccaggagtttgagaccagcctggccaacatggtgaaatgctgtctctactaaaaatacaaaaagtagctgggcattgtggcatgtgcctgtaatcccagctacttgggaggctgaggcacaagaatcacttgaacctggaaggcagaggttgcagtgagccaaaatagtgccacttcactccagcctgggtgacagagtgagactgtctcaaaaaaaaacaaacaaaccaaaaagattagctaaaggttgaactttcagtgatgaactaaacagaaacaatctcatagagattgtggacaggagaagaaacaagcacaggtgcagttaaaacccgtgataaatgccccggcagaaacaagtgttaggccaggcgtgatggctcatgtctgtaatcccaacactgtgggaggccaagacaggaggactgcttgaggccgggggtttcaagcctgcagtgagctatgattacaccactgctctcctgcctgggcggtagagaccctgcttaaggaaaaaaaaaagaaaggctgggcgccgtggctcacgcctgtaatcccagcactttgggaggccgaggtgggcggattacgaggtcaggagatcgagacgatcctggctaacacagtgaaaccccgtctctactaaaaatacaaaaaaaattagcagggcgcggtggcaggcgcctgtagtcccagctactcgggaggctgaagcaggagaatggcgtgaacttgggaggtggagcttgcagtgagctgagattgcgccactgcactccagcctcggcgacagagcaagactctgtctcaaaaaacgaacaaacaaaaaaacaaaacaaaacaaaacaaaaacctaaaccaaaaccaaaacgcagcatagtccatgagagaggaagagcagggcaggcctactcacctggggctgtcggggaggctgcccaggaagggactctgaagtgagcacctggaggaaggaggttagttctgagggactggaattcatcctggcattgggatcacgggcaaaggtcctgtggtgacaaggagactggtgcgagcctggcttagcaccatgtgagagcagaggggtggaaaggcactaggtaagcatgccttcggatgtgaaatgagggagacggggactgggggaccctgacatgagggaggaggaaaggagatgggaagaatgggtgaccagagggaccactagaccaccgagggtgagagcttgctaatatcagagccatgtgtaggagaatgaagtgcaatcttggatagacctccagtgcaggtggtccagccatcaatgaccataaccacatgcatgattgtaggtggaaccagaagaaccacccaggcaactcacagaactggggaactaatcaagtcttgttttaaatgactacattacgggtggtttgccacgtagcagtggatcgctgaaacagtttaaaatatctattcagccgggcgtgcggtgggtagctcacacctgtaatcccagcattttaggaagctgaggcaggaggatctctcgaacgcaggaatttgagaccagccttgagcaaaatggcaagaccctgtctccacaaaaagtaaaaaaaattagctgggtgtggtagcatgtgcttgtagtcccagctacttgggaggctgggacaggagaattgtttgagcccaggagttcggaggctgcagtgagctgtgactgcaccgctacactccagcctggacaacagagtgaaaccttgtctctaaaaaaaaaaaaaaaatctacaaaccaggcaggagcactgaatagctcctgtctcccctgagacccttgtagaccttgaggtctgttacagagctcaccaaccttctcttggtctagaattatctaaaaagagttgagtgcagccagaaaggactgaatacatggtgttcttcaatcccatcaaactgctgtgccctgcagatgatccctgagtccaggtgttggtgggttgaggacaaggctgagggaacagaggtgggaacagtggcccaggaccaggagaatgcagagttcagagtgcatgacctgcatctaactctagatgctccaggggtctgagaccatctccagcagggtctggaaggcccagtcattccccagcacgcacagtcaccactggatactatcttgctctgtgagtgatgcaaaggtcctgggtcagtgaagcctgtgaaacaaagttgggaccagagtgtctctacggttgagggctgggcttatttgctctctaagtataattgtaagagcaaatagaaacacctatcctctctgagcttaaaaggatcaaaaagctctgacagtgtcagtggtagggctagttcaggggctgcagtagtgctggtgcccacaggtggaaccttctcctgccctgattcccaaggactggtgctctcggaggggtctgggaggtatatttctctttcacaaatacgtgcacaacacatgaatgagctactggatgagggaataaatgaatgaatgagtgaaaaaagcttcctttctcctctccaggagttagcaatcactggttagttccccactgcccaccagcctgtgcagaggagggaggagcaacaggtcatagatgtggttgcagctgttactggacagagtggtcaagacatcctgtgtctgcagaggccctccccagccctcacctggacagtggagctgttggccagagaggcagtgggaagaagggtggggctcccagagtcgacccagcgggctgaaactggtgcagtctgcgcctcaccaggcagagaatggatgtggggcagcttgacaccgagcaggggctcatctgagcctcaggggtggttgctctatcaaagtgtttgcaagtaaacagtcccagtgcacacccagctgctcagtgccacctcgtgcacccagggccacttcagccttgatcacaggcctgcacaggttccaggggaggagacactccagctttttgagggagggtgagcatgtgggatcagagactttaagtccaaatttccccttaatttttttttaaatcttgcaggtagtatgcaaacatacatttaatgtattatttttattctcatttatttttttgaggcagggtctccctctgttggccaggctggagggcagtggcgagatcttggcttgctgcagcctcaactcaacctcccaagctcaagtgattttcccacctcagcctcccaagtagttgggactgcaggtgcctgtccgccatgaccagctaatttttaaattttttttgtagagatggggttttgccatgttgctcaggctagactcgaactcctgagctcaagtgatcctcccaccttggcctcccaaagtgctgggattataggtgtgagacactgcatccggctcccaaatttcccctttttataaggacaccagttgtactgaccggggccccacctctatgacctcatctaaccttcattaactccttaaaggccctatctccaaatacaggcacactgggggttagggcttcaacctatggatttgggggatgcaattcagtctatcacagtgccaagctgcacctgctcggtgagccagaacaggggtggggaaggcaccaggccctggtgcttctttcccatgcctgagtcactctacttggttctaggagggagaggagcatgggctgaaggcagtgctgcaacatggaaggggcagaacatcccaacccgctctgggcccccagtgtcttctgctgtacaaagcaggtgttttcaccccccgaggatgtgtcctcccttcctggctcaccaagcatttaaatgtagacagaaaatttatttatctggggtgcggtttcctcagggggaagttgaggtcacgacccctgaggtaccttaacccaaaggcctccagggcactggccccagagtctccagcaggtgcttcctccctgaatgcttccatatggcaagatcagagccacaaatgctgccccgacactgttccggtaaccgacgttgcagacccaagaaagtctgggatggtagtggccaggaacggggtgtgccacggccccacctctcagagcagggaggaggatgctgggccagcccttggggaccccaggcaccgtggccacaggagtcagagctctgcatgtctgcaccatgtcctgggctcctgtcctgctcatgctgtttgtctactgcacaggtgagggaacccccagatcccaaagactcctgccccttccttcatcctgccctgcccccacggcccacatgcatctgtgtcaccaggttgtggtcctcagccggtgctgcatcagccgccggccatgtcctcggcccttggaaccacaatccgcctcacctgcaccctgaggaacgaccatgacatcggtgtgtacagcgtctactggtaccagcagaggccgggccaccctcccaggttcctgctgagatatttctcacaatcagacaagagccagggcccccaggtcccccctcgcttctctggatccaaagatgtggccaggaacagggggtatttgagcatctctgagctgcagcctgaggacgaggctatgtattactgtgctatgggggcccgcagctcggagaaggaggagagggagagggagtgggaggaagaaatggaacccactgcagccaggacacgtgtcccttgaactgaagacagcagaggcacgcatccccttggagagactgtcatggaagagggtggagccgccgcccgaagcgccgaggaggctgagccactcagcatctcctggtcctgcagtgttgctgtaaatccccattggagactgcattagggaattaaagctgcttgtcactttttgctgagtttggtctgactgttgtgcgacttcgtagtaccagccttgggcaaaggcccggggccccgggagactggcagatcactgtggtgagcactcacctgagtccttacttttgtgggccatgggaggcaaggggttgaccgaagcaccctggaggggcatccatgcccaggacaggaccctctggtgtcatctgattctgcccagcggttacagggcaaacaagcttagaaagcacctggtctgggcctccagggagaacaggagccaggtaataggcctagagtgggttctccaccttggtcctatcgacgttttgggctggacagttcttggttgtggggctgtcctgcggattgttgaatggtgagtggttatctgtggcctctacccaccagatgccccttcccagttgtgacaaacaaaaatgtctccagacattgccaaatgtccccaggtggtaaactcacactgattgtgaaccactggtctagatgagcaagtaaatgcatttacttatttgtacaagagagtggcaggtgtcggcaaacatgttctttttttcctttttttagggataaagtcttgctctgtggtccaggctggagtgcagtggtgcaatcatagctcaccgcagcttcaaactcccaggctcaagtgattgtcctgtctcagcctcctgagcagctgagactacaggcgtgcatcaccatgcttggctatttatttagttttatttttggagagatgaatgtctcactatgttgctcaagctgatctcaaactcctgagctcgagtgatccccctgcttgggcctcctaaagtgctgggattagaggcgtgagccactgcacccagcccattttctataaagagccaggtggtaaatatttttggctttgtgggctatgcgatctctgtcacaactgttcaattctgtcctagtagcaagaaagcagccacagacaaacatgtcaacaaagaggcgtggctgtgttcttataaagctgtatttacagaaacagatggggctacactgggctgggtatggcgcccaggctgtagtttgctgagccctgctcgggagcactccagctcctgtctccaggttttaagcaagccatgcttggtgggataatcagagtcccccctcaacttatcttgcctgtgaccccaggcagaagcctctggacccatggagatacctagaggcatgaaggacgtggtctcactgagactgtgttggactgtctgggtgaagtagcaatggggagctccctgcagccccggcccacagcaaggccccctgagcccgtgggtggtgggtctgagtgtgccttgcagagagggactctctacactgggtgtccacacaacctgtagacatgcctcactcagagaggtgccgggcaaaccatctcccttgtaaccccaacttgcctgggaacgtgcattcaccccagctaaaaagatcctgaggcatctccccagagaggtggacacatgtcagtatcagcgttccatgtgtggtcatgagtccctctcttgttaaacagtggtctccagcactttgggaggccgaggcgggtggatcacctgaggtcaggagttagagaccagcctacccaacatggtgaaatctcatctctactaaaaatacaaaaattagctgggtgtgttggcacatgcccgtaatcccagctacttgggaggctgaggcaggagaattgcttgaacccaggaggcagaggttgcagtgagccgagatcatgccactgcactccagcctgggtgacagagcgagactccatctcacaaaaaaaaaaaaaaaaaaaaaagagacagtgatctcagcttatgccatactctatgcactgggttcttcctgcgtcaggcttttacccctgggccaggcccacattttaaaacattattatttacttgtttattattttattttagagataggatcttgctatgctgcccaggctggactgctgtggctattcacaggttcaattcatgatgctctacagccttgaactcctgggctccagcgatcctcctgtctcagcctgctgagtggctgaactacacgtgtgagtcactgcacctggccatggcccacagttttaaagaccagctagatggttccagaggaactctgtcttctgcttgtaacccgtccctctcttgcctccatccttcatgattctgggattccatgctatgagaagagatctagaaagccgggagctgagttggactcctgtatcatcctcatgcccccaccccaccagctcaatggaaaatgagacctggaactcaggcttgaggccagactgagtgtgagtcttagctctggaggagtcacttaaaatctaagccaacatttccaatgttgcatgtaaaggggataatcatagaactgattaacttatataaaaagtttttatctggccaggcgtggtggctcatgcctgtaatcccagcactttgggaggccgaggcgggcagatcacctaaggtcaggagtttgaggccatcctgggcaacatggtgaaaccccgtctctaccaaaaatacaaaaattagctgggcatggtggcgggtgcctctgatcccagctacttgggaggctaaggcagaagaattgcttgaacctgggaggcggaggttgtagtgaaccgaaatcgcaccacatcactccagcctgggtgacagagcaagactgtctctcaaaaacaaacaaacaaacaaacaaaaaggttttatccatcatgagtgctcaacaaaataatagtatcatgatttccccatcagtcacctgcctggccttccctgttgtcaaatcctttcctttagtctgagtcatttctcaccttgaccattatctggtctccttcccatccatcctcctgctgcatgcagtctatacccaccactcctcatctttgttgctcctagatccagccttgcatgcattcctcctctctaaccctttattgtctcccacactctaaagaacatatgcaagccacatctgtaatttccaattttctagtggctacattatttttaaacagtaaaaacaaatagatgaaatgattttttaatgatatattctatttaacataataaatccccaatattaccaattcaacctataatcaatataaaaattagttactagatagtttaaacttgtttttcttttgtattcacacttcaaaatctggtatgtattttatattcatgtcttggataatttgctcaagtggataatctggtcagccaagtggtcaagagctacatatgccttgtgaagagaccactttggttgaggggatgcaattcagcctccttcccatgacacagcctttgaaggctggctcaggcttggtcccaagtcccatttcttgtgcaccctctctccctgtttctgccatgttaagccaactgcaactgatcaaacacccgagtctcttggttgcttctaaacctttgcccaagctgtttactgccaggacttcctgtccctttgttgtggcctccatctggctgcactgactcggggctccacaactgtctcaaatctcactccttgggcaagacttccccgagctcttcatgcagttattaacttcctccactgtgcaaacagcatgttttcctaactatatttagcttctactgcacagttataaatttatttagcaaagctccctcccctactaatctgcagattctcagtgggcaggatctactcaacccattgatgtgcctgataaacacttggcaattagacagttgaatgaacaaatgaatgaatgtgtaactgaatgaattttcgggttccaaggaccctgacattctgggatcccattaggtggctggggtcaccaccttagagaattgtgattccctaagaagggagaaccagcccagaccttctcgatcatattagtgactggccacatttcctctcctttctgattctctctctcccccacacccttactgcatgacagtgatgagaaaatccacttgatcaaccaaactacaactttcggcctcatccctatccctcccttgccttctgaccagggccacagtcaccctgtgggttcttccttttgagtgtctctcactcccttcctcctccatatctctgagaccagcctccagccctgctggcctgctctgctgccttctggctctttgttgaacccaagaccagggtttatatatgttaaatataaatatatttttccatatgaaatgtaaacatattttaaacattaaatataaatatacatcttagatatggcctgtgttggaatgtgtaatagattgagtatataatgtctattcaatataaaatttatatttatatatgcagtaatgattcaggttgattgtagttaagaaaaacaagctccaaattcgagagaaatatgtaagaagagagacaggaagaaaaaataatgaggcaggtaaatgcaacagacaattcgagacccacaagtgcagagcaggcttcccagacccggataatgtctcctgggctgataggaagccctcaaccccccaagtccttctcagccataaaccgcctgagcacagagccacagggaccgtgttggggctgggcctctcgactttagttcctctcattctgtgcaaaaggaaaaacaattcagaatctacagaggtttagatgtgtgtagatgtggacagagaagtcctggcacggtggttcactgcccaagaagacagtgagtccctggagggatagaagaatatacatcatgctaatatatgtcatcccagtactttgggaggccgaggcgggtggatcacttgaggtcaagagttcgagaccagcctggccaacatggtgaatccccgtctctactaaaaatacagaaattagttggctgtgggggtcgatgcctgtgatcccagatactcgggagacagaggcaggacgaactgcttgaacctgggaggaggaggttgcagtgagctgagatcatgccattgtactccagcctgggggacagagcaagatcccatctcaaagaaaaaagaaaaagaagttgtgagtgctaagttctctctggattttcaggaggccagttctccagtccacagtggcctgggaggacaggggttcctgagggtgaacagagcctgtgcccggtcaggtaggatcgcatgtccctgaggttcagaacccaggagcatggggagggtccagggggttcctgctgcatggagggaagaccctctttccacaggggccccggagagcgagaggaaggaggagggcaggtcagtgagtgtgacggggtcacagtggagagggaagcagaaagaagtgtccccacaacaagacacacacagtgtctacgctgaagctacagagagggcctctccacctgtgtctgccgcaaagcagtggggcgtcttctggcagcccagagtcacctccagatcccacctgcaccatgcttcctgcagggactgcctgtcttcctaatacactgtcttctgaccagagtcttccagacaaatcactggttgctatatatatatatatatatatttttaatagctaatatcttacactgatatatttatattatatataaatatttttgtactttatgtttaggctatattacagatgtagttagttagctatttatgttatatataatataaacatgatgtagattcttatatttctctggggactcactgtcttcttaatacactgtcttctgaccaaattcttccagacaaatcagctgttgctatatatatatatatatgtgctatatatatatgtgctatatatatatgtgctatatattttattgcatagaatatattatatattaattatataatatacattatacattacatattatatataatatattatattattatgctatatcttatatattatatatgttatatatgtatatatattatatatacacatacatacactcatgtatattttaatagctaatatcttacactggtatatttatattacatatgtttatatacaaatatttttgtactttatgtttatgctatatatacagatgtaattagttgtttatgttatatgtaatataaacatgatgtatattcttattttcctgtgaggacccactgtcttcttaatacactgtcttctgaccaatgtcttccacacaaatcagctgttactatatatatatataatatttatatacacatatacacatacatacacacatatgtatattttaatagctaatatcttacactgatatatttatattacatatagttatatactaatatttttgtactttatgtttatactatatatacagatgtcgttaggtatttatgttatatataatatattaacatgatgtatattcttatattcttctggggactcactgtcttcttaatacactgtcttctgaccagaatattccagacaaatcactggttgctatatatatatttttaatagctaatatcttacactgatgtatttatattacatatagttatatacaaatatttttgtacttttgtttatactatatatacagatgtagttagctatttatgttatatataatatatcaacatgatgtatattcttatattcctctggggactcacagtcttcttaatacactgtcttctgaccaaactcttccagacaaatcagctgttgcaatatatatatatatatatatatttattttttaatagctagtatcttacactgtggctcatgcctgtaatcccagcactttgggagaccaaggcaggtggatcacctgaggtcaggagtttgagaccatcctggctaacacagtgaaactgcatctctactaaaaatacaaaaattgattgggtgtggtggtgcatgcctgtaatcccagctactcgggaggctgaggcaggagaatcgcttgaacccaggaggcagacgttgcagtgagccaagatcgtgtcgctgcactccagcctgggcaacagagtgagactccatctcacacacacaaaacatcttacactgatgtatttacattacgtgtagctgtatataaatatttttgtacttacattctgtgtacttatattctatatattataaaacattatataaaattatacatgtataataaaatgttacataaaaattttaatataataccattttactacatatatttctaaatttaatataatgaaattttatatataataatgtataacatttctaaacttattataatacaatgatatataattattttctcatattataattatacataaggtaatttattgtaaataaaattttatataatctacgtttattataataaaattttattacatataacacatttctaaatttaatacaataaaatactatgtataataatttataacatttcaaaatttattatataattttattatacaattattttatacataattatatatagtatataattgtatttatagaaatataattatgcatatacaatatgtaattttatttttacatagtatatatacataattatgtattaacaaatataataatatcaatttatatacttatttacattaagttatatattatataaatgatgttatatgttatatgttacatatatttttgcttaatatattaaatttaatctataaaattatgtattacaaataaaagtgtattttacatatacactacatataactttatttatataaaaatataaaagtcatatggttaagttaataaaatatatttatatcaatctattcatataaaatatacacaatgcatatttatataaatacaaagtatataaaacttttaccagtaggatgcaaagagttgctgaccgtctgcagaaatcctgaacctctggaagcagaataaaatcttacctcccagtctgctttgaaaggaacagtaaagcagtcccgaaccccaaacccatcctaaggggagatgggggagttgggatggacgcgttgaccagtgaggactttcctttgctggttttgaggtgtcttagcccagaagctaagacgggaagtgattctggagcaggtgagctgatcacaagcctgagccaagaatccatggagctcataaatagcagaagccgggaccctgtgcaaatccttctgaaatatcccccgtttactgggctcctaggggtggggaagaaaaattccctgacatttcggcctcagggaaagagagagagaccccactggccggaagcctctgctatttttcagaagacagctggggcatcactctttcccaaatgacggtgattttcagagtggttcactttttggagagacatttctgccctggagatccatacatattgaacccaaacgaatattttttaattaaaaaaaattaaacattagaaagttcaatattgaggcagctacgagtttgaattcctcatttttcctagatgcatgttgtcaaaatctgtattgcatttagtaactacttatgtgtctaatgtatataaggttacacaatgtttttttctgctcctcagggtcagaatttgaaataaaagttttggaaagaaaaaacactcttgtctgtttgtgcaaaaataaaagaacccatattttaagaatattttaaaataaatacaaattttgtgtgggagggttgcttataagaattcttcatatcctaaatcaaagacagatcttgttattaaccagaaaacaaaatgtgtgtgtataaatgtacaacactcttacactcacacaaacacaggcacacacacacattcacgcactcactgatgtactcacacaaacacaggcattcatgtataaatacacacataagcgtgtatttatagaaatataattacacacatacaatatataattttatttttacatagtatatacacatcattatgtattaacaaatataataagatcaattttattatatacttatttacataaagttatatattatataaatgatgttatatggcatgtatatatcacatataactttgcttagtatataaaatttaatctataaaattatgtattacaaataaaagtatattttacatataaactatatataactttatttatatgaactataaaaatcatatgtttataataaaatatatttatttatatcaatatattaatataaagtatacacaatgtatatttatacaaaaatttttaattaaaaaatattcatttgggttcaatatgtatggatcgccagggcagaaacgtctcttcaaaaggtgagccgttctcaaaatcaccgtcacttgggaaagagtgatgccccacctgttttctgagaaacagcagaggccagtggggtgtctctctctttctctgaggccgaaatgtcagggaatttttcttccccaccactaggagctctgtaaaccggggatatttcagaaggatttgcacagggtcccggcttctgttgtaaatgagctccatggattctcggctcaggcttgtgatcagctcacctgctccagaatcactgacacaaatgcaaccacacacttacacaaacacacatcaacaccaagacagacagaagcacaaaacacactcatagaaacacatggacacacaaagacatgcacactcacacaaacgcagggacacacacacaaacacaattacaaaaatgtggggtttttttgcacacgtgggtgcacatgcacattgacatgctcacaaagcacacaaacacgtatacatacaaagacactcataaacagaatcatgaaaacactctcatataaacacgtggatggctactcacccacatagacactcacatatgtcacacgcactcatacacacactcagaatcacacaagcacacacaaacacacaaatacagtcacacactcatgcaaacacagtcacaaaaagactcacataatcatgtggacacacaaacataaaaattcacacactggggccgggcaaggtggctcacgcctgtactcccagaactttgggaggccgaggcgggcagataacttgaggtcgggagttccagaccagcctggccaacatggtgaaaccccgtctctactcaaaaatacaaaaattagccagatgtggtggcgtatacctgtaatcccagctactcaggaggctgaggcaggagaatcatttgaacccgggaggcagaggttgcagtgagccaagatcacgccactgcactccagcctgggcgacagagcgagactccgtatcaaaaaagaaaaattagccagatgtggtggtgggtgcctgtaatcccagttactcaggaggctgaggcagaagaatcttttgaacctgggaggcggaggttgctttgagctgagattgtgcctttgcactccagtatgggtgacagagcgagactccatctcaaaaaaacaaaaaaaaagaatttatacattgccatacagattcacagacatacactcatattcacaaacacacaaatacgataaacgcaggggcacacacaaacaccatcacaaaaacacacttccataaaacacaggaatgcacgctcacacagaaacacgcatggaaacacacgttatcttacagattcacagacacactcatcatcacataaacaggcacacacacacagccacacaagcacacacccacacccacatcaacacacacactcccacacggcacccacgcgctcacgcacataggtagaacaggcctgcattacctgataacgcagttagatcagacgtgatgctgcctgccgaggagacctggaggcttcccatgaatgggctttcggatgagaggtctctgggtgcatttggtgacaccccaggcagtgggggagacgtccaggctggaaggccagccacagccagctctgcccaaggatgccacgtccatttgcttcagtaggatatgcaccctggaaacccaggttcctgcctctccaggaaaccccactgaggtcagcacatcccccaaggtttagaaggggtctctgggtgcatttggtgacaccccaggcagtgggggggacatccagcctggaaggccagccacagccagctctgcccatggatgccacgtccagttgcttcagtaggatctgcatcctgtaaaccctggttcctgcctctccaggacacgccattaaggtaagcacactccccaggtttagaaggggtctctcggtgaaatgtggtgacaccccaggcagaaggggggacgccacagccagttctgcccacggatgtcacgtccatttgcttcagtaggatctgcaccttggaaacccaggttcctgcctctccaggacaccccactgacgttaacacaccctccaggtttacaagcggtctctgggtacatttggtgacaccgcaggcagaggggggacgccacagccagctctgcccgcggatgccgcgtccatttgcttcagtaggatctgcaccctgtaaaccctggttcctccctctctaggacaccccactgaggtcagcagcccccaccccccacccccaggtttgtccagcttcgctgtctggggagagacacagaaagaccacattcggtggaattctggctataaccttttgtagccggcaagaaggatcaccaagctgtcccgttaccttgctggagcgatcactggtttcacgcttggcccccgtgcagttagtgcctgggccaggctcgattcctggagctcaggtgaaatttgggcttggagctcacgcctgcaccatccagaaagcagaaggcagccggcccgggctgtacggttcgtagaatcagagagaacactgcttgccttcatgtctgtaccacaataaatctgccaactgcggtcaaagtctctggattcctgccccctcattttattttgtctattacggagtggaaggagtgagaaagattttgcttcctattttgttttgcaaagcgcttctaagaaaaacaacccgtgttctgaaaacgagattctgagtgtcccctgggcgcgatgaaaacaaactttgggaatccaagggcctgagaggcagagtgaatgtcatttgcatttccctgcgaatgacaaagtcactttttatttattattattattatagattcaggggatccacgggcagctttgtgacctggggatattgtatgatgctgaggtttggggtatgaatcatcccgtcacccaggcactgagcattgtacattcctgaggtatataatgtgtactaaaaataaaatgtatatttatatatgcactaatgattcaacttgattcctcgtaattaagaaaaacaaaccccaaattctagaggagttctagaaatatataagaagagggccaggcgcagtggctcatgcctgtaatcctagcactttgggaggccgaggcagacagatcacctgaggtcaggagttcgagaccagcctggccaacatggtgaaaccccgtctctgctaaaaatacaaaaattagccaggcgtggtggcaagtgcctgtagtcccagctacttgggaggctgaggtagaagaattgcttgaatccaggaggcagaagttgcagggagccgagactgcaccactgcactccagcctgggtcacagagcgagactccatctcaaaaaaaaaaaaaaaaaaaaaaaaaaaaaaaaaaaaagagagagagagaaaacaaacaagcaagaaaatgcaacagaaaaatccgtgacccaaagctctctccagttgctgctttctgccggaaattcaaagaacctcagggtagtttttcaacccttgtacccccgcccctgcttcctgctctattagtcctgagggtctgtggtgccgctccatcatgtccaggtgcaggcaatgtttagctcccacctataagcgagaacatgtggtatttgattttctgttcctggcattaattcactaagcatagtgccctttggcttcatccatgttgatgcaaagggcatgattttattcttgttcatggctctgtagtattccatgatgcggaaggaccacatttgttttatctaattgagaacatgtggtatttgattttctgtttctggcattaattctctaaacataatgcccttcggcttcatccatgttgatgcaaagggcgtgattttattcttgttcatggctgtgtagtattccatgatgtggaaggaccacattttctttatctagtggagaacatgcggtatttgattttctgttcctcgtattgattcactaagcataatgccctctggctgcatccatgtggctgcaaagacatgattttatttttttcatcactgtgtagtattccgtggtgtaggagggccacatttgctttatccagttgagaacatgtagtatttcattttctgttcctggcattaattcactacgcataatgtccttcagctgcatccatgtggctgcaaaggacatgatattattctttttcatggctgtgtagtattccatgatgcagaaagaccacatttgctttatctagtggagaacatgtggtattcgattttcttttcctggcgttaattcactaagcataattcccttcagctgtgtccatgtggctgcaaagatgtgattttattctttttcatggctgtgcagtattccatggcatagaagggccacaattgctttatccagtcaagaacatgtggtatttgattttctgttcttgtgttaattcattaagcataatgccctccagctacatccatgtggctgcaaaggacatgattttattctttttcatggctgtgtagtattcgatgctgtagaagaaccacttttgctttatccggtaccccactgatgggcaactaggttgattccatgactttcctattgtaagtcgtgctgtgatgaaccttacagggctgggcactgtaatcccagcactctggagggccgaggtgggcagatcacctgaggtcaggagttcgagaccagcctggtcaacatggtgaaaccccatctctactaaaaatacaaaaattagccaggcatggtggcgcatgcctgtaatcccagctgctcaggaggctgaggcaggagaatcacttgaaccaggaggcggaggttgcagtgagccgagattgcgactgcactccagcatgggcaatagagcgagactccgtctcaaaaaacaaaaacaaacaaacaaaaaaaaaaaggaagtttaccatgcatgtgtctttttggtagaatgacttcttttcctttgggtagatgcccagtcttggaattgctggcgcaaatggtggagcagtttagattcaggaggtacatgtacaggtttcttacatgggtacgatgtgtgatgctgaggtctggggtatgagtgatcccatcacccaagtagtgagcataataccccacagttggttttttcaactcttgtccttctaccttcctctctccccctaactagaccccagtatctcttcccttctctgtgtctacgtatacacaacatttagctcccacttataagtgagaacacgcagcattctgttaatttacttaagataatggcctccacactgttcacaatagcaaagatgtggaaccaacccaaatgctcatcagtgatagattggataaagaaaatgtagcacatagacactgtggaatactatgcagccatgaaaaaggatgagttcatgtcctttgcagggacatggatgaagctggaaaccctcatgttcagcaaagtgacacaggaacagaaaaccaaacactgcatgttctcactcataagtgggaagtgaacaatgagaacacatcgacccagagaggggaacatcacacactggggcctgttgcaggagggggggactggaggagggacagcattatgagaaatatctaatgtagatgatgggttgataggtgcagcaaaccgctatggcacatgtatatctatgtaacaaccctgcatgttctgcacatataccccagaacttaaagtagaatagaaaaaataaaaaataataaaaataattaaaaaagataatggcctccagctacatccgtgttgctgaaaaaaaaaaacaccaaaaacatgattttgttccttttcagggttgtgtagtattccatggtgtagatgtacggcattttctcgagggtggagggtgggaggagggagaagatcagcaaaaacaacctgtggctgggtgtggcagctcacacctgtattctcagcactttgggaggctgaggtgggtggatcacctgaggtcaggagtttgagatcagcctggccaacatggcaaaactctatctctactaaaagtacaaaaattagacaggcacggtggtgcacgcctgtaatcctggctcctctgtaggttgaggcaggaaaatctcttgaacccaagaggcggacattgcagtgagccgagatcatgccactgccctccagcctgggccacagagtgggactccatctcaaaaaataatcataaaaataataataataacctgctaggcttaggacctaggttgattccattacaaaaaaaaaagaaaaaagaaaaaactaactttttaaaagaaggatctccctgttcaaaaacaaaaccaatgccctgtcaggaaagatgttctgtgtttctggtaaagctggaaggaacctacaggaaggagtcaccccataaaactagtggagcagcattgccttttggggtgagggctgcttctgttaggccaccaggatgagtaccttcctggggagtgtggttcatcctataccatccaggaagcaattcctgcccccaaatcacccgccagcttctgccctgtaagtaaaatccccagcaagcgggcagcaaggagctacttgccttggaaggcagccgaagtctctgtccaccacccagactgtgtcctctgggcaaggccagggcttccaattggatggttttcacattagcggctgctgtttagaatcatcaacattggccaggcgcggtggctcacgcctgtcatctcagcactttgggaagctgaggcgggcggatcacaaggtcagggaccagcctggccaacatggtgaaaccctgtctcaactaaaaaaaaaatacaaaaattagcttggtgtggctgggcatggtggctcatccctgtaatcccagcactttgggaggccgaggcgggcggatcatgaggtcaggagatcaacaccatcctggctaacacggtgaaaccccgtctctactaaaaatacaaaaaattagccaggcacggtggcaggcacctgcagtcccagctactcgtgaggctgaggcaggagaatggcgtgaacctgagaggcagggtttgcagtgagcccagattgcaccactgcactccagcctgggtgatatagagtgagactctgtctcaaaaaaaataaaaaaataaaaaattagcctggtgtggtggtcggcacctgtaatcccagctactcaggaggctgaggcaggagaattgcttggaccccggaggcagaggttgcagtgagccgagatcgcgccattgcactccagcctagacaacagagcaagactctgttgcaaaaaaaaaaaaaaaaaaaaagaatcatcaacattgccttggcccaatctcttgtcaaatatttaccactggacctccatgttctagtttcaaagctctgctggccacagtggctcatgtctgtaatcccagcactttgggaggctgaggtaggaggactgcttgaacccaggagcatgaatccatcctaggcaacatagtgataatagtgtcaaatcagagccagtgtctggtaattccccaaatatctgagaattttcttttctttaagtcatagtcatcctggcagaaggctgtaggtccctttggggaagactgggaaaaagataaacaatgtaaatttttggcaatgtagcagcgtacttccccaagatcacccagcctccccttcacttaaggggttgtgggcctgtgaactggctcaagtctgggaattgattgagggttttagatctgtgtttcattaatttgagttagtcttttattcagttgacctagaattcttcattttttaaagaacaactaagactttggtacagcccattagctctccctgtggataccatggattacacaatgccgtgggtgtctgtgagtcaaaccattctgactgctgctttgacactgctttccactgtggtgaccacacccaccttatcttcggtgattaaggacagcccatgttccctgccaccctaggattcaattatcctcattttacttaaagatcccagtccagtggctgcagttcctgctgtaacattttgcctactgagagcacaagctcaaagctcttccaggatactgggctcctctcacaatattctttctcatgatcgtcgtgaggagtatgttctgtagaccctccagtgtgagtgagcaggtctgacataataaatccagtctccgtgagtttttgcatacctttctgtacacataaaccaaggaagttgtggcatctcaactttatgtaccttaggtaaactctgattctgtttcagccaaccaaccaagtcaccaaacaaataagcaaacagccaaccaatcaaccaacaagcaagcaacaaaccaaccaaacaaccaagcaaggaagcaagcaccaagcaagcaagcaaccaaccaaccaagtaaccgatcaaaccaacccttggagccctttctaaagctttgacttacaaccctgagtccagaatctctgtttagtgggccaacattaataaatgtagccgaatccaactttatgttacttccaccatggtgccactcacttaatatccattcccacgtatattctccagatttccttctgtataaattgcgtgtgtgtgtgtgcgggtgtatgtgtgtagaaagagagcatcaactgaaaaatcacaaaattttataaatttagaaaagagagctttatttcttataaaggtttgcagtccgcaaggtggccattatgacaggctgggaagtgtggcctacagccaaggccagaggcaggcatttccagggagggaaggagaggacaggaatttgagccaaatgagttggctacatatacatactcaataggatatcagaggagctacatcattttatgagaatactcataaaagaggtcctaacgcatgcatattcaataaacatgcatgttcattctggggtggagacttgacatttaaatgtattataattaggccctacacatcaaaaagtgaagcagggacataaaggtactcagcctctgtaaaggctcagcctctgtaaaggcacagcctctaaaactggccagaaccagtccatggaggatggtctcttatcaggagaaagttactgaaatcagtcccttgtccagagaaagctgtcgttaaggttagtggggcaggagatcagttactcagcgtctgtgaactgggtgagttgtaattgttttaatcttgcttctctcacagccagtgcttgcttggctgctagagaaaaataaaacccatgtggtagttagaatctagttaattctttaagagtagggtacaagacttaaccctcgcctggcatggccctaggccctgtttataatttgaggtcttattgccacaaagagtctgttctgtcagtctcatgatctctattttaacattaatgctgctcagttgttgggtctaaaccataagagggagggaggtacagggaggtatgtctgacctcctgtcctgtcatggccgagaactgaattttaagatttatttgaggttccgttggccaacagggggtctgttaagtcgggtggggggcttaggattttattttttgttctcaagggagataaaataatttaatccattggcctctgtgactgtgggactaacatggctatgatctgtcggacagacttcaggctggcacccaggcaaaattctatgctgtagtaaatgcatcatgcacatttgtaacaacacgtacataacaatgtcacaaaatactttcacggtgacaactagattagtgttttattgaatagctgatgacataaactgtctcatttggtgccaagactgaccatcaccagcataccaaggtcatcactgatcagaggtctaacccaaggagggggtcatgtgcaggcccagcggtggggaggaaagatgctgcagaggagatggatgcccacagaggcccctgagcggataccatgctcactaagtggtaagtatagactcaacgtaggctgtaagctctccccctgtgtaaatgggaccccgtacacttgagagtcaagggtctgtttgggtggcagggatagccacttctgaaggtagaaaggaaaataagccaccaaattggtacctttctgtgaaatggacatcgtgctcagaatctccattttccccacaacctggaggagtaagtactgtcatctgcattttgtagctgaggaatctgactcaacaaaattaaattactcgcctaagcaattagcaatcaaccaagtctttctgactcagaaacccagctattgcctgttcatatccagcccctgtattggggtcaagatctggcctgttctcaatgcagcaagatccaggcagatcacactggactcccagcactgaatctggctcgaggggacatcaaatttgactgggtcatggggctcaggagcatcactctcaaaaatagcagtacaggaagaggcaatggccctaaacagcatttgcaggcagatcccatgttaatcgtaagggtcaggactctctcacttttctgtctctctctctgtctctcctctagggctgaccccacatcggacaccactgcatccatgtccatcacaacacagctgccttttcttctgcctgcttatgggaaagtcccctcctctcctccgtttccttctcttcctgccctatcacactgtgcacttctccctttccttaaagaaccaccatcaactttaggaggagggaaaggggtggctctgggaggaaaagccagaatcccctctagccagcagagagagaggaatggctgcatgttttctcccccaatccaaggcactaggttttggctaggttgcaggttccaagctgctctcctgctgtgtcggtgagttctggttaacctgcaacctcctgatgtggccactgcagttcatcgagtcttcagggactccccatggcctggagtactttgccttgcttacatgggagaggagaatggatttatagagaacatcatctaaatccaacttgaccattgtgtggccacacttgctagattgctatagtctaaatctagcattgtagaaagacgggggagcttggagctgcacaaacccaggtctggaacgggctccttaccttggaaggtgaatgatcctggtaggactcttagcctccctgggcctcagtttctttatctgtttcatgggaatgaggatctcggctggttggttgggtgatgcgggggctgtgtgaaaacagcttgtcaatacaagctgaaatagaaatatttctccacagagtatgaagatcaaatgagagaatacatttaaattaaatggaaaattaaaatggcaaaaaaggcaaagctgtattgaaagttccgagcttctctataaggagctttttgactatgtaagaatcctgtactcgttccccctaaatataaaaaaaaaatgttgaaggaggcagaagggagagtgatgcacgatgggcgaggacttcacctgctgttgctggctttgaggatggaggaaggaggccacaaacctagaagctggagcccctagaagctagaaaaggcagggacccgattcatcccttgagcctccagaagggacatagccctgccagcaccttgactttagcccagtgagatcctcttaggacttttggcaaccagaactataagacagaaatggaagccactgagtctgtagctgtttgttgcagcagcaatagaaaactaatgcagagcccaagaaatcactggtgatgagatggggaagtgggctcaggaggtctggatctgtgatgagatggggaaagtgggctcaggaggtctggatctgtgatgagatgggggaagtgggctcaggaggtctggatctgagttggggatctggagtggaaggggaattcatttgttcattgtctatccttttgcattaattgaatttttttctatacatacatgtgaattttcacaataaaagttttttccaaaataaaataaaagaaacaaaaggggctttttgcaacccaattcctatctatgtctgagtccacttgtattgaatgagtctttctgctaacgtccttatatttgggtgactatctgaatgtcagtgaccaatcagagcagaggcagaccttggagtgggcagggcatcctgagggccctgattcctgccataaggcataaccctttaggtgccagaccatggggaggtccaggggttgcaggggagggctgtgcatctgcaatggctctcagggggctcccggtggtggcaattggtgaatctgcatggtggtgtttcagtattgtcacaaccctgctgtctctcatgctctcaaaaagcatttctcttacctgtgacagacttcctatacctaacagcttgcaaaaatgttccagattaatgagaataatctctcggagccatacctccctgcttggggtctcagtttccccaaatgtctccagacaagttaggctagaaggcccctgagtctcagcccctctatagccctcctgtcacccagacctgatctgggtcttgcaccctgggtgcagcatgacaggggtgggcaggggctggctctgggccagaggaccctttctgatggacttcagctgttggccttccaggggagactgatcaacctcacaagagtcatatggtgagtagcggtgggcaaatccatccccctcatcttagatttatggggagacagagacaaagaggagacactccaggaagacctgcaggtgggagtaccaggttgaaaccaaggacaccttcctggaggagctgccgtttgagccagctctgagaacaggtggagacaggactggagaggaggaggttgtgccctatgagcaaagactggccaccaccccatctaacacccccacagggcccctgtggcatccctgtccagtccctgtcaccacccagtttttccctctggacccaggaattcaaagtaagcaaggaggtccgctgctccagttggctgcaaataattacaaccttgagcccaagcagcactttgggtcctggtttgggaccatgaagcggctcggtgagactgagaggtaaggccagggcaggaattgggatagtaggattgaactctccctgggggccagcctcagaaagcctgtggccatggcctcttggccaacatcagatcctgtggtctggcaatgcctggggtacccagacctcactctggacaggccctgggagggggccctggtgagattcctggcagcctcacagccactcttctgtccatagctacaacctgtcatgccagctggaggctccatcccagttggctgggagcataaagtccaggaagatagacatcacccaccacaggggccagtcagggcctgaaccagggcgggcagaggttggctgccttgggatatgggtgggctcagggagtcagacagcaagggactagcctcccatcctactgctgagcagccctgtgactggggagagtcaccttacttctctgggcctcagtttccccctctgtggagtgacactaaatgatctctctggagacggggatcaatagggtactggtgattgaccaggcactcagcacatgcctggagcacacagtgcagggctgtggtggggaggtgggctgagttcctagggagtcacccatgtgtgcctgccgttctgaccagccaccaggccctcagggcagagcccactaccagcagcagctcacaccccaagaccagctcagaggcggcccctacctcagcagcagggacatcacagacactttgagctggcactagggtggcttctccagctcccacggggagaggggtcccagctgagtcccactcacgtggagtctcatgcccatgaaagtgccattcaccactggccaggctcatgaggccgcatgagaggggggtcactggggaggagatatcgggggaacagagagggtggttgaatttttgtataataggcagtgcaagtgtttaccgtttggcaggggaaaggtttgttattattagcaatgctacacttcaatattacactaaaatccagtttctctataacctgggagttgctcttttgttctttcttttcccatcttaattaaaatgagatgcagactctcacggtccacagtcgattaagaaatcttgcacggccatcaggttatgtcttggagagcagagtttcagtaccatcagcctggcaaggagctgggcctgctcctcagagctcccgggactgcgagaattggcatgttcacaaggcaccgtcacagcctctgaaacacgctgtctttaaagatgtttgcaggctggacgcggtggctcactcctgtaatcccagcactttgggaggcagaagcgggtggctcacttgaggtcaggagttcgagaccaacatggcaaaaccccatctctactaaaaatacaaaaaattagccaggtgtggtggcaggtgcctgtaattccagctactcaggaggctgaggtaggagaactgcttgaacccaggaggtggaggttgcaatgagcagagatcacaccactgcactccagtctgggcaacaagagcaaaacttcatctcaaaaaaaaaaaaaaaaaaaaaaaacacaaaacacaaagacatttgcaaggaccatgtcctcacccagaatggtgcctgcctttctacagtttttcaggaaaaggaaacattttctgcttctctcgctgaggttttttttaaccacccattaggaacctatagatttcaggatcgaacactgggattccctcagcactaaaggaggacaattgcaaacagagctgaaagtgcaatgtggaaaggtcaggctgaggaaggttcttagccagtagaccaagggcaggaaggacactgcctcctcagtctcccactagggaacttgtgattcttgtcccctgacctcagaattccttgtcatgtttgttttgtctccaagggaagggtttgaattacagaatttaaggctagagtgggcctcgtgcagttaacattaaccctctctctccttcgctggccaaggtgaagtccggaaacatgtagttctgacgtccactctctcgggggatcaccagttcacccatctcacccggcaagctgggacctagtttggcgacaggcatcttccacccacctgggaggcagggttcaacactctgcctctgaccttgtttccttcttctgccacctgcttaggcagccagaaggggttgtccagccagcacctgggctttggcgctcctcaagcaggtggaggaagtttcaggcacctggctcctcaggtgtctgccatccaggtgctcttcaggcctgcccagcagagctctcttgatccagctagaactggccagaactgactcactcaggaatgtgtagactttggcatcaggggctgctttaatttgcacaatttccaaatacctcttttttcttctttttctgatgagtcatcttcctagactttcattttaaagagatagatagttatcaggttccagagaagacatggtagaacatttatatctcaaagacacagagctgagacttcagttttagatactataatttgcctaaaccaaaaaggaaggtgtaggtaaagttctagtcaagacaggatggccaggaaaaacaccttaaaccaagggatggcttgctttgctgatttaagccaatggcttctttatcataagacttcccagtgatttagtcctccctctcttccagtgcacagagacatacccctccttacaaataaaaatgttctttatagatgtaaatttattttacaaaaatgtttcaaaataaccagatgaaaatcatccttatgccagaaagacttgttttttttttcattactagaaatgaaacagtaagtatttgttgtattgacatacttaggcttagacctgtgtttaacaagaaagcctaataatagcactgtggttagactgtagcctatttttccaaaccatcattttattattaaggaaacgaaggaccaaatacctttcattcatctgatatgatcctttaaaacacattccactaacaagtcccatttggaacagctgaaaatcttttaataaaactttttaaagatgagctcatggcttagtgtaaatttcacaagcttaattaggtcaaatggaaggaactcagatgagtagttgcccaatcagagcccattatttgtaagtcatcagacccctccatgaccttaaaactccactctgacctgattattgcaaacctatatacaaaaaagtgaaaggattaattttcattcatcaacctctcaatcccagattttcaaagaaaaaacctatgtaaggaatacttaccaaaaccagacaggaaaattagagcctgcatactttagagtcaaatttgttccactacagccaggtcgcatacaattacatcatttggttcttcatacactctagaactgactaggacagagtttagcatagaagaactgtaagaaataggttctgaaacatagaaattgcaaagttcaaaaggctatgaaaaaaactaatgtaaatgagagactcccctcactttgttttaaagaaatagacccatcagagaaatgcaaatcaaaaccacaatgagataccatctcacaccagttagaatggtgatcattaaaaagtcaggaaacaacaggtgctagagaggatgtggagaaataggaacacttttacactgttggtgggactgtaaactagttcaaccattgtggaagacagtgtggccattcctcagggatctagaactagaaataccatttgacccagccatcccactactgggtatatacccaaaggattataaatcgtgctgctataaagacacatgcacacgtatgtttattgcggcactattcacaatagcaaagacttggaaccaacccaaatgtccaacaatgatagactggatgaagaaaatgtggcacatatacaccatagaatactatgcatccataaaaaatgatgagttcatgtcctttgtagggacacggatgaagttggaaaccatcattctcagcaaactatggcaaggacaaaaaaacaaacaccgcatgttctcactcataggtgggaattgaacaatgagaacacttggacacaggaaagggaaaatcacacaccaggcctgttgtggggtggggggaggggggagggatagcattaggagatatgcctaatataaatgatgagttaatgggtgcagcacaccaacatggcacatgtatacatatgcaacaaacctgcacattgtgcatgtgtaccctagaatttaaagtataataaaaaaaataaaaaaataaaaaaataaatagatgttctgtaaaaatatacacaatttttacagacaaatacatttataagttgtttttatcttaaaaattggggatatttcatatttataactaattattgaaccttaagttttcttggccatttataggctaataaactaagaatcatgtaaactaagccaaagtagaatagacataaaagtcctaacacttcaacttcctatccttcaagaagtatacctcgcaaagctcatttgagagaggaaaagctttcctccaccctctgttttacagcgctgaggtttctcatcacatttctatgacttatagcttaaatccatgttacatggtcactggcattgttagtgcttctcttttaatactgtagaaattaatcaatttggtggcgtatttaattaattctatcactagaggattgtaaaattacatatatgaatacctcactttagagaccacttaattttttttccaaggggatatttgactatatttcacttgtgtcttatttaatgattttataatttaaaccctaaattataaatctagaatttagagagtatatttccccactggattacatttttggaattattatatgtgcacaaatattacaaaatcactgtagacacctgaaaactatattatcttttaaaagcaatatttacattaaactggtataacaaaattgtttggtgcattttttccagtacattttgtatatattacatgtttaacctttttttattcagcaaataatttttgagtatctactaagtgctaggttctgcattactaattgaatttaaagagtgaaataacagacatggtctcagacaataaaaattaacattaggtcacctatttacatattttaaaatggtaattatgaaaactttgagattttaaactagataacattataataatacacttgatgttgttaatatttgccagtgagcaaaaaagaaaataaaaagatggttttattcaatatacactttaaaattgcagaaaatagtcaagtttctctgctttgcagtttaatgtctatgtgtttttctctgcaacttggcttttgtggagtgaaacaattattcttccagcccaataaaggcagaagagtaacaataaatctaatattttaaatgcttatcaaaagatagtaaacatattatttcagaatactgagttcaataagttgacctacaaaaaaagccaaactgacagtattactgaataaggaaaggcccaaagagacaaaatactttttattttgtaacctcggtatgatacaacttaccctaactataaagaccctaaattaccaagatgggtgcttataatatggagagtaaaaaaagtcatttcacttttagcttttttatttctctcagaataaaaagtgtataaggagtttataaagaagttgatactataagttagtactacaaagacagcacttttcaagaaaagacttttttctctcttacaaatatcatgttagcagtatttgttttctccagaaataatgaggaaataaaaacataagtatgtgggtaattagtgtagtttcttaaagaaatgagttaggcaacaggctaataatgtatacttcgctggcttttgaatgccaacaatcatattctttataaggcacagagaagatttttctgaagaataagtatgtgaacctgaaaagtaatcgccacttggtagtgacaatatggatagggtgaagggcgtcatcaagaagcaatgaaaagatacatttgcagttaaatttgaaaaccatgatgtttaatacatatagtaataaagaatactttctcctatttcaaaattattttagaattaagatagaagctaaaatacctagggataatgatatgactatcaaaaattaaaaattaaaggacattttgagtattataagttaagaatgagaacttattacccaaagaacaggggataattcattatgctccatatccattgaattaaaagacaggcccattacctggataatttgaaagtttaattttatttaaaagtcttgtttcattcatcaagctaaaggattagctcccagaaatattctaggattgcatatccccaactctgtaggaagtatagaaagaatgttataagggccaccatctaaacattattatgtaaataatttagtaccattccatttgcctttgtagatttaaaaatgtaaatggctttctcatattaggaaacatcacttttcaaaacccagataaacatagtatattgcaagagaataattattttctttattaaaaaatactggatgctaagtccaaaagacataaattattttatactaataactactaacattttattcattaaaatataaaggtcaaagattttaaaatgatctttaaatgattaataacatgttgatctttttcttctttctgtaaacctttttgagtcttaacaatactaaactatacaagcaatattaaatagtatataaacggattaaaatattcaaatttactagaatgtggacattggaaagaatgaaaataaacagaagcataaagcagcagatataaaattaagaaagcaactaagagtgtttaaagtacatattcatctgtagtctaatgtctaccataaacaatgactcttctcagtaaaacacaaattgttcatgaagggaaaaagcatgttgtattagagaatattcaacataatttttttagtactaacttgtgcctggagtattattggtttttccattatgaacttatgcacttgataatttttttcataaaaattgtatgtacaactccattcaaaagcagtttttggtgggttttttttttttttttgagatgagttttgctcttttcacccaggctggagtgcaatggtgcgaatttggctcacagcaacctagcaacctttgcctcctaggctcaggtgattctcttgcctcagcctctcgagtggttagaactacaagcatgcaccaccatgcctggctaattttgtgtttttagtagagacatggttttgccatgttgaccaggctggtcttgaactcctgacctgaggtaatccgcccaccttggcctcccaaagtgctgggtatgggcaagagccaccatacctggcctcaaaagcagtttttaaaagcaaacacaatataacaccaaagttgaaaaatctatgctcacccaaggatgccaggtttaataaattatttatagaatactgcatcaaaaataagacaataacccaaaatataccattaaagatgtatccactcctacaactagagataattaatctatctggtagcaaatgatacttcaatcagtttcagcatgtctgaaatctttaaggacaaaagtgataaaacatgacttcattcttcattagactcttagaacacttgaaggaaaataatttctgaagcacaaagaggtaaagaggtgtaatctttcaaaaagatattcagtgttcaaaatccaagagtgcaatatcaggctgggtgcggtggcttatgcctgtaatcccagcactttgggaggccatggtgggtggatcacctgaggtcaggagttcgagtccagccaggcatggactctggctgtactaaaaacacaaaaattagccaggcatggtggtgtgcacctgtagtcctagctacttgtggggctgagacaggagaatcgcttgaacctgggaggtggaggttgcagtgaaccgagatcatgccacctcactccagcatcagtaacagaatgagattccatctcaaaaaaagaaaagagtgtaatatcggtatacacagataatatactgaatgaaacaaatagaataatttgaagaggtatcttgatgaacaaggagtcattagaaaggttgtattcatgtctttgaaggaaattgcaatgtgagaaattaatactttgactactatactaaaagtttattgctaacatgtattgagttattaacgtgtgttaggcagagtgccatataatttacaagtgttatctcatttattgcaggtgaaatgtaatttcgaactctggaagtataaatgaattagatagaaaaaaattctatttaaatggccaccagtaaatcggtatctaggaacagggtgatacagtgcccaagttttctattcttactaaatgttgtgtttcattttcaatgttttcttggatattgctcttttttggtgattttgatttttttttattttagaaaactaataaattgactcttcttggtactgactcgggttttatagaagaaaaagtaaattctgtacatttacctttacctcatctttttctcttttaaatttactatattttttattttttttgtaattttattttatttttctatgattattatttttattattattatactttaagttttagggtacatgtgcacattgtgcaggttagttacatatgtatacatgtgccatgctggtgcgctgcacccactaactcgtcatctagcattaggtatatctcccaatgctatccctcccacctccccccaccccacaacagtccccagagtgtgatattccccttcctgtgtccatgtgatctcattgttcaattcccacctatgagtgagaatatgcagtgtttggttttttgttcttgcgatagtttactgagtatgatgatttccaatttcatccacatccctacaaaggacatgaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttccgatttctccacatcctctctagcacctgttgtttcctgactttttaatgattgccattctaactggtgtgagatggtatctcattgtggttttgatttgcatttctctgatggccagtgatggtgagcattttttcgtgtgttttttggctgcataaatgtcttcttttgagaagtgtctgttcatgtccttcgcccactttttgatggggttgtttttttcttgtaactttgttggagttcattgtagattctggatattagccctttgtcagatgagtaggttgcgaacattttctcccattttgtaggttgcctgttcactctgatggcagtttcttttgctgtgcagaagctctttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtgtaaggtgtaaggaagggatccagtttcagctttctacatatggctagccagttttcccagcaccatttattaaatagggaatcttttccccattgcttgtttttctcaggtttgtcaaagatcagatagttgtagatatgtggcgttatttctgagggctctgttctgttccattgatctatatctctgttttggtaccagtaccatactgttttggttactgtagccttgtagtatagtttgaagtcaggtagtgtgatacctccagctttgttcttttggcttaggattgacttggcgatgtgggctattttttggttccatatgaactttaaagtagttttttccaattctgtgaagaaaggcattggtagcttgagggggatggcattgaatctgtaaattaccttggggagtatggccattttcacgatattgattcttcctacccatgagcatggaatgttcttccatttgtttgtatcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttcgtacattgattttgtatcctgagactttgctgaagttgcttatcagcttaaggagattttgggctgagacgatggggttttctagatatacaatcatgtcatctgcaaagagggacaatttgacttcctcttttcctaattgaataccctttatttccttctcctgcctaactgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgcatattgaaccagccttgcatcccagggatgaagcccacttgatcatggtggataagctttttgatgtgctgctggattcattttgccagtattttattgaggatttttgcatcaatgttcatcaaggatattggtctaaaattctctttttttgttgtgtctctgcctggctttggtatcagaatgatgctggcctcataaaaagagttagggaggattccctctttttctattgattggaatagtttcagaaggaatggtaccagctcctccttctacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcctctttatcattttttattgcgtctatttgattcttctcttttttctttattagtcttgctagcggtctatcaattttgttgatcctttcaaaaaaccagctcctggattcactaattttttgaatggtttttttgtgtctctatttccttcagttctgctctgattttaattatttcttgccttctgctagcttttgaatgtgtttgctcttgcttttctagttcttttaattgtgaggttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagtaggttgttcagtttccatgtagttgaatggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctactaggtccgcttggtgcagagctgagttcaattcctgggtatccttgttgactttctgtctcgttgatctgcctaatgttgacagtggggtgttaaagtctgccattattaatgtgtgggagtctaaagtctctttgtaggtcactcaggacttgctttatgaatcttggtgctcctgtagtgggtgcatatatatttaggatagttagctcttcttgttgaattgatccctttaccattatgtaatggccttctttgtctcttttgatctttgttggtttaaagtctgttttatcatagactaggattgcaacccctgcctttttttgttttccatttgcttggtagatgttcctccatccttttattttgagcctatgtgtgtctctgcatgtgagatgggtttcctgaatatagcacactgatgggtcttgactctttatccaattttccagtctgtgtcttttaattggagcatttagtccatttacatttaaagttaatattgttatgtgtgaatttgatcctgtcattatgatgttagctggttattttgcttgttagttgatgcagtttcttcctagtcttgatggtctttacattttggcatgattttgcagtggctggtactggttgttcctttccatgtttagcgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttcttgaggagtatctttgtggcgttctctgtatttcctgaatatgaacgttggcctgccttgctagattggggaagttctcctggataatatcctgcagagtgttttccaacttggttccattctccccatcactttcaggtacaccaatcagacatagatttggtcttttcagatagtcccatatttcttggaggctttgctcattccttttaattctgttttctctaaacttcccttcttgcttcatttcattcgtttcatcttccatcgctgatactctttcttccagttgatcacattagctcctgaggctttgcattcttcacgtagttctggagacttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccatccagctttgttctgttgctggtaaggaactgcgttcctttggaggaggagagcgctctgctttttagagtttccagtttttctgttctgttttttccccatgtttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtatcagtgtgcccctgctggggggtgcctcccagttaggctgctctggggtcaggggtcagggacccacttgaggaggcagtctgcccgttctcagatctccagctgcgtgctgggagaacaactgctctcttcaaagctgtcagacagggacatttaagtctgcagagattactgctgtctttttgtctgtgccctgcccccagaggtggagcctacagaggcaggcaggcctccttgagctgtggtgggctccacccagttcgagcttcccggctgctttgtttacctaagcaagcctgggcaatggtgggcgcccctcccccagcctcgctgccgccttgcagtttgatctcagactgctgtgctagcaatcagcgagactccgtgggcgtaggaccctccgagccaggtgcaggatataatctcgtggtgcgccgttttttaagtccatcggaaaagcgcagtattcgggtgggagttacccgattttccaggtgccgtccatcacccctttctttgactcggaaagggaactccctgaccccttgcgcttcccaagtgaggcaattcctcgccctgctttggctcgcgcacggtgcgcgcacccactgacctgtgcccactgtctggcactccctagtgagatgaacccggtacctcagatggaaatgcagaaatcaccgtcttctgtgtcgctcacgctgggagctgtagactggagctgttcctatttggccatcttggctcctcccccttaaatttactttaattgacatataataaatgtacatgttatggggtacagagtgatattttgatatatttatacgatgtgtaaagatcaagtcagagtcattatcatatccattacctaaatcatgtattatttctttgcagtgagaatattcaaaatcttttattttagttatttgaaaacacacaataaattcccattaactacagtcacccaacagtgctgtagagaactagaacttcttccttctctccagctgtaattttgtatgtattaaccacatttttcttatactcttctttctcctactctttccaggatatggtaaccaaaactctactatctacttctacgggattaaaaattttagcttccatacataagtgagaacacgtagttatgtggtgtttatgtttctatgccaggcttatttcacctaacataatgccctccacttgcattcttgttgccacaaataacaggattttgttctttattatgactaaataatattccattatatatgtatgtcacatttctttatccattcatctgttgatggacacttttgttgattccatatcttggctattgtgaatagtactgtaataaacatgggggtgcaggtaactctttgatatactgattttctttcctttggatatatactgaaaaccatatgattaaattaataaacacaataaaagcgtttggcaaaattaaatattcttacatgacaaaaaacctctcaacaatttagtatagaaaatatatgccttaacacagaaggacataaaggacaaatctacagctaagatcatactgagtgtggaaaacgtgaaagattttactgtgaacaagaaaaagattttactggaacaggaaaaggatgcctattctcaccaatcatatttcacatagtgaaagtcttagccaggacaattaggtgagagaaagaaataaaggacatctgaattggaaaggagacagtcaaactgtccctgtttaaagacaatgtgatcttatacacggaaaaaaataagactctaccaaaagcttcttagggtgatacatgaaattaataaagttgcaggatataaatcaacatacaaaaatcagtagcatttctatatattgatagtaaactagctgaaacaagaaattaagaaagcaattccttttacaatagctacaaaaatgtacttagaaataaatttaaccaaggaagtaaaagatttcgacaacaaaaatgacaaatactaatgaaagaaattaaagaaaacacaaaaaaggaaagacatccacgtttatagattgaaataatattcttaaaatgacccactatcctatgtgatttacaaatttagtacaatcactagcttgtatttttaaaagcacctttgctgcatattcttaagatattcaatgacaatgcctggatttaagtttgaggtattattatatctattttatactgggcacaatataatgttatcagaggtaatggttttgattggtcctaggtcatacagtaatatatacattgtgatttatagacatgctatcttttaatactcaggcatttacaaagttcatttagacaaagttataaaaacttgccttcctttccgcctatatcacctaaaaatcctaatttaagaggtaataacattttttgatatacaatttatcaacacaataaaaatctaacaattatcatgtgcagagtgtgaaaatctcatcagattaaggaacacaaagacatctttttcatatttcgaatgtaaaactgttttggaaactgttatttttagaaacagttaaaaacattttttcattagtttttcatgtaaaattgtgacaaccagcatgaaataactgtcatcacagaagcatggtatattcgattccaaaacatattctttgtaagttttaatatatttatgtattatttatacttacattgtaacccataatgtacagatattatttttccttcaactcttaagaatattcttaaataataaaaaattaatgatttataatttttgttggttgggaaaaagaatagacacacacgtgacagtgcatcacttcacctcatcatttcatctcatcattttatctcatcatttcatctcatcattttatctcatcatttcatctcatctcatctcatcccatcatttcatatcatctcatttcatcaaatctcatctcatctcatttccatttcattttcattatttcatttcatcatttcatttcactatttcatttcatttcatctaatttcatttatttcattatgtcatttcatatcatctcatttcatttcatctcatattttttatatcatttttcatatcatttttcatctcatcatttcatctcaattcatttcatctcatcatttcatctcctcatctcatcatttcctcctttcaacatttcatctcatttcttctcatctcatttcaatttcatttcattatttcatctcatttcattatttcacctaatttcattatttcatctcatctcatctcaattcatcatttcatctcatttttcatctcatcatttttcatctcatcatctaatctcatttcacttcatttcatctcatcatttcagctcatcatttcatgtcacatctcatttcatcatttcatttcaacatttcatttcatctcatctttcaatttcatttcaatatcatcatttcttttcatttcatctcatttcattatttcatttcatttcatctcaccatttcatctcatcatttttcatctcatcatctcatctcatcatttcatcatttcatctcatttcttctcatcatttcatctcatcattttatctcatttcatctcatctcatttcaatttcatttcattatttcatttcatttcacttcatttcatctcatcattttatctcatctcatttcatctcatttcttctcatctcatcatttcatcatttcatcttgtttcatctcatttcatctcacctcatctcatcatttcatctcaacatttcatctcttcctttcatttcatctcatcgtttcgtctcatctcatctcatctcacctcagcatttcatcatttcatctcatcatttcttatttcatctcattttatctcatttcatctcatatctcaattcaatttcctttcattatttcatttcatctcattcatttcatctcatttcattacatctcatcatttcctctcatcattacatctcatctcatctcatcatttcatcatttcatctcatcattgcatctcatcatttcaaatccatcattcatctcgtcatttcatctcatcatttccatttcatcatttcatttcatcatttaatttcatcatctcatttaatttcacctcatttcattatttcatttcattttttcatttatgtcatttcatttcatctcattacatttcgtctaatttcatttcatcccatttcatctcatcatttcatctcatcttttcatctcatcatttcatctcatcttttcatctcatcattttatctcatcatctcatcaactcttttcatcttatcatttcatcatttcatctcatctcatatcttctcatctcatttcaatttcatgtcattatttcatttcattatttcatgtcatctcatctcatcatttcatctcatcatttcatcattttatttcatcatctcatcttatcatttcatctcatttcaattttatttcaatttcattatttcatttcatttcatctcatcagttcatctcatcatttcatctcatcatctcatctcatcatttcatctcatcactcatctcatttcatatcatcattttatctcatctcatcatttcatctcatttcatctcatctcatttcatcattacatctcatttcatctcattttatgtcatcatttcatgtcatcatttcatcacatctcatcgtttcatctcatcatttcatcatttcatctcatttcaactcattgcatctcatctcatcatttccatttcattattccatttcatcatttcatttcattatgtcatttcatctcatcatatttcatctcatctcatcatttcatttcatctcatcatttcatctcatcatttcatctcattttatctcatctcatcatttcatcatttcatctcatcatttcttctcatctcatcatttcattatttcatttcatctcatttcattatttcatttgtcatttcatctcattacatttcatctcatcatttcatccatcatttcatttcatcatttcatctcatgatttcatctcatctcatctcgttatcgcatttcatctcattattgcatctcatttcatctcatctcatcatttcatttcatcattacatctcatcatttcaactcatttcaatttcatttcaatttcatcattacatttcataatttcctttcattatttcatttcatttcatctcatttcattatttcatttcatctcatttttcatctcatttcatctcatcatttcatctcatcattcatctcatttcatctcatcattttatctcattatttcatctcatctcatctcatttcaatttcattatttcatatcatttcattatttcatttcatctcatcatttcatctcgtttcatctcatcatttcatccatcatctcatcatttcatctcatttcatctcatctcatctcctttcaatttcttttcaattttgtcatttcgtctcatcatttcatctcatcgtttctactcaccatttcatctcaaaatttcatctcatcatctcatctcatctcatcatttcgtcatttcatctcatctcaagtcatcttatcatttcatctaagtgaaatgatgtaatggaatcatgaaatgaaatggataggatgccctcagtgatgttaaatttaaaaattgtttcttttcatgtatgcatttttatatttatatgtatttatatttatatttacttatatttctttttacttatttttatttatatttttacttatttctttatttatagacaaggtcctgttctgtggcctaggctggaatgcagtggtgcattcacagttcactgcagcctcgagcaaacctcccaccttagcctcccaggtggctgggaccccaggtgcacaccaccacacctggttaatattttattatttgtagagatggagtcttgctattctgcccaggctggtctcaaactcctgggctcaagcaatcctcctgcattggcaacccaaaatgctgggatgacagatatgagccacagtgcccaacctatttatttatttatttatttaataaggacaaggtctcactatgttgcccaggctggtcaactcctggactcaaatgattctccaaacgtggcctctcaaaatgttgggattacaggtatgagccaccatgcctggctaaaaatagtattatatttttgtatcatataattttcaattaggtaatatgaatattctgtacaggaaatacgcccttaattacataggaataaacatttgttacactgagaaaaatctaacagagctaaaaataaaaattaatttggaaaggtcattagatactgacacattcttacgtttatacattctttcatatattcatatattcttttaacagtatcaatggtttggagttatgtgtacaaaaccatgacctatatgtaatacaactaataacaggcacttacaattcaaggcatattatatacaaagctttaacttcttatcaaaatattttgttttttttctttctgttttggcagatactatgaatacaacattcaactcacagacaccatggagcccttactaagcataaagtactgtgaaaggccagggctaggacagaactgagacagggccagggataggacagaaccggggcagggtcatggccagagaaaaaccaggggcagggtcacagccagggacatgagaggaccaaggccagggccagaagcagggcagaaccagggccagggcagggacatggcagggccagggccatggcaggatcagggtcagcagaaggccagggcagggctagggtagcacagggccaaggcagggcagggtcagtgtagagcaaggaacgggccagggtatggcagggcagggacagggaggtccagggccagagtcaggtccagcacatggacagggcagggccagaaacatggcaggaccagaaaggggacagggcaagggcaaggccagagaaggaccatggaaaaaacatggccagggagggtccagggcaagggcaaggccagggcagaaccagagccagggcaggccaaaggcagggccagggcagggcaaggccagggtagggtggggccagggtagggtgagggtagggccagggcgagttcagggccagggcaggactaagatagcacagggccaaggcagggccagggcagggccaaaaggaggggccagggccaagcatggccagtgtcagacctggggattgtcagggccagggtcagggtcaaggctgggccagggacagggccagagcaagggcagggccagggagaaagcagaaccagagaggatccagagcaaggccagggtcagggaagaaccaggaccaggataaggcaaagccaaggccagggcagggcaagaccagggcagggcaagaccagggcagggcaaggccagggtagggccaggccagggtaggagaaggccatgatagggccaaggccaaggcagggcagggctagggtagcacagggcatggccaaaaacagggcagggccatagcagtggcaggactagcaacagggccagggcaagcgctggaccacagcatggtggggacaatacagggccaggacagaggatggcaaggcaggtccagggccatttcatggactcggtaggcctggggtcaggccagggcagggcaaaggcaaggccagggagaaggcaaggccggggccaaggcagtgccagggcagggcaggaccagtgcagggccaacgcagggtgagggcaaggccagggcatggaagggcagggcaggaccaaggggaagggccaggagagggccacggcagggtcacggccagaacaagggtatggctggggtcaggaatatggtaggacgagggctgggcccaggctgggacacgcagggcagagcatggcctgtgcaaggcacggccagagccaggccatagagatgggagggcaacaccaaggcagagtcagggtagatccagggctgagcagagtcagggcaggtccagagtcgaggcagagctagggcccaagcagggccatggtagcaccagggcagaggagggcagggcaatgcaggactgggccatggcagtgcctggtcaactccggggcagggccagaagcaggacagggccagggccaatgctcaggccagggacagggcatgacaggacgtgccagagcagggctgggccaatgttggggcaggacaaatcagaccaggacacctccaagtccagctctggccctgccttggccctggacccttcctggcctgaccttgtccctggccctgccctatccatgccctgtgtgtttgaccactgttttataaccagaatcctacaagaaacttaaattagttctttttgtgcatttttagtagagatggggtttcacaatgttgaccaggctggttccaaactcctgagctcaagccatctgcctgccttggcctcccaaagtgctgggattacaggagtaatctggccaagtatttaacttctttatgcctgtttcctacatttggaaaatggggatgctttaagtacctagcacatagaattattgtgagaatcaatgcctcacatatttacatattgataaaattatactcatagaacactactggaaacaaagacagtattagttaaaatttagtgattactgcaaatattattactattacaaacaacatagtatagacattactactactatagttatcttaaaaatctaaaataaaaattttacataatagcctaatgtaatctctcctgctctgccctggctcagccctagtgctggctctgcccctagtcctactacatccctggccctgacccttccctggtccagccgctgccctggcccttcccatcttcaggccttaccacggccctaccctggtcctgaccctgccctggtctggtcctgaccctggccctaccccacagaaggggtatggcagagccagggaagggccagggcaaataagtgacaggacacatccaaatccaggaaagggccagggctatgacagagccagggcaagtccttggcagggccaggttccaggccagggccaggaaagggtcatggcagggtcactgtatggccaaggtccaggccaaagccaaggcagtggcagggtcagggctgcataagggcaggaccagagccagtgatacggcagggccagggccagggccagggctgtgccaggacagaacaagagcagagcagggcaggaccagagccaggccatagagagagtagggcaaatgccaaggcaaggccagggtagtgccagggctgaggcaaggtcagggaaggtccagggctgagtcaaggctagaaccaagacaggggcaaaggccggggcagatctagggcacaagcagagcaggctagggcagggcaatggcaagaccaggccatggcagggccagcccaggatagaagagggcacaggcagggcagggccagggccacagctggggcaggacaaggaccaggaccggggtccaggccagggcaagggtatggccagggcagaggtaggccagagccagggtctgggcaggaccaaggcaggtctgttgcagggccagggttcagaccagggccagagcagggctgggacagggccagggccagaaccaggaaagggcaatgtcaggacaagggccatggcaggaccagcaacggggctggggccaggacagggtcaggaccagggctgggccagggtatggccttaagtagcgaagggccagggccagggtccatgccagtgccagcgccggtccagggcagacgcagggccatggccaggtctaggacaaggctggggcagggccaaggtctgggtcagggtcagcacaagaccaggacagagccaggggagggacagggccatggtaagaccagattaaatcagggacaagacacctgcaaatccacttcagggccagggtcagggcagggccagttcagggccagggccagggccaagacagggccagggttagggctcccagggtcattggcagggccagggtcagggctgccagggtcattggcagggccagggccatggcaggaccagggtcaggagcaggggtcaatgccaggccaaggccacacataggaccaggtctgtgctagggccagtgtgagggccaaggcggggtcagggcagggccaaagggagggcagggccagggcagggtgatgcaggcccagggtagcacagggttaaggtagggcacgaccaaccagggcaggtctatggctggggccggggcagggccagggccagggcagggccagagccagggcagggccaagacagtggcagctccagggcagggccagggttaggaccacggacatgtccaaggccagtgccagggcaagggcaagggcaggggcagggccaggttcatctaagaaccagggacaaagccaggcccagagatgggccaggacaggtacctggcagggctagggtctgggccagggccacggcagggccagggccacaaccaggtctgtgctatagccaggtccaacacagtgcccaggtaaggctaggtagaaggccaaggtagggccagggcagggtcaaagccaggctagggccaaggcagggccagggctggcaaggcagggccaggaaagcatagggccaaggcagggcagggccaggccagtaccaagacctgggcagggccaggggcagggccaggggcagggccacggccacagcctaggcaggaccaggttcggggcaggagcaaaacaagggtaaggacagtgcaggttcttggcacagccagggtccaggacagtgtcagggcagggccaaggcagggtctgggccttgataagaccagcaacagggctggggctaggccagtgacaggaccagagtcagggcaagggccagagcagtgcaaggccagggtagggccaggcatttcagggtcagggccaggggagaaccagggcaaggtctgaagcagggaagggccagggccaggacaggtccagggcagggccatgacacggccaggggctgcgttagggcaagggcagggccagagcaaggtaagggtcagggccaaggccagggtagggacagggcaagaaatatggcaggaccaggggcaatgccaaggccaaggctgggccagggctgagccagggctgagtcagggcagggcaaggcagggcatggtatggccagtgcaggacaggacaagagccagtccagagagagagcagggctgatgccaagaaagagccaggctagtgccgaggctgaggcagtgtcagagcatgtccagggcagggccggggccagggacagaaccgagccagggcacagccaagacagggtagggcagggaaatagcatggctgggtcagtactgggacagggcagagcagggcaaggcgatggtagcggcagggcagggacaggccaatgcagagccatgtcatgccggggccaggacacctccaagtccacttcaggcccagggctatggcaggacaaagaccagggccaggatcagggccaggtctgtgctagggccagctccagatgagggtctagcgaagactagggtgagggccaaggtaaggccagggcagggtcaaaggcagagtagggccaggtcagggtgatgacacatccagagcacaacagggcagggtgatggcaagaccaggggcagaccactgccagctcagggccaaggaaaggccagtgcagagccaggaaagggtctgggtctgaacaaggcagagcagggccagggccatggcagagtcagggcaggtccttgacaggaccaggttccaggccagggctagggcagcagcaggggcagggcctggataagggcagggccagggatatggcaggaccagggctagggccagggccaggccatagtgagggcagggcaaaagccaaggcagggtcagggcaggtccagggcaggtccagggagcggccagcaccaagcggggccaaggcacaaccagcgcagggtaaggcaggacaatggcaccactgggccatgacagggcaaggtcagcaccaggagagggcagaacaggcaggcccatggtggggccagggcagggatgggccaaagcagggccaggacatgtccaaggccaggtcagggccagaacaggagcaggaccatgaccattggcagggccagtgccatgacaggaccagggtcaggacaaggggcagggccagagccagggccagaaccaaggtcaggccagtgcaggttcagggcagggccagtgccagggcaagaccagggcagggacagggtagcacagggccaagacagggtcaggatgggaccagagcaggacagggccgagagtccaggtaacagtagagcaggtatagggcaaggcagggcagtacagggccagatccatggcaggcgcagggcaaagccaggcccattgccaatgcaccagccctccctacaaggctcctaccacctggccactgctgcagcccgtccatcgctgtaagcctgaaccccaaccctggctgcagccacctgccctcctagtgcggccgctctcctaccgctctggcgcactgcaatctccgtcactgccacccacccgcagcgaggcaagccgtggtgtcgcaggctcaaggtgtctcctcctcctcctggcacggagcagctgggcaggcaaagccagaaaagcctagaggaagatgtgaggggtggaagggttagagcctcaacttgtcatgccagccactgggtggcaggggccagtttcagcaaaggcactcacacccaccctccaaagtccagcctctccttttggcccaagctggccgggaactggggtctggggtgggtgctggagatatcacagcacccagctccccactccacaggaaccattgggcccaccggggctgcactcctcggggagcaggagaagcagaaaaattcagacccagccagccctccgcacccaggtgccaattcctgttccggacgcctccacgcacagggccctgtcccccatggtgtccccaggggtgcctggcagcctctgaggcacagacccagagtgcacaggcccaggaaccacggtgggtgtgggggctctgccatgctcaggattcccacgcaaacgctgtgtgccctgccgcattccagtatgaccaagagtgggtcgccctctggagtgtggagtcagggagaggagaaccactccttccttggatgccaactctgttgaccgccgccagcagtgcagcccctgatagcaccgaactcgcccccgctccacggctagtcctgccctcaatagcgccccccacctccgtcccccaatgccgccagtagcgtatacccgataatgccctaacctgtcctcctccatgggcactgaagccccagaaagcgcccataacccaccctccctgctgtgggcagtgcagccctgtacagtgctaccaaccagtacccctaatgcaggcaatgacaccctggatagcgcccccaacccaccccacactgcgaaaggtgcagccctggatagcccctgtcctaccactctgttcatgctgcagtctctgtcaccaccaccagcaaccacagtgaggcaagccagtgggccgcaggctctagcatccagcagccaggcatggagcagctctcgctgatggccggctcctaccactctgaccatgctgctgtctgtctccatggccatcttctttcactacaaaggaataaaactaggtatcaataagaaaagtaattttggaaacaatacaatcacatggaagttaaacactaccctcctgaataaatgactagcaggtcaatgaagatactaagacagaaattcaaaaatttcatgaaacaaagggtaatgaaaacacagtataccaaaacttgttacgcagaaagccatacaaaggcagagatttacagctacaagtgcctaccatccaaacaaaagaaaaacttcaaataaacaatacatcttaaagaactagtaaagaacaaactaaaccgaaaataagaaaataaataagatcgtagcagaaacaaaattgaaataaaaaacacacaagattaaacgaaaagttggttttctggaaagctaaacaaaattgacaaacttttaaccaggctaagaaaagagacaagattcaaataaataaaatcaacagattaaaaaaaggagacattacaactaatacttcagaaattcaaaggatcataactggctattatatgccaataaattggaaagcctagtagaaattggcaaattcctagatgcatacaacctacttaggttaaacaatgaaaacatccaagaccagaacagattggtaacaagtaatgagattgaagccatcagaaaaagtctcccagtaaagaaaagcccaggaactgatgtcttcactgctgatggcttcacaccaaacaatttaaagacctagtacgaatcctgctcaaactattttgaaaaacaggagggaatacttccaaacttattctatgagaccattattactgtgataacaaaatcagacaaaagcatcaaagaaggaaactacaggccaggatctctaatattgatgcaaaaatcctcaacaaaataccagtgaatcaaattcagtaatacattaaagagataattcatcatgatcaagtgggatgtatccctgggatgcaagggtcactcaacatacaatgtgatacatcatatcaaccaaataaacgacaaaaacagtatgatcacgtcaactgaaaccgaaaaagcatttgatgaaattcaacatcccttcatgctataaatcctcaaagaaacgggcacagaagaaacataccgcaacataataaaaactacaggaaagacacccacagctagaatcatatggaatggggaaaaacggaaagcttttcctctaagatctggaacatgataaggatgccccctgtcaccactgttgtttaacatagtaccagaaatcctagctaaagcaatcagtacagcccctgatatggcccccaacccaccctgccccctaccaccagcagtgtcgcccccccgcaacagcacacccaacatacccaagccgccccgcctccccgcaccatgggcattacagcaccccatagcgccctcaacccgaaaccgccacccacccccccaccgcccacagccgcacagtgcagccccggatagcacacttagcccacctcactgttgccagcaatacagtctgggatagtgcccccaaccggctccccgccaaaggcagtgcagccccggtttgggcccccaaaccatccccccgtgcaggcagcacagccccagatagcacacccaaccagccacccaagacgggcagtgacgcctgagatagggctcccaaccggtcccaggccacccgcagtgcagcctggatagcgcgcttaccccaacgcctttctacgctctggctggctgcagtgtccatcgctgccaccaaccacaaacagggctgcaaacaggaaggattttattcaccgtcgatgcggccccgaggtgtcccaaagcgaggcagtgcccccaaggtctgtgcagagcagaacgcagctccgccctcgcggtgccaccggcccgcccgcccgggtctgtgctgaggagaacattgctctgccttcgctgtatctccgaagtctgtgcaaaggagaactcagctccgccctcgcaaaggcacacagcgccggcgtggcggagaggcggacagcggcggagaggcggacagcggcggagaggcggacagcggcggcgcggcggagaggcggacagcggcggagaggcgcacagcggcggcgcaggcgcggagaggcgcacagcggcggcgcaggcgcggagaggggcacagcggcggcgcaggcgcggagaggcgcacagcgcggcacagcgaggcgccggcccagactccactccccagctgtgaaagggtaagaactgagggtggctgagactcggggttgttcagggcggggtgggctctggacccagcaggcccggcacccaggtcagggctccaggggaggccaggtgggcgaaggccaagaaggggccggggctggtcaggaagggctcctggtaaccagagcactttgcgtgagccagcgtgggaggaaggtgggctggatgagctagggaggcgccgggaggggccttggcagaggcgaccccctccgtcagcccccaggccactgaaccctgggtagcgagaaccgacaggggaggctgcatacagaggagtggaggctccccggctttgggggctctgagtagaagcatctagggggtccctcaagaggcccccaaacgcctccccatggtgagaaaagaaagcgcagagaggggcacggctgtgatttcttttattgccccaaatgtacttcatcttggtagatttctattggctttaaaaatgtgtgtgttttgctgttggggagtggggtgttatacggatgtcagattttgctggttgactgttcagatcttttgtaaatccttgctccttttctgcctagtttcactctgtcacttacattagagtgcggtggcacgaacatgactcactgcagccttgacttcctagggtcaagtacttcccctggcttaacctcctgagtagctggtactataggtgtgtgccgccacacctggctaaatttaaaattttttggagagatgaggccttgctatgttgcccaggctcgaactcctggcctcgagctatcctttgtctttgcctcccagagttctgggattacaggcatgagccactgtgcccggcctctgcctagttttaacagttgctaagaggaggatgttgaagtagatgtcttcttggtgggttaatccttttgtcattaagcagttgttatggtcacttccttttcaccccattggtgaaggaggggtccctgccctaaagtgtaggagatggctgaacacgacacctggcgtggatggatgagattgacagcagtgttttagtcacatatacccacagctcagaggaggacactgcatgccacacagggtcagatgggcaccgcactctgtagcggagtgagggctgtgggctgaggaagcaggcaggcttgatagtaacaagagcacacaatgaccaatggttcccgagggggaatgcagttggcttgtttgaataaattcatgggctggcagacaggtgaagtgaagcttcttaggctgaggtgcaactgtttggctgataaaagaactagccaggtggggagcctttcctgttgggtggcagggtagggggtgtctggtagaaacaggaaaacccacggctaggcctttggggccctgtgaggctcaaagatgtcaaggcagcataggaaattttagatcttaaaattcagcgaagaccctctccagctctggtaaattattttgcttgaagtctacttcatgagatattaatatattcactcctgcttccttaaaaaattaatgatttcacaggatatctttctccattcttttactttcaacctacttaggtccttaagtgagtttgaagtttcttatgaacagtatttagttgggccatgtgtttattataggctctccatcaatctgtcttttggtttatttagaccatttacatttaaggtgcttatagttacataattgcttatgtctgatgtttttattatttgctttttcgtttcctttttctttccctccatcttgatctatttctgtataatgttgttgctcgtatctctttgtatagtcttaaagtgtttgctctggatgttacaatatgtgtattgtaatacagtagtctactggtaccagtatttaccacttcaaagtgtggaaacctgccttgcatttatgtctctttaccttttccacttgtataaatcactggcttgagtattaggtggtggtatagtttttgtttcagtcgtcaaatgtgattttaagaactgtggattgtctcgcgtatgtatccacatttctggtctttcctttgtccctcctcctatagtcccatattcatcccttctgcataagaactttctgtagccatttttttgttttgatttttttgttttaattttttgtattgtggaaatgacagaacatatttctgtagccactttttagcatttctaaattgaccagtgacaaattcctatattctcttcctctgagaatgtctttatttctctcttcatttctgaagggtagtttcatgggatatagaatttgcagcgaacagtttttttgtttggttggtttttttgtttggttgttttttttttaaacacttgaaaatgttgtgccacttccttctggcctccatggcatttgagttggcgtgtccctacaggcattctgccatttttggtctttgtttttagttttgaaagtttaattggtgttgctttcttttggtatactttgaggtttgctcagcttcttgaatctgtaagtttatatctttcaccaaatgtgggaagcctcaggaattagttatttgcatgctttcacagctctggtctcctatgggactcagataacataaatgcggggttatcgtcccacaggtccgtgcagctctgttcatttgttttcaggttattttctctctcttgtttagactgggtgaattctgttgatcaggtttcagcttctctgattctctcctctgtcgtctccacttttactcaatagggcccatccagttagtttttttaaaatttctgttactggattttatatttctgtaatttccatttgattcttcagtttctttgctgatgttttcagttctttgattgttgccataggatttgtagttgcttgttgaagcatttttatactgactgttataagtgatgagtcagatggttccaacatctgcctatgtaatttttttatttttgcaggcagtcctcctgtttaggtttagtctgtaggtcttggtctactttgtgggctgtgattccaatggcaatttaatttcagagccttcatggtgttattttggtctctttggcttatatgtatcactgggattctcccaccagtccctgttgttgcccacctgagggaacaggggagccgccctaggctgggccacctgctgcagctaggtgggtggggaatggtggttgtcttggtgtgtggagctggttttcttgttgtggggaagatctcctttgatctgcggggactgagtctgcctgggttgccttctattgctacgttgggagttgggaaactctgggcctgggtcaccttcctattggatgaggtccagggagacacctggccactatgcattccctagtcctagagtccctcagcagcctttttctgtccaccttttggaattctccattgatcctctcctgtctattatttctagagtttgggttacatttcttaggagggtataatgtgttatcttctctagaccagaaatccttagtggtggtttcgggttgtaactgtgctaaagggagaattggcgtatttgtgatgtcgggtctttcttttcaaatgaggacatatcattattcagtatataatatttacaacacctacttccttgggttgaagaatgtggttaaggcaaggaaagtacttaacacagtgcctggtgtggagagcacttacgagtgttggtagtgatgctattccttttgtcctttggtagcctattaaagcttttcttcttttttaaaaaaataaagttccggtgcacttcttgttaggtttattcctattttatccttttttgcttttattgcaaataggagcttcctatcttttataacgtctacctggttctttggcccttacgtgaaaatgttttaatagccttctaaacattgttctctcaaatgagttttaatttgcctctttcttttgttttcctttttttgagacagggtctcactctgtcacccaggctggagttcagtgacgcaattatggctcactgcaacctctgcctcctgggcccccaaagtgctgggtttacaggtgtgggccactgcacccagccttacttgtctgtttcttttaagagtgggaactataattgagcccagagctccaaaaacaaatgaagaaatgaatgagtgaataagctcttcccatgggtttggtgtggtttgggactctactcttaatctaaatgctatgttttatataatctaaaatttcccctaggtgtgttacacgattgtgttgtgttgaacttacattgagactccttttcacatgtgctggttatcagcgtgggacttttccattcactctttgaattattcgtttgggggacacagatagacctctgtgtctttcataaagagtgtccattggccggttgcagtgtctcatgcctgtaatcccagcactttgggaggctgaggagggcagatcacgaggtcaggagttcgagaccagcctggccaatatggtgaaatcccatctctactaaaaatacaaaaattagccaggcctggtggcgggtgcctataatcccagctgctcgggagactgaggcagtagaattgcttgaacctgggaggcagaggttgcagtgagctgagatcgtgccactgcactccagcttgagtgacagagtgagactccgtctccaaaaaaaaaaaaaacaaaaacaaaagagtgtccattatctatactagaaaaattgagattgggattttgacatgaagtgcggaaatgtggattgggtccatttagtttacctaaacagatgatgaaatactaactgttttacgaagcattccctagtgcaaagttttgcctgtgtttctagtgatgggaacagtgagaatcagacttggaacacggagcgcattgtgggcctgtcgtgggtggggccagcagcacatgcatgccgggctgacagagcagcctttgggtgttcttttcccagaggagctctacggtgactttgaagacttggaaacaggggacgtgcacaagggaaaatcgggccccgatactcaggtatgactttgtcgtagctggctgttcttggtcattgtgttctgagagaggcccgcattgagaaatgcaaatcttacttgtgatgtgtgaagattgcagactggatggatagattccttcctaaagtgtggggatgtggggaccaaagagaagctttcttatttacttgttaagttttggactacagttactaccgtttcttgccatagtcatttgccaagtccactgtgatttttcactcacagaagtcttagcttctcagacttacattcaaccattgccatcattctcctctttttaaatttaagtgtcatttaaaagaatgaaatccctgttctccctaatatttctttagaacagggtctgggagcatctgggtgagggacatgtctgttatttttattctagtttgtgttcccagccagcttaaggaatagcagctagttgtaatgcagatgtaacaatttcctgtagcagtaccatgttattcagagacaaaggttatgttgtgttttgttttgttttattgataatgataacagatttttgctaagatttttgtttaaatagaactttaaaaaatctaatgtttaaagaaaagaccttcataaacatacacaaaattttttcttctggaaatttaagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacaggtgagaaacctcagttcctctcagccccttgtcaagactatcacatagtgtaggaatccctgactttctttgggtccctgcttcctatcctgcttctgtgcctttcacttggactcctgggtagatgcatgtgagtgtgtttattcatgcagtgagctcattgtttctacagtcagaaggtcaccagaaaaagatccatacctattttgtaacaagaattaggaaaccgaaatgactgagacatggtctctacttttgagacttttacaatgtagcgatctgagatagtgtgttcatttcagtgcaagccaatgctgcctattccgatcgctgctccctgatttgaatggcaggtgatcagtggcccgtgtggcttatggacacaccagagctcccaggggaagtgctctgaaaacatcctggtcagagttcagaaggacatgtggagtataaggtcagatgcggagataagggagatggtgtggccctcctgcccaggggtgctgagcaggttgctggaggcggtgatctcactctgaaggagacagacacagaaacgtatgtacagttgatggtgagcatctgagttgcgtcttgttagtgaggccaggagtgcctgtgtaagctggaacagattaggtatatgatttgtgaaacggagtttcatcctacgtcttcatctagtcaaaggactgtttcctgattaggcattagcttagtggttgctagtctgtgttgacctttgaaaggcatgactaggctaactctgaagttgttgcttcacaccatttacaatttaaaattacctagagccttgtgggccattggaaaagactgaatgtttcactctgaaatgggagtccttggagggttttgaccagagaagagacattcaggtaatcagatcactctgccaagagatcagtccagtggcacaaaccagagggctggcagtggagatgagacagagtcaaacccggattgagtttatttggaagctgggtcagtaggatttcctggtggactgaatgtggggtgtgtaagaggaaatgagggtggcgactggaagttcctggaagggtgggttgttgcaggttagataggaaaccgtctgcagatgcagttttgggaagatgatgtttggttcggctgggtatcatgcagacaagcggagtgtcaagtctggagagacaggtctggccagggacttagatgtacagccctcagcatgtagatgccacttaactctgtgaggtggccggggagtgagtgcagagtgactgggaggagcaagactggcatgggcgagatggggcgattgcggccgtgaggcctgagcagtgcctaggagggagagggagaagcagtgtgagcatgcaggcacgcaggagtccagttgtacacggaggcgaagcactgttcagatcccgctgcagtgttaactacggtaaaggcagagttgaccactggaggagtccttcagcgtggaggccttcagcgatcttggcaagcaccaattttcgtggatgtaggagaatgggagcagaggaactggaggctgcaactgcggaaaacttttgtggggttttgctgcagagagaagcagagaaatgaagcagttgttggtggaagaaatggaatcaaaaggttttgagatagagaacagagggaagagctgttggaataaagtccaggaagagtggatggtgtctagtgagcaagtgatgtgtggccctgagtagaggcacgtacaaatcacctgtgcctgagctgcccttagaactttctgtgatcatggagatgcacgtctgtgcttcccaatattgtaacattggccgcaggttgatatggaccacttccagtgtgactagtgtgattgaggaactgcattttaaatattatgtaattgtaattaattttaatttaaatagccacacgtagctcctctataggccaggtcagagctctgataaggctggatatgggaggaaaccctggtagagggttgactgtagaggttcttttggttttggagtgaatcaggaaacagccatcagctgagtgaaggtgagggtggtggtgggtgtttgaagacaagggaaaagtgtgaaagaattgtttggagaggaaggaaagaagatgtggactggggatgtttccaatgttcgagcacgcagggctccacagttatctacatttgctgtcccttggagcaggagagaagaaaacggttgggacatattctgagcagactgtagaggtaaaatacgtagtttttttttgttttttgagatggaatctcgctctattgcccaggctggagtgcagtggcacgatcttgactcactgcaacctccatctcccaggttcaagcgattctctcacctctgcctcctgagtagttgggactacaggcacgcaccaccacacccagctgattttggtatttttagtagagccagggtttcaccatgttggcgaggctggtttcaaactcctgacctcatgtgatctgcccgccttggcctcccaaagtgctgggattacaggcatgagccactgtacctggccaaatatgtagtatttttaataggataaagcctacataattctgtccacagttcctttacttagaaattgctcatttgttcatgttaatgctatgtttattacagataacagcatacaggttttccccccccaccccgtcatgtacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcaggtgggtccctttgctgcatatttggtgcctgaggctctgtggatttcccctccatcaatcatcttaccctctcatccccctcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtacttaagcagtgctcaccatgtgctaagcactgtatgaggttgtgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcctctgaaatcactctcaggaaagtactcaagtagccttttttttttctttcttttttttttttttttttgagacagagttgcactctgtcgtccaggctggagtgcagtggcacaatcttggctcgctgcaacctctgcctcctgggtttaagcggttctcctgcctcagcctcccgagtagctgggattacaggtgtgcaccatcatgccgagccaatttttgtatttttagtagagacaggatttccccatgttggccagactggtttcaaacttctgacctcaggtgatctacctgccttggcctcccaaagtgctgggattacaggtatgagccactgtgcccagcctcaagtcacccttgttagtttggcttaccaactttaaagttttggattgcttttgtcaagccactgggttgcaagttcagatggtctttcttgtttttcttagctaattgtaagtaaaattcactttggtaatttattgtgtcacatagaattgaagtttttctcttgctaatattattcctattttcaaattttggggttcctgttagcctgattttcggatagctgccacataagttgtccttgatctggataaatccataaaaattgtgaagaaattaaagctaactggttttccatataaaatttttaagaacacttcatttattaaggtctgtatatctatatattctcatatttataaatctccatattgtttgagaaaaggaatgaaatacctctaaaatatgggcctcatatttttagaaaagtgtttgaaatcttttataaacttcatattttgtttgctcctttatattctgtattacttaaatatgctcagaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaatcacaagtttgtctaactcagtagaaaaatcgacaaagcatttgcagacaacttggcaagggtacagagaaacggatgtactgtttttcagtatttggggagggtggtttgagcagcatttattgacaatttcattagtggggatgtttctattgaaaacagggttaggaagtcataaaatgttcctgcaatataaggtaataataccaccagcgtttatcttactgttttcatgttctaagtgcatgcatctgagtaaaaggatctgggctgcagtccagtctgagagatgccagcaaaggcttcctaggccagttcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatatgattttgtgtgtgtgtgtgtgtttttatcttgctgtacctgtagggaatgtttaattcagccttggaagtggccaaatttgaaggtgctgtgattcgaactgtcagtgggataagggggcagatcaagaaagcactctgagctccagaaggagctttccgggccagctttgaggataagctgctgatgagcggtgagtgtcttaagtagtgttcagggcagggtgttaccattcatgcttgacttctagccagtgtgacgagaggctggagtcaggtctccggagagttgagcagctccagccttagatctcccagtcttatgcggtatgcccattcgccttgtgtctgcagccccctggccacacccagtaacagttctgtgatctatgagaatagttcccttagcgacctttcccttcaaatactttgcagccaggtagagaagtttggagtgaaggttttgttctttgtttcttcgcaatatggatatgaatcttcttttgaaaatattaaagtaaattacctcttttcagatattgtcttcatgcaaacttggtatcctgtttccatcccagccttctgtaacccagtaacatctttgttgaaaccagtgggtgagaaagacacctggtcaggaacgcggaccacgggccaactcaggcttgcccatggtgtcagactaaaggcaaacaaggactctctgtataaggtactggtcgtgtgtgtgttagtggagatgaagcctgtgctctacagacagggagtcacacagacacttttctataatttcttacgtactttgaatgttcaagtataaagtctaacattaaatttgattgaacaattgtatgtttgtgggatattttggagtggaacaccaaaaaatggtaatagtggttctttctggattgaagacaaacttttcttttttaaaataaattttattttatatatttgaggttgacaacatgatcttaaaggatacatatagatagtaaactggttactatagtgaagcagattaacatagctaccatctcacatagttagatttttgtttgtgtgacaggaacagctaaaatctacttatttaacaaaaatcccaaagacaatatatttttattaactatagccctcatgatgtacactagatctctaacttgttcatcctacatgtctgctactttgtattattttaatgtacatctccccatttcctattggtcatttcctatttggcccatttttcaactgggttgtttttctgctattaagttgtaagagttctttactgatttttggatattaacactttatcacatatgtggtttgcaaatatttcttccagtctgttggttcccctttcattttgttggttgttcctttgctgtgcagaggctttttagtttgatgcagtcctccttgtttatgtttacatttgtagcctggcttgtggtgcgatatccaaaaaattattgctaaggccaatgtcaagaggctttccccctatgttttcttctaggagttttatggtttcaggtcttatttgggtctttggtcttgtatctgttttgagttgatttttgtgtatggtgtatgatcagggtccaattttattcttttgcatgcgaaaatcctattattgaagagactatcttttttaccattgtgttgtcttgtttgcccttgtcaaaaattagttgacagtatatgtttggatttatttcaaaggtctctgttctgttccattggtctatttttttgtttttatgccagcaccatactgttttgattactatagctttgtaatacaattttaaatcaagaggtgtgatgcctccaactttttctttcacagtaatccgttggctgtttgggattttttgtggttccataagagtttcaggattgttttttcttttcttttttttttttttgaggcgaagtctcactctgtcgcccaagctggagtgcagtggcataatctcggctcacggaaacctctgcctcctggattcaagcaattcttctgcctcagcctcccaggtagctgggactacaggcacatgccactatgcccggccaatttttgtagttttagtagagacagggtttcactctgttggccgggctggtctccaactcctgacctcgtgatccacccgctgcggtctcccaaagtgctggaattacaggcgtgagccactgtgcctggccaggattgttttattcggttctgtgaagaatgccatcagaactttgatgaggattgtgttaaatctgtatatttgctttgggtagcatgaacattttaacaatattaattctcctgatccataaacacgggatgtcttttcattcgttcatgtctaaatttctttcatcaatgttttatggttttcaagtgtacacatctctcaccttcttggttaaatttattcctaagtttttgtttttctttgatgctatcgtaaatgagattattttcttgattgcttcgtcagctacgttatttgtatatagaaatgcaactgatttttatatgttgagtttataccttgcagcttaactgaattgatttagtagttctcacagttttttgtggaatctttggagtttttttacgtaaaggatcttgtcatctgcaaatagagataattttacttatttaatttagttgcctttttttcctcatctgattgctcttgcaagtattctattgaataaaagtgatgaggctggccatccctatcttgtactcaatcttagtggaaaagctttagttgttccccactaactatgattagactgtgggtttttcataaatggtctttattgtgttgaggaactttccttctatacataaactattaagagttttatcaagaaacgttgctgaactttgttaaatgcttttactgcatcaattgaggtgaccatatcgttttatctttcattttgttaatgtgatatatcacattgattgatttacatattttaaatcagccttgcatgccagggataaatcccacttaaacacgatgtataatgtttttgatatgttgttgaattctatttgctaaaatttttttaggatgtttgcatcagtgtttaatttattggagaagttgacctgtagtttttgtttgtttggtgtgtgtgtgtgtgtgtgtgtgtgtgtgtgtgtgttttggtttggcttaggtattaaggtgatactggcctggtaaaatgtgtttggaattatttcctctcgctctgttttttcgaagagtttaagaagtaaactcccaggggatgggagtgactctggacatgggagtgacatgatagtgactctggaccctgcagtggtgggacacagcagcatctctgtctctgtgaggccaggcgcagcatcagcaaggaccccagaatggtggagcactactgtggcttgggccctcgggggcagggaccagtgcagcaactacttctctccctggggaggcaggtgcctgggcaactcagattctccagagctagtccagttccaaggaagcagggttctacagttgtttgtcctgaagggcaaggtaccccagttcagccaatgccgttttcctgggatatgggggtgccatgttggctcatccctggcaggtgtggctgctcagctcagccaagacactgattccctgtgaagcagggcagcgcttcagctctcatgcagtggggggtgtgactgctcagactggccaaggcactgattccctggaaagcagggcaccaagtcagctcaggctccaaggggcagggcgcaatggcagctgggaggggaggggcacagcagcatggccctgcaggtggggtgtatgctgtgatgtggacatcatttgttcccaccagccatttgaaatttcatccatttgaaatttgattccaaatgtggtggtgtgggaggtggggcctagtgggaggtatttgggtcacagggcagatcctttatgaatagattaatgccttttcatgggactggattagttaccaggagtggattgttatcagagtgagttcagcttcctagactctcgtgtttcctctcttgccatgtgagccccttgcatacacctgtttccccttccactttccctatgagatgaagcagcacaagaccctcgccagttgtgctgcccaatctcggacttttcagacacaagcagggtgagccaaataaaccttttttataaaataagttaccccgagtctcaagtattctgttacagccacactaaatggcctaagacagtgtaacagcggctcgggggtggtgggccactaggtgggtgtgatatagagcaacaaagcctgaggatggaagaagggtgcggtggcagctcaccctgggtgggacatgctcccgaagtggtccaggtccaggagggcacgttgcagcagcagctggtccatgggggtggggcacaatgtcagttccttctctgaggggagtgctggggctactgggcccctcttgcttccttatccctgcagggagacatcccctctgcttcaggctgatccctctgggggaatgggtggtgggggccagatgtttccttccctcctttatgtgaccgtcctggttttctgtgctctgctggatttctgctactccttgatgcactctggggctctcttttagtgactttcatcaaaatatagatgtttgctgctttggctgtctttgtcaggggatgagtgcaaggggctattgatcagccccttgctggcatcactccctcttaaacttttcactgggtactcttttgaactattttttcccccaccgtatacatgtattttttaaacgttaatgtgctaatttctactgaagcaatgtggatttttctgaaagttttaatgttttaataagctttttattgaaatgttaatgtccacacagaagagtgcccgaatcataagtgtgcatctagatgaactgtagcacaccaggctgccacgccctggaccaagcagtagcctcgccctgtggcctctcccaggcactgctgccccaacccacagaatagctactttcccagttcctgatgtagatttgttctgcctggttttgacttctataaaatacagcacattctgtttagcctggcttctttggttcagtattacagaacacatccatgttcttgtctatggcagacattgatttatcgtcattgttgagttccattatatgactgtgtcaccatttttccattgatgagtaaaatgatttcctatttttggctgttatcccacggccctgaacactaggtctggatatgggacttgcaggtatgcaggggcacacgcacttctgctggaggatccctgggtggggtggagactccagggcacctgtgctctgcttcagtatggagtagttggagtgtattgcttagaacaaaagagatgagacactaacactgtgtgtatattctaaatcatatatcagtgaagaaatgtgatgtttgcaacatcttctctggggatgctaaccccctaagtcattattaccatgcatgtaagcacctcacctagatctgcactccatctagcagtgagaaattccaccataatctacacaccataatatcatcaatgtgtctagaagtcagatcctctatgtgtgaaccaagacaatgcctggcaaacaagacagctgggctctcaggtctctgcaccatggggaggtgtgtaaggccattcttgaattactataaagaaatctctgagactggatgatttacaaagaaatttacaaagaaatgttgaattgactcacagttctgtgggctgtacaggaagcttggtgctggcatctgctccttttctgggatgcctcaaggagtttttactcacggcagaagatgaagtaggagcaggcatctcacatggcagaacaggagcaggatagagagtgggtaggaaaggtgtcacaaatttgaacaaccaaatcccatgaaaactcactatcataaggtgaaaaccaacccaagaaggatactctctcatgacccaagtacctcccacaaggtcccacttccaaccttgtgaattacatttcaacatgagatttagtttagcatccaaactataccattattcccctggtctctaaagtctcatgttcttctcacatggcaaaatacaataatgtcttcctaacaatccccaaaactcttaactcattccagcatcaactcagtcgaagtccacagttcagagtctcatttgagttaaggcaagtccctttcacctataggccagtaaaataaaaaacaagttatttacttccaaaatacactggtagtacagacattgggtaaatattcccattccaagagagaaaaaactgccataaaaaaagggctacagatgtcatggaagtttgaaaccccgcagggcattcattaaatgttaaagctccaaaataatctttttttgactccgtctcccacatccagggcacactgatgtaaagggcaagctaccaaggctgagggcagttctacccatttggctacgcagggttcggcccctgtggctactctcataggctgttaagtgcctgcagcttttccaggtgtaggatacaatctgccagtagatctaccattctggaatacagaggacagtgacctccttcccacacctccactaggcagtgccccagtggggactcggtctggggcctccaaccccacatttcccctccacactgacctagtagaggttctgtgggagggttctgcccccacaacaggcttctgccttagcacccaggcttttccatacatcctctgaaatctaggtggaggttgttgaggctccagcactcttgcattctgtactcctgcaggtttaacaccacatggaagcttccaaggcttaacatggcttttgctccccaaaactgtggcatagcattatctggagcctcttgagccaaggctggagctgaatcagccatgaggttgcacaggactgtggggccctaggccagacccagcaagccattcagttcacctaggcctcaggacctgtaatgtgagaggctgcctcagagatatctgaaatgcctttgaggtctttttcccattgtcttggctatcaacacttggctcctctttagttacgcaaatacctctagcaagtgattgtttcgcagcccacttggattcttttcaggaagaggggatgttattttctgccacatagtcaagctgaaaatttttcaatcttctatgctctgctttccttttaaatataaattccaaattaaagtcatttctttgatctcacatctgagtataggctgtagacacagccaggccacctcttgaactctttctgcctagaaatttcttctgccagatactctaaatgattgttctgaagttccaacttccacagattcctagaacatgaatagaattcagccaaactctttcctaaggcataacatgggagatacttgccccagttcccaataagttactcactttccgtctgagatgttgacagcctatgcttcattgttcctaacaccatcagcattttgatcacaaccatttaaccagtctctataaagtctgaagcattttctaatcttcctgttgtgaacccccaaaattggacacaagtctcagttaactcagaaagcttattttgccaaggttgaggaggcacatctgtgacacagcctcaggagatcctgatgacatgtgtccaagatggtaggggtacagcttggttttatgcattttaggcagacatgagacatcaatcaacatgtgtaagatgtacatcagttcagtctggaaaggtggaacagctccaggtgaaggcaggacaacttgaagtggggaaggggcttccagtcttagatagataagagacacatggttgcattcttttgagcttctgatgagcctctccaaaaggaggcaatcagatatgtgtttctctcagtgagcagaggggagactttcaatagactgggaggcaggtttgctctaagcagttcccaggttgagtggggtcccaagatttgttttcctttcacactgtcttctcctgagccccccaaacccttccaacctctggccatgactgagttccacagctgcttttgtactatcaggtatcttttagccatactttatttaccaattatctgtgttaggacattgttgcattgctacaaagaaatttgttgggaaatttacaaacaaaagaggttgaattggcttatggttctgcaggctgtacaagagtcatggtgcctccatttgcttggcttctgaggacacctcaaggggattttacttggtggaacatgaagtgggagcagacatctctcatggcagggtgggagcaagaaagagagtaaggcaggaggttccacacatctaaacaatcagatcttgcaagaactcactcactgtcatgaggacagcaccaagcctcgcggaatccgcttcaatgacccaaccacctcccaccaggtgccacatgcaacattggggattacgtttcaacaggagattgagagaggacacacatccacactatatcaggaggtgtgtgccttgcaaccatcaggggatgctgcaggactgccctatggtccctacacagctgcttagtaagaaccattcactccaaggaacctgtgccctgtgctcaatgatggggactcaggagctgtgtcctctctggcctggcagagtcccctaagcagagacctgtgtatggtctcggcaggtgcttcctcccagggccctcccgagggggaaaccaaaccttcctcctcctcagtctggagtgtgagctaagcttcagctccagggctcagggaggggctgggcagtccttggatggaaacatatttgcatgagcagcccctcctctggcagaggatggagaagaagaggagacctggggcagctcaggcccactgttagggctcaggggctgtgtccaccatggcctggactcttctccttctcgtgctcctctctcactgcacaggtagggaaagtccttataaactgagtctcagtgtccaacctacaccatcccctgtggctcagacctacaagaagctttaccctgggaactgccttatcacccatgatgtctgtgttttcaggttccctctcccagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctaagactcacacagtgctccagacccatgaggaagtaagacaaaaccctcccctctactctcctggtctagtgaaatcacccctgctggtggctctgaccaaatctagctcagggggtgacatctgttgtctcatcgacagcactggagctcccacggagaagtaggtctaacaaagtcctaccttgctcgcatttcacaggcagacatcccttgctcaggggtaaaatctctcagtgttgacattgaagaaggcaagagggctgggttggggttcatctcagctcagagtctagaagtgactcagagatgctgctggtctgagagttttaatatgagccttgggatacaatacagggatgcagatgggaattgtattctctatgtcagtaacgaaccatcagtaattgaaaagtcaatacattgagaatagcataaagcatgaaatactttaggataagtatgacaaaaattgttgttttacacactagaagtcctaaaacattgtttagacgcaggtcttaaagaagacctgagtaaatgcacagataatccttttttttttttttttttttttgaggcagagtttcactcttgttgcccaggctggagtgcaatggcatgatcttggatctcggctcaccacaacctccacctcctgggttcaagcgattctcctgcctcagcctcccgagtagctgggattacaggcatgtgccaccacgcctggctaatttttgtatttttagtagagatggggtttctccatgttggtcaggctggtctcgaacacctgatctccggtgatctgcccgcctcggcctcctgaagtgctgggattactggcgtgagccaatgcgcccagcccagataacccttttttttttttttttttttgagcaggagtctcgctctgtcgcccaggatgcagtgcagtggcgcgatcttggctcactgcaacctctgcctcccggttgaagtgattctcctgcctcagcctccctagtagctgggactacaggcatgtgacaccatgcccggctaatttttttttttccttgtggcaacggggtttcaccgtgtttggtcttgatctcttgaccttgtgatccgcccaccttggcctctcaaactgctgggattacaggcatgagccaccgtgcctggccccagataaccctttttatgtgagagtgtagagaatgttgctgcagctggtgtgggatgggggatggctgggttgagactgtgttgtcacctgcagtgtacacctgaggtgacatggttctgaacatcactttccccattgaaggcccgagtgacctatcacttgcttctcaaaattcaggaactaggtgactctaggagagtgcacaggaagctttctgcatattctttcaagagatttcgaggtcactgactcttttttcaagacttaaacacaaaatccacatccatcattcttgcgtaaagagaccattcttttttttttgagatggagtctcgctctgttgcccaagctggagtgcagtggcatgatctcggctcactgcaagctctgtcttctgggttcatgcccttctcctgcctcagcctcccaagtagctgggactacaggcacccgccgccatgcccggctaattttttgtattttttagtggagatggggtttcaacatgttggccagaatggtcttgatctcttgacctcgtgatccacccgccttggcctcccaaagtgctgggattacaggtgtgagccactgcacccggcccaagatggggtttcatcatgttgacctggctggtctcaaactcccaacctcaagtgatccactcacttcagcctcccaaagtgctgggatgacaggcgtgagccacagtgcccggcctagtacattgtttaaatggtgcatgtaaaacctcatggtactacaactgcctggtgacagactcaccagagtaaataactatcctgctgttctccaaccacatgggattccccaaacaaagatttgttgagtccaagatgcatcatgccagaactcttgcagtcatacacataatttgtttcattttaataaatacggttatcttttttcttcagtttattgtttttaatgtatcatcttctaggtttcattacacatcaaagatgaataatttctctcatctttaggacatgctgaaaacactcattagtgattttgaacagtattatttcctaaacatcctagttggaatggttgatcctaaaagctaccatgtgtcaggctcacctgagtgcagactgtggtctaaacaagctaaagttttaattcttccatcttcaaatacggagcatatttgcttgttttgctctttagcaaaacactgcaaagtcattcgccaggatctcctgcagactggcattcagtgatggagaacagactcctaggtgagatccctggtcacaggatccagatgactatgactgcaagtctggaaaagaagagacagaacaaagatttaccagcataaccctctgagaatgtgccccagccatcctggagggaagagctccctattgacccagcactgcagaatccacagaggaaggacagctctggccaccagggagcagccacacgacaagagaggacccggtgtccccacaggtgaggaaatgagtccatggggctggtcagtgctctcgatttcattctgccataacaggactttgtgtagtcaccacctgagtcctatacagtgaacagccaaggagacatggacagattcacccctgaggaacccagtagaatgtgaagtctgccctgaggtcacgaagaaaagactcggggggctgcctggcctggccctgatggagggggccatggacagaacaacggggaggcaggggtgtctctgagaggctctggtcaccttgtcatacaatggtggtgtacaatgtcgcaccatggacactagggggcgcctgcgcaccattcctgagaagactgggtgtgatgagagcaggaccagcgccacctgtcctgcttggtgccctatgcttagggctcacagatgtcaactctccaccccctgggaccacacagccccacccctggcactctctgacatcctcaggcagaggagcttgacccagggcccagggtgggatcagaaagctggagggtctgatttgcatggatggaccctccttctctcagagtataaagaggggcagggagagacttggggaagctctgcttcagctgtgagcgcagaaggcaggactcgggacaatcttcatcatgacctgctcccctctcctcctcacccttctcattcactgcacaggtgcccagacacagggtcaggggaggggtccaggaagcccatgaggccctgctttctccttctctctctagaccaagaatcaccgtgtctgtgtctctcctgcttccagggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggcacagtgctccagcccaatggggaactgagacaagaacccccttcttcctcccccaggagggtgagtgccgccagctgctgctcacgcctgacctgtagcttctgctgctgcaggttctcccatgggccacggggcagccagggccctgcctaggagtggaggctccaccacttttgtcctcagagtcaggaacagggactccaggaatgagaatatcctgctcctgcagcttgggacacagggtctctgcactgacatcctgggctgaggtggcaggtccagctgtgtcttcacagtccttcctgtgcctgcccatggtgtggggagggagggagtggggaagggggtgtgggcctttgagcttcactagagacctgagggagcagaggtgctccccaagacctggactccttccctcaccctcctcccatcactctcctcactgtagctatggccaggtgagggctcagggctacttgaggaccttgctcagcccagggcctccatcccaggcattgtttccaaactctgtaagggctgtctctgaatctgtagaaacagttatttctatgtgcccaggactgggttagagggcaccaaccccaccccttgcaaactgctcctcacctcttagcgccccagtgaggagaagaaagagttagaaatcaggaatctactcagggctcccctctctcccctttcccagcctcccctggctttctctttctacagaaacaccaaggaggcagccaccaaggacgaggggaggcccaggcattataccaggcagcggagccagccagtccccccagatggtggagggaggtggtggaggtgtctgggaccagaaaatagtgaggaccctcttactgaagtgaggacgggtggcataaactgaggcccagatggtggaccagatctcctgagccatctactcatttcttcgtgtgttccagtttgggtaagaataggctaaaaaaaaaaaaaaaaggctttgaagaggttcctttcctcagataagaattcgtagaggattattgcccactcaggcattgaggggaggctgagcctcactctcaggccaatagaactgggggctttcaagggaatttgattgtactgagctcccagactctgacatctaagatttttgccctcgtagccgaacccagcactgataccaaaatggatgaaggctgatagataagcctagaatattctagctggcaccatctcgtggaaaagagaatcaagttagaatattgatgtgataaggtggcatcgcacagtgaggggaggagagcttgcatgggggagggtagaggagccactagagggctggacaaggaggagacagtctgaggtaagtttgtgaggaaaactccagatgcttcagagaagatggacaaggaggtaggcagtgtgaaggccatgggaccagctctagtcaccgggagagagtggtcagattcagcaccagtgtctggggaggaggtactgaagcctgggtgaggggagaggctcaaggctggccttaggacctgagtggggcacagtgatcacactgctggggggtccttcaagtgcaagggggctgcaggaaggcttgagctcattgtcacaatgaaaacttagacaacagctccccagccttgttcaaaggtgtcacaggactttttcctctccacatggcaacgtggagaagaaaacttatctctgagatatataagatgttagttctccataacctctcttgtcccctggctgaattcctatttggaaacaaaatgactctccagttttatatatgacatcctcacaaaaaaaaagttccagaatgagaaagatctgccctccctgacccactggtgaggaatctcagccttcaggacaaccagactaaatcattcatgccatctcccatgacagcatcatgtggaccagggagcctaccttatgggtttgggccacacactgcctgtccctagcattgcagctggggacacttacatgctgaactcatggctgggagatctgaggtccagacatgacaggaaaaggaaaaagaccaggagctctgcctaagtagcccccctgtgtgaatcactctaccctccaccctcatcttcagttcgtgatgggtattgtcttgtgaaaactgaaagctgggctgggacacaggcaagagagtctctgactcacaaatctccatcgtgggctctctggcctttctgatattcttttcacacatcaattctgggccaagacacatccatgctcatcaagaaggcattgataggagaatcaggtagcctccagagagacaggaagcagataaacaccctcatgttggcctcctaagcccagaggagaaaaaaaaaagttggaggggaagaagttcaagaagccacactagaagccactgattaccatcacctcggcacctgtcctccatctgcccctctttcaagtgaggaccagactcaggggacagcacctgcacctccccctctgtccatgcactgtgtagggagcctccttctgctctcatctcaaggtggctgctccgccaggtcagccgtatcactgctgagagtcttccctgggtcctggtcacagggtctgggatcagcagcaacctggctttgattcagctctgaccctgccccttcaggacacaaagcccattattaaagggataactgaactctcctagttcactcaaccttagattttccttctcagtgtccttctagaaagtgccgcctctactaaatgatttcatgttatttcctcaggtctagagctatttgatttccaaaattctatactcttctgttctcattcccggtcatggctcattttccctcagcagctaatgatgctaatcatgtatctaccccccattgtcacaaaaaagagagatggaagagttccttagataaatacagggttagcaaagaaaagtttcattatctcttaagaattactccaagatctggccaggcgtggtggctcatgcctgtaatcctagcactttgggagtccaaggtagacaggtcacgagatcaggagatcgagaccatcctggctaacatggtgaaaacccatctctactaaaaatacaaaaaattagccaggcatggtggtgggcacttgtagtcccagctactgaggaggctgaggcaggagaacagcgtgaacccgggaagtggagcttgcagggagccgagatcatgtctctgcactccagcctgggcaacagagcgagactccgtctcaaaaaaaaaaaaataaagaattactccaagatctaagaaaattaattccagttcttcaagagtttactcctcagaaacaacagcatgaatacattaggtagtgaatgttcttggtcttctcaatgaataacgtctgaaaggttcagagtatatgtttcaaaaaggtaagtgcataactttcaaaaaaatgtagtattaacatgtcaacaattttaattggtatatatatttctgaaaaaaaagcagtatgatggtaaaagaaatgtaaaaaagcctttgtaaaacccagtgcttacagtccaccaggatagcacctgtgaagcaaatttcctttgctgaagatacaccgccttttagaataatagcaagatagtttgaatttgtcttcttctctcacagcaatctaaaaattaacttaatcccatttatatgacatatctagaaatattcctgtacatgtggacattcccatcgcacacctcccatccaggctgtcctaaagtggcatctcctcttcttctgctcatgttctccccctctcctcacctctcctgctgacacgtggctcctccctgccttcctctccagtagccccagcagatcaggcccaaccagtgaacaagctcctggacttcttggatttctgaggacttgccctgccagggtgtctttctcaatcacaatctctccttcccgggagtccaattctcctagatcctgttatttatctaatgttatacatctgtatctacttggtggacttccctacatcttcacccgaaccccaggaatcttcaggtcatgcccatatgaccttagttctcctggagtcccttcttccttcttcccctgtgatcccaccaagtggagatctcttctcagaccctggagtgcagcagggacttctctggtctctgccccagggattaagggggtggaattgaggactcctgtgcccttcctatgcctgtgttttcatcagggtcagctgcacaaggtagggattcccactctcagagtatgaagaggggcagggagagatttggggaagctctgcttcagctgtgggcacaggaggcagcactcaggacaatctccagcatggcctggtcttctctcctcctcactctcctcgctcactgcacaggtgactggatgcagatcgaggggagggtccctgggaagcctatggattcttgctttctcctcttgtctctagaagcagaatcatgatgcctgtgtctctcccacttccagggtcctgggcccagtctgtgctgacgcagccgccctcagtgtctggggccccagggcagagggtcaccatctcctgcactgggagcagctccaacattggggcgggttatgttgtacattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgaatgctcacacagtgctccaggcccagggggaggtgagagaagaacccccttcctcctctaccaggagggtgagcgctcagctgctactgctcaggcgtggcctgtggcttctgctgctgcagcttcccccatggtccaggggcatccagggccctgcctcagagtagaggcttctctttttttctgttctgagaatcatgcacagcagctccttcctaggaacagggcctccagggaccagaacatccatctctttgtaccttgggacacagggtctctgcagtgaagtcctgggctgaggtgtcaggtccaactgtcatcacaaacctgatgcagaacctgtgtctccatcaacctcatttcctgatttctggaagttccgactgttggctttctgtccctgctcctcagggtgaatcgcttggcttctttcctccccagcctactctttttaataaaaccctttccaaggaggaataatgtccatacgagaaaacacctatatttataatataccatgacacccattttggcatgtttctggatccttgaaagcatcaccaccaccgagctatgcaagctgtgaccaaccccagcagctcctcatgaccctttgtcatctccctttctaccccaatgccctcccgggaagccacagatcctcctctgtcattagtgtttggtttccattttctggaaggtatcagtgttcacaaacattctcttgccatttgttgaggcttctttcactccgcacactttttgagattctccctgttgttgctgaatgacatctcatcccataaagggctcatcagtacctttgagggcccctagccattttgcctttcatgcccattcctgcatttgtatatacacatatagaatccagggtagcctatattccttttaatctgaattttaaaaaatcaatacattttctggggcccctaacagcgtcgagtcctgtaggcatttgatcttctctctccagtgatgctcagccctacttgcatctcatgcgattatactcacttctcgccattattcaacaattttgttttattctcttggttttaaataggcaatacacaaacaagatgccacatgagaactatggaaaccacttccccctcctacatcctgtctcctggcctgttggtttctctcagctgaagtgaccaggaatgcttacatttatgttccctcccagccaggatctgtgtgtagaaacaagggggtctgtctgtgtctgtgtgggcaaccacattatgttttctttagtaccactacaaccttactattgacaaacaactttttaattcctgagactgtgacttcatgtaatcctgacagtagcccgattattgcttttgaggcagtggtcctgattggagaggaactgtttgtgacctggggatggcgttctctaatttatcaaatgtaaacactggaggtcagttaaatttgaattcggtaaaacaatgatgaagaatcaataggtaggctgggcgccgtggctcacaccttaaccctggcacttttggaagccaaggttgatggattgcttcaggccaggagttcgagacaagtctgacccacgtggtgaaaccccgtatctcctaaaaatacaaaaattagctgggcctcatgacatatacctgtaatcccagtgactcaggaggttgaggcatgagaatcacttgaacccaagaggcagaggttgcagtgagctgagaccgggccactaactccaggtggagtaacagagtgacactctgactcaaaaaaaaataccaaaaaaaaaaaaaaagagtcagtatgtgtatcccccagacaatattgtgtatttaaatataaacataactgggtgccctttaatttatctggcaactccacacagtgtcacaacctggaagaagcatagctggggcagtcatccccttactgatgctgggtctaggggcttaactacaaagacagagctttgctagcaaagatacactcaagtgagcacatcagtgagcatgaaatgcatgtgatataattcccaatgaatgatgcctcctcacttctctaattattctttctattatccttcaagtctgcagattcagggcctccccagggattgcttcagcctgagcgctagacaagtgatctcatgtcctgtcacacccagatgcatggggctactctgtccccacacagaggggcttcagcctggggtgcataagtaacatgtgagagagagaagagctcagcctggctctgcttatatctagtgagagaccaacttcgggttcatttgatgctggaggctggtgagctgagagcagaggagagaccaagccttagagtgcagggctttcaggagagaaattgggaacctggaaatgggccacactcttcagtgaggaagaagcaggcagctctaggcacagccctgcattcctagtggcttccccttcatcaagcttgactccctgctttgatgtctgtcagggaatctacttcagcaaggtgaagatcccagggctttactaaaaatagcagtagaccaggcaggtatgtcatggttcaagagttctgtgcacagaaataaatacagatgcatattcacaagggccctcacagttgtctcttttggagtggaagagatgaagaaaggcagggagaaattgaaagactcagtcggtctgggcctggggcagcactggatgctgtggacttatccctgaagggtctgcaggtgaccacagccaggaagccagcccctgctatgaccctgtgtcatctgctcactgctcactgagctcagcagctgtgtcctcacaggaaactgggtgcagccagcttggccttctccaccccacctggaaaatgtgggcaggtgactgtcagcattgagatcctatgaaggggctgggagacaagggaagagggctgatttgcatgaagcaatcattccacacccttatctttaaactatatcccattaatggaagctctggggccatccaaacctgatcaatctaagaggggttatcagctggaggtggtcagagtgaggaagaaactggcttccttgaaagactcatcaacacagccaccaactctgggacaaatggggtgactccctataactgtcacccgatattagccacaggagcctgagcctagtcccctcaccttattgcttctgattctggtccagtcccctgttgtccctggacccttgcctatgtctgagtccagggtggcaggggtagccccatctcagtcaacatctatagagaggtaagagctactacggcttcaagcagagtccacagttttacccatgagggcctcttttgctcccccaccctgtcacacaggtgactactgctgtgggtctggtggagtggcccctggcccctgaaggacacaaggtattccttcctctctaacaccaggcatatagtggagaaggtatgggtgggtatagaacagattggcttttctagatgcaaatcggtaagaccctggctacagaaaaattatttcacaaaaccccacaccctttcgtgacaaaaacactcagtgaattatgaatagaaggaaattacctcaacatagtaaaccctatgtatgaaactcccacagctaacatcacgtgcaatctgaaagactgaagatatttcctgtaacttcaggaacaaagcaaggatgcgcactttcaccacttctattccaaatagtattggaagacctagccagagcaattagccaagaaaaagaaataaacagaaaagaaattagaaatgaaaaagtaaaataatctctgttttcagatgacctaatcttatatgtagaaaatccataaaacttccaccaaaatagcaaactcttctcagctaagggaccatgttctaacccaatgaagggaagctaagaaccttgataaaaggttacaggaacagctaaatggaataatcagtttagagagaaacataaataacctgatggagctgaaaaacacagcagaagaacttcatgaagcatacacaagtatcaatagctgaaccaaaccagtggaagaaagtatatcagagactgaagatcaacttactgaaatgggtgtgaagacaagataaggcaaaaaagcaggaaaagaaatgaacaaagcctccaagaaatatgggactatgtgaaacgaccaaacttacaattgattggtgtacctgaaagtgacggggagaatggaaccacgttggaaaacacacttcaggatattatccaggagaaattccccaacctggcaagacaggccaacattcaaattcaggaaatacaaggaagatcactaagatactcctcgagaagagcaagccaaagacacataaccgtcagattcaccaaggttgaaatgaaggaaacaatgttaagtggatccagagagaaaggtcaggttacctacaaagggaagcccatcagactaacagcagatctctctgcggaaaccctacaagccagaagagagtgggagccaatattcaacttcttaaagaaaagaattttcagtccagaattttatatccagccaaactaagctacataagtgaaggagaaataaaattctttacagataagcaaatgctgaggtattttatcaccaccaggcctaccttacaagagctcctgaaggaagcactaaatatggaaaggaaaaactgctaccagccactgcaaaaacacaccaaaatataaagaccaatgatgctatgaagaaactgcatcaagtaatgtgcaaaataaccagttagcatcatgatgacaggataaaattcccacataataatattaattttaaatgtaaatgggccaaatgccccaattaaaagacacagactggcaaattgggtaaagagtcaagacccattggtgtggtatattcaggagacccatctcacatcaaaagacacacataggctcaaaataaaggaatggaggaatatttaccaagcaaatggaaagaaaaaaaaaagctggggtcgcaatcctagtctctgataaaacagactttaaacaaacaaggatcaaaaaagacaaagaaaggcattacataatggtaaagggatcaatgcaacaagaagaactaactatgctaaatatatatgcacccaatacaggagcacccagtttcataaaacaagttcttagagacctacaaagagacttaaactcccagatgataatactgggagactttgacactccactgtcaatattaaatcaatgagacagaaaatgaacaaggatatcccatccttagaaaaccccatcgtctcagccccaaaactccttaagctgatgagcaacttcagtaaagtctcaggatacaaaatcaatgtgaaaaattcacaagtatttctatgcatcagcaatagacaagcagaaagccaaatcatgagtgaactcccattcccaattgctacgaagaaaataaaatacctaggaatacaacttacaagggatgtgaaggacctcttcaaggagaactacaaaccattgctcaaggaaataagagagaacatgaactcagctctggaccaagtggacctatagatatctacagaaaactttaccccaaatcaatagaatatacattcttctcagtgccacataacatatattctaaaattgaccacataattggaagtaaaacatccttagcaaatgcgaaagaatggaaatcataacaaacagtctttcagactaccgagcaatcaaattagaactcaggatgaagaaacttactcaaaaccacacaactacacggaaattgaacaacctgctcctgaatgactactgggtaaataatgaaattaaggcagaaataaagaagttatttgaagccaatgagaacaaagagacaatgtaccagaatctctgggacacagctagaacagtgtgtagagggaaatttatagcactaaatgccacagcagaaagtgggaaagatctaaaattgacaccctaacatcacaattaaaggaagtttagaagcaagagcaaataaattcaaaagctagcagaagacaagaaataactaagatcggagcagagctgaaagagatagagacgtgaataacccttcaaaaaaatcaatgaatccaggagctggttttttgaaaagattaacaatctagatagaccactagctagactaataaataagaaagaagaatcaaatagatacaataaaaaagataaaggggatatcactactgatctcccagaaatgcgaactaccatcagagaatactacaaacacctctatgcaaataaactagaaaatctagaagaaaggatagattcctggacacatacaccctcccaagactaaatcaggaagaagctgaatccctgaatagaccaataacaagttctggtattgtggcagtaattaatagcctaccaaccaaaaaaagcccaggaccagacagattcacagctgaattataccagaggtacaaagaggagctgataccattccttctgaaaccattccaaagaatagaaaaagagagactcctctctaactcattttgtgaagctagcatcatcctgatatcaaaatctggcagagacacaacaaaaacagaaaattccgggccaatatctttgatgaacattgatgcgaaaatcctcaataaaatactggcaaactgaatccagcagcacatcaaaaaacttacccaccacaatcaagtcggcttcatcgctgggatgcaagtctggttcaacatacacaaatcaataaatgtaatccatcgcataaacagaactaaagacaaaaaccacatgattatctcaatagatgcagaaaagccctttgataaaattcaacatcccttcatgctaaaacctctcaataaactaagtgttgatggaacatatctcaaaataataagaggaatttatgaaaaacccatagccaacatcatactgaatgggcaaaagctggaagcattcactttgaaaaccaccacaagacaaggatgccctctctgaacacttctgttcaacatagcattggaagttctagccagggcaatcaggcaagagaaataaagcgtatttgaataggaagagaggaagtcaaattgtctctgtttgcagacgatatgactgtatagttagaaaacccaatcatctcagcccaaaaactccttaagctgataagcaactccagcaaagtcccaggatacaaaatcaatgtgcaaaaatcgcaagcattcctacacaccagaaatagacaagcagagagccaaatcatgagtgaaccctcattcacaattgctacaaagaaaataaaatgcctaggagtacaacttacagggacttgaaggacctcttcaaggagaactatacactactgctgaaggaaataagaaaggacacaaaggaatgaaaaaacattccattctcatggataggaagaatcaatatcgtgaaaatggccatattgcccaaagtaatctatagattcaatgctattcccatgaagacaccactgactttttctgcagaatagaaaaaagctactttaaatttcatatggaaccaagaaagaacctggataaccaagacaattctaaacaaaaagaacaaagctggaggcatcacaccacctgacttcaaattacactaccaggcaacagtaaccaaaacagcatggtactggtaccaaagcagataaatagatcaatggtacagagcagagacctgagaaataacaccacacatctacaaccatctgatctttgacaaacttgacaaaaacaagcaatggggaaaggattccctatttgataagtggtgctgggaaaactggtagccatagacagaaaacagaaactggaccgcttccttacaccgtatacaaaaattaactcaaaacggattaaagacttaaatgtaaaacccaaaaccataaaaaccctggaagaaaacctaggcaattccattcaggacacaggtgtgggcaaatactttatgatgaaaataccaaaagcgatggcaacaaaagctaaattgaaaatgggatctaatcaaactaaagaacttcggcagagtaaaagaaacaatcatcagagtaaacaggcaacctacagaatgggagaaaatttttgcaagctacccatttgacaaaggtctaatatttagaatctacaaggaacttaaacaaatttacaagaaataaacaaacaaccccatcaaaaaatggactaaggatatgaacaaacacttctcaaaagaagacatgtatgtggccaacaaacatatgaaaaacagcgcatcatcactggtcattagagaaatgcaaatcaaaaccacagtgaggtaccatctcacaccagttagaatggcaattattaaacagtcgggaaacaacagatgttggtgaggctgcggagaaattggaatgcttttacactgtcagtgggaatgtaaattagttcaaccattgtggaagacagtgtggcaattcctcaaggatctagaaccagaaataccatttgagaccagtaatcccattcctgggtatatacccaaaggattataaatcattctaccataaagacacatggacacatatgtttattgcagcactctatgcagtagcaacgacttggaaccaatccaaatggccatcaatgacagactgaatatagaaaatgtggcatatatacactgtggaatactatgcagccataaaaaagaatgagttcatgttctttgcagggacatagatgaagctggaagccatcattctcagcaaagtaacactgaaacagaaaatcaaacactgcatgttcatactcataagtgggagttgaagaatgagaacacgtggacacagggagggaaacatcgtataccagggcctgtccgggggggctgggggtcaaggggagggagagcattaggatgaatacctcatgcataccgggattaaaacctagatgacaggttgataggtgtagtaaaccaccatgtcacatatatacctctgtaacaaacctgcgggttctgcacacatgtatcccagaacttaaagtaaaataaacaaacaaataaataaataaataaataaataaataaaataagtcccaccaaaacaaaaactgttagaactattaaatacatttggtaatatttcagaatacaaaatcaacacataaaaccatctaatggacagccatgatggctcatacctgtaatcccagctcttggggaagctgaggtgaaaggattggttaggatcaagagagttcaataccagcgtgggaaatgaagtgagaccctgtctcaaaaacaaacaaacaaacgaacaagcaaacaaacagggttcttatatttctatacttaatcaaccaaacaggaaacaagaagacaggacacaacgcaaaatgaaattaagaaaacaattcaatttacaatagcatcagaaagaataaaatacttaagaatcaagaaggggactcttctatactgaaaactataaaacattgctaaaagaaattaaagaatacacaaataaatggaaagaaacattgctaaaagaaattaaagaatacacaaataaatggaaagaaaacatttgttcatgaattgaaaaacttgatattgttaagaaatcaatacaaaccaaaagaaatctacagattcatttcaatctctattaaaattccaataatttttttgcaaaagtagaaaaaattaattctaaaatttacatagactatcacaggactccaaatagccaaaatgatcttctaaaagaagaacagtgttggagatttcacacttcctgatttcaaaacatactacagagctacaccaatcaaagcagagtggtacagatagacagacacagagacaaatagaatagaattgagcacccagaaagaatctcttagttatatgatcaaatgattttaaataagggtagcaagaccattgagtggggaaaggacagactccataaaaaatgtttttgagaaaactggatatccacatgcaatgtggaaatggataaaagacccaaatggaaaagccataactgtaaaaatcttaatagaaaacactaggaagaagtttaacaacattgggtttggaaatgatttcttgtatttgacgccaaaagcacaagaaaaaaaaaagaaaaagaatatagataaattggatttcatcaaattgtaaaatttatgtgcaacaaaggactctatcaacagagggaaaatgcaaatcatggagtcagaaaatattttgcaaacattgtatctggtaaggtgtccaggatatagaaagaactcctacaactcaacaggaataaaaaaatagaaacaatctgaataaaacatgggcccaagacttgaatagatatttctccgaagaagatcaataaatggccaataagcacatgaaaagatgtttagcatcactaatcattagagaaatccaaatcaaaccacaataatacacaacttcacacccagtaggatggcgttaccaaaataatagaaaataacaagttctggcaaagatgagtagaaattgtggagaaactataaaatgatgcatccactgtggaagccttatggcagttcctcaaaaaattaaacatagaattaccattttaacagaattttcacttctgggtatgtgcctaaaagaattcagagcagggtctcaaagagaaatttgtacacccttgttcatagcagcattgttcacaatagctaaaaggtagaggcagcccaagtgtccatctaatggataaatgggatatagtatacacacacaagggaatagtattcagccttaaagagagtgttctggcccatgctgtggcacagataaacctgaaagacatcatgccagcagaaataagctggcttcaaaagaacaaaaattgtttcattacccttatatgaggtacctagagtagtaaaagctaccgtgacaagaagtataatgaagtttcccaggtccttggggtggagagtagggggagaatggacagttatttgttttttgtttagtttagttttgctttgttttgtttttgagactgagtctccctctgtcacccagtctggagtgcagtggcacaatcttggctcactgcaacctctgcctcctgggttcaagcgattctcatgcctcagcctcccaagtagctgggattacaggcatgcaccaccatgttcagctaacttttggtattttttagtagagatggggttttaccattttgctcaggctaatcttgaactcctgggctccagtgatccaccgaccttggcctctcaaagtgctgaaatcaaggaagtgagccaccacaccgagccgggcagttcttgtttaatggttgcgaagttttagtttgggaagatgaaaaatttctgaagatgaatggtagcagtgtgattgtacaagttgatttacttagtgacactgaagtgtacacatgaaatggtgaaggtaacaaattttatgtttgaatattttaccacagtcaaaaagaggaagatttatatttggcaccattgctctacttccaagaacagtagaaagatacagtagtaggagagtgtgcacaagtatccaggacgtctttcattttttgccagccctgcagcatcctaacaatccaagagagcaggaggtgtctcattacaggggactcagaataatgtgaagaaatctggggcggggtgggggcataatgatagcacacaggtgccggacccagtccaggagtggccacaaatgcaagggctgcagaagagggggagatgaagctggtggcagtggtagcagctgcttcagctggaaaggggcatctgttgctttccaaagtggttcacagttgaaatatctggcatagatacttcatcctgcctacctttcatgactaactatattttcattgcaatatatgcagtcatagtgagaatacctatttcctccagatacaagcaaacgtgaaggaaatgtgctttagtgctttggccaacttgacatggcagtcacaaaaagaggatgaatatccaaagacaaccttttccaaagataaggttattataccgtttattgtaaatactggaagtgcacaacaatcattcagacacctgggaaaatgacttgaccaaatacagttgtgaaaacaatgagtaaagaaagtgatatattcttggtaaaagaaccactggatctagtgagtaaagaaccaaaaggagatgaccctagattggaacttttagaccaggaccttggtaacattggtcctgtttatgcaacaaaaacaaagcaataccttgtctaccagtgagaatctgaatgagggaacagcaacaggaagcagcagaaaaaaggaaaagaagctcagtgcaaacagctgaatggggagatcacagggaccaccaagaaggcccagggttttctgctcagtgccttccctctcatacaccttagagcacccactgaacaaagataactaccagtatattctagctgagcctgatccccacgcccttggtcctcagaagcttgaacttgactgctgggcaaaattccttattcctggagacctctacagaggctgcttgtatgaacaggttttgttagcctgacataattgagctccccagttaaaagtctccaatgacctgctggctgactgtggttgaacagaaggtctactctatggtacgggattctcatgggttaccttgatatcaccatggatgagatgccaccagacactgctgccagactgggttggtcccagtctttagataactgtcaagcttccttagtttatgataagtttaactattcttgggagaattaaagggaatgaagttccaccagtccactggcaaacactactcttctagctatagacaaggagacatcctgggattttatatgaatcttcctgaagaaacaaagacagtcaagtcattgcctgatacttacaaagataaggccttgataaagtttaagaattatttgtgttttgaggaaaaagactttgtgactgaagcagagaagagcctaaaagagacttcccacagtgagataagattttataaaaatggtgttagtcaaggcatggcttacaaagatattttcaaggggctttactttccagcaatcttaccagaaaacaactgcataatttccatgaacattggactgtgcttcaagtatcctccaaaggatctcacttactgccctatgagtgacatgggctgggatgctctggtagagcacactctggctggtgtcttggtgctagaaatggattcaatcactggacaagaaagtccttcaggggcaaacataaggacactgagggtcatcttattctacctgccttctctccttacttgtatcctaggccagcctatgctagcgcaactgtccacagatctctctctctctttctgtctctctctcgtgtgtgtgtatgtgtgtgtgtgtgtgcatgtgtgtatcaaatgatcaaacatcttcattcaaaagtccaagccctgcagcatcatgagacagtgctaccacacatgaagaaaatgttcaaagggcaccaaatagagatcgcatgatccaaagttatttctgatcccagaaaagaatggcacacaatcaatatgaatagtattagatatcaaaattatagtacaatctcatttgtttttaccatagattcaaactctctttagcatattggaaagcagaatccatgttctactgatgcaattccccttgaccatcatgaaagaattggactgaaagcaggacatttctgaagtctctggaggatacgtaacatgactgttggagggaatgcacataggaagaggtagtgaattatgtgtcaagtgccccaacaaaaggctgtcagtgtttgtctctgacacattgttggggagaaaggtggagtcacaggacacactgccatgggacccacgagacttgatcctacatcccacagcgggcagcctgcatcaacgtggtcatgcagggatagaaacacagccacagaaagctttcacctgcccaagcagcatctcccaagagccagcatgggtgctgtctctgctctgcttcttcctggactgtgtctcagagccctgagttctccctcacccagtttcccaatccccctcttctccactggttaccaggggttaggggagtggggaggggaaataaacgtttaaagggtacaaacttttcacttgggatgatgagaaagttatggaaattcataatggtgatgactgtatcacttttttttcagaggtggtaacttgctctgttgcccaggctggagtgcagtggtacaatgatagctcactgcatccttgaactcttgggtctaggcaagcctcctgcctcagactcctgagtagctgggactacaggtgcaagccaccatgccaggcaattctatcacattgtgaatatacttaacaccactgaattttacagttaaaagtgatttaaatggcaaattttatgttgtgtgtattctatgacaattaaaaatacacttgttcaaatgtcaaaatatatatgatgttatattcataaaattttccttttcacacttatatatttatcctattctaactcattctcatcaattaaaaaagtactgtaattactggtcattatgtactaaattttccataattcacattgaagccttaacccccaatattactgtatttggagacagagcattacagagggtaattaagatgaaatgagatcataaggaccggcatccttataagaggagattagaaaatggacaacataaaatgagatgaggacagagtgagaaggtggtcatctacaagtgtggacacatcttcagtttgtgtggagtaacagttgaagggctcgcccatcctataatgaaagttggaacaggtgccttgggcgggctccaggattaactgatctagtcactgcatcccactgtgggaccccagagggaaagaagcactgtggagattcctgagacattagaaatggagcctgagaaatttccaggacacccacatgggctccaggtgaagcaggggcccagaaggccttgtctgagccctgagtgtgacgcagcacctggccactagggggaggcaaactctgtgaatcctaagggacctgagctcttgctctgagccctgcccttgttaatcaccagccctgggagggagccgatttgcatggaatgtgatgtccctgcccacttcttcactgagggaataagaggctttagggcctcaggctcagctgagagactgaagaacccagcattgcagcagctccaccatggcctgggctcctctgctcctcaccctcctcagtctcctcacaggtcagggtgggcagtgggctgggcccccaaagggacccccacctcccagcctccatctccccatccctgctcttcctcctccaacagctcatcagccacccaccaacaggagccctcatgggtgtctgtgtttccagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaagatgagagtgactaccactgtggggcagaccatggcagtgggagcaacttcgtgtaacccacagtgacacaggcagaggggaagtgagacaaaaacctcccggctgatctgctctgtccacacttccttcccactggcctgactcacatttcagagggctgtctcttaactctgtatttaaagttttcaccttcccagacattttggagttctaattcacagcatatgttccctgtgtgtaaatattttctcaagagcttttgaaacattgaagtttgcacaccaacatttgtggtttttgccactcacctgtcccctgatgggattgaagtttccaggttgtggaactgctcacaggtgcgtttatcaggaaatcaccgtcaccagctcccacgacctttgtccatattcaacatttgtgagctgcctattcaatgatgggaactgacaatttccctggagacacaaggccttcaccctgactcacagtgtcacataatcgacgtggacttcagccatctccagtcacctccatgtgcacagagctctcatggtacatgtgcttggctgccctagaaagagagaatggacacacaccaaagatagtagaatgtgagcctgctctatatctgagattctgaaagaggcccccactgccttcacagaatgaattccttcacatgcagggagagagctctggtggaatcactctgcaatgctttctgatgacaaatacctggattgaggtcaaatttcacaggttaataacccttttcaagactacctccactacagactccagttcccaggcattaagcctgaggacccttgtagacaaccaacatggggctgtgaccagcaggagcaatgggtaactgtcccaggccctgccttggggctgctcacagccgggtgagccccactggccacaggctggcagaggctgagctgctccctgtgctcgctgatgaaactcagcagcctagtgctctcagggtccagcaaagcctcttgggcagggtcctgtgcctgttcccaacagccgctccttcgaggaccctcctaggcccacactcgagcagctccttcctcaacctcctctgtcctcacatccccttttgggttcctgaatcagtgatcaggtagggtctcatttagccagaagggagggagtagatttgcatgaacagcttcttcttttccctgagggcagaaggaaaaatagtcaagcctggggaagcccagcccaactgtgaggtccagaggctgtgtccaccatggcttgttgcctgaactcctctggtacccaatccttggtctatgtttatagactcaatgaaaatacctccctttctactggcctcttaatgctaacagaatcattttgtcccctaagcacaaatagcctttcgggttgctgggtgggatgacaactagagcagaagtctagcatgtgcaaccccattcctggcccatacatgtccctgctcttggcccagtctttgctggttactccctgaactctgaaacttcagggaagttgagtttctctttctcttgagattgtactcttgaggagctcctgaatttccaggtatagggtgacccctcctcattaaggacatggctctcagacttatccctggtttacttccccaggtttaggtctgtgagttctaaacagtttccctatgtttctttggttgatattttggttgatatttccctttgtttctttaggttgatattacattgggtaattacattggttgattacattgggtaaatatattcttgtagatatacacattataaactcttcccccattaagctcttaataaataaacttgtttgggtgccaatgtaccaatgtaggtaagaagtcttgacgcttttttttttttcttctgcaggagcagaggagaacctgaaaaaaaaaagagagagagacaagttcagcttataatactgttattttcatataaactctcctactttaaaaagtacaaaactagacctatactgaaaatatttttaaatatatcagagtatctgcatctgtcactgtggagatggttgcttgctctaccacagagcacaataatactgagcctcatcttcagcctaggcccctgtgatggtgagggcagtcttgtcttcaagcacagagtgtgagaatcaagtggggaccccatgcagagatggggacgtcagacacacacaccctggctcagcctcacctcatgctcctaacatctccatcttcttcacacagaggctgctgctgcttctggctaacacgggctcctgacgctggttctccagggcccaagagaaagtggtcacatatattcttctaagctgcaaaatttgtatttttaacccaacatgttattataacaatgtgttcataaagcacaatactaagatctatcatcaattgcacagttatgagttatttataggagtggcaaaataaaaagttacgcacacacacacgcagattcgggcaggccagaatttaattacaggagcaaagtttgatattagtgacacaacataacaatgatcctatgtataatgataaacatagcaatggaccatatgaagctttgaagaaacatagtggaaacacagaaaaaatctccctctcaccaaattttagaaaattctaaaaaaaattaaaaatttttaaaacccctcaaaactgagttaatttataaaatatgatacaaaacataaagtttacataactttaacactcttcatactcagtaaatgcaggttctttctccacaatttaatccagtgtaccaaaaccgagccttcctgtttgctggaggaaaacctcagcaccacaacagtagaaaagcaccaacctctctgcccacagtgcatcttccctccagagactccgcaggactctgcatggtctcctgagggccctgaagtggaggttctgtgatgagaagggggcatggatggcacagggcaagaatgtctgcagggtaagagtgttagaaggacaagcttcattcctctctgaaacaagcctatcttacatgatttatctttattcttctctacaaaaaaaaaaaagtcacaaagatagctgcaaagaaatatgtgaaattatacaaggctaagataacaaagaatattggaagaaaaagtaattatgacatcttctatcgaaacattttaggccaagcgtggtggctcatgcctgtaatcccagcatgttgagaggccaaagcaagagaatcacttgaggtcaagagttcaagacaagcctgagatcccatttttattttttaaaagcagcattaaaaaaaaaaggttcatcatagtctcctcttcccacagttaataatgagaatggagaaagttcaaaaagtgaaaatttaagcaactcttatgtacccataacaattttttaaattttgaaaaagaaatgaaacccgtagcacaactgaccaccagcacacaggtgcctcttcttcagctgcccctcctgaagtgacaaccaaacccaggggctcagcacaatgagctctccctctggccatacattccctgtgaggccccatctactctcatcccaacacaattgctccccaggcatctggggactgctgctgagattctccactcatggggtcctgggcacagcggtgttatcccagtccccctcttcctctgtgtcctgggagctggaatcagagtcagcctgatctggcccaaagcctacaattaagagccctgagtggcctctcctgctttccccccacattggactcttcctttcagtgtccttcctggggtactgtgtcactactcaataatatcttatgtcctcagtgctaggcgtttttcacataatatactcttgttagtttctcctcacctttccaagctcagttatcaactctaggctgatgatcctaactattcatttacagcacattgtcatataaaggccagcgatatctagaaaaaaaagtgccaataaatgtgtgtactgcatcttacgaatcactacaaggataccacaaacaatatccctgtatttaaatagagttcactcttcagacacaagagtttaagtggagttcaatataatagtttatatagataatagttaatataacagtttaaccagtctgtctgtggctaaaccagtcaccatctcctgcactggaagcagcaacaataagggtcttgggcttgtgtcctggtaccaacaatgaccaggaagtgccaccaaacctctgatacatatgtacggatccatatatttatatccatatcctgcggcgaatatccacctgcagggatccaggactgaatctcaggctaccggtctggcaaggaggcattgctgagcatctctgggctacaggcttaggacaaggctgatctctgctgttggctttaggcagctccatcgaggtccccacagtgctgcagtctggggaactgagacaaaggcacaccaggtttccaatgagtatgagctacctgcagcaccacccactgtcaggacaactgggctctttaccgtttgtgtgtatgtttcctggtgctgccactaaccagtgcccaggactcaagtcagggacagtgatctagagaatgcagctttgttctttcagagccagcccacagagggagcccttagcaatggcacattgtcagactgcttcaaaagaatcagaaagcctttgattccaggaacaggctgctctggggacagacccgagatgggtcaggggaggcagggacagattccaggtggctctctctcaggcacatgcactaatgcagaggtctaatcatccctattgtctactgaacaactactatgtgccaggctatggggagggctcaggatacagagttaccaagacagacaaggttcctgtcttcatagggctgacaccaaactaaagagagacagtcaagaagtcaatgggaataaggcatattgtggtgtatcaaagaggtgacactggccagaagggggagaatgatagaacgcctttagtgggtcgtaagcaaggaagacacagccttttgtttgagatttaggaggaaagtccagcttcttcaaggaagacaaaaaatgaggggatagtgcgaaggcaaaaggtccagttagaaagcagtggcattgtgcacatgagagatgaggtatctagcatctgatgtagcagctgagctgggaggaatgtgcatgacccacaccatggtgagaaggactagaggaaagaggtcactaggttgaggccctgaccttgtccttgtgatggaaacctgacaacagcctgcagctgcgatcaagcatgtcactctcctcttctctctggaaagctcataggactcaggactcattgctgcccttccctcttattcagtgagatttatttgaaccatcacttttcacacctggacagagacctgcttactttctcttgagcaaaagcactaagggtcgggacagagcactgtagagcacatgggatgatgccctacacactcaaggggctgctgttactgctgttaaagctcacgatcaaacctcccagagctctgtcagaaaccatgagacgggaggtgtcagtgctgaagtagctgatttgggggcacactgatttgcagtctgtgcagtcctgatttggaggtgtgggacagtgagggctgaagcccagcatcggcaagaggttcctgaggtgtctttatgtgccagggtccttgtgaccacctcagtgatgtgtgggggtaaaggtcaattgaaaagctggagagcagtggacaggcaggattctgtgtctgggtgagggacgggatgttcagctcctgcccaggcatccttatttacatttctgtttacctctcttcttccttgtctccttcccagggcagggttccagggctgttgtatctccgctgctctttctccatcacaaagagagcaagagagacaggttatgtgatgactaattccctcttcacactcagttgtctgattgtccttaggaattcttcctgaggatgggaatgtgctgttttatttctcccttacagtgagatcctagccatttgtgaggccaaggagattgaccccatcctgtcgatgaaggattatttataacacacatggtcaaaaagaacatcatcaacttctgcacaagtcagtccattcgtcagggttatagaagtgcacgtctctcagctgtcagcaatgggcttcaaatccccaggatgactaacttgtcaggatgggatcatccacattaagatgtttctttacagttagtgactctattcactgtgtttcccctgctgagatccaacctctatgagattgtttattggctgttttctgtcttgttattgctgaaaacacttcctggcactaaggacagactcaatacatgtttattaaatatgtgagttcacctacattggaatcccaggaagaggtacaaacctgaggtcaagataataatttttttaaaaattctgaatattttgtgtttgagattccaagttcattcaatggaagatactaagtaatgacttttgcctttggatttggttagcaggagaaggatatggatataaaaatgcaaatatatatatcacacatacctccccatggcccagagacctgaaagcccagctggtctctgcagctgccaattgcagcctctgttcactcatttatggtctgattgtcatggatccatatatactggatcccatgggttcatgtggagaaagtggagaggatgcgatgggctttcccagtcctgataaaagaaaccacaggaagcgaatagatcataaagcaaattctggggacagaaaaccctcgagagcaaataaactgctaatatgggtgagttgggaaaatgtctggcaatatttatataactaagaaactttacattagatatccttccttcacaatattcattacggagctttaaatcatccatatgatcaatgcaattcaaacattaaactcatcaaccccaagtcccatagcagactttgatgaggaaattcttgaaggaagaagggtgggtttgtgagctctgtgtccacagaagagatatttctccactaggagaactgggtaaagccaataaataattaggaatgtagatgcccaactggactatattctaatccaatatgcaatgctgtgagtcctgcatctgcaaattgttaacattcattgtgcttccttcagtttcccaattactacaataaattaactttagacatggatgattacagaacagatcaattaatgtgagagtccttggaatgtgttgctttaatccacaaaaattacggaacacttcaaatgtatatatttgttaatttatgtaccaattgtattttactgcttcgttgatctgttgtaaaaatcacccagtgagggagtaagctgatgggtaaaatgggttgaaaaattaaacaagatgaaccacattgatgatggtcaaatttggctgatgggtgcaaacaattcattagaaaagtatctgtatatttgtatggttcaaaagtttccatgctatccagtgtttaaaatatccttgtttgtaactgttctgcttttaaccggtgtacaatgtggacaaaatgtaagcttacactctgactttgagtagaagcccatcttctcccaacaggcagaggagaagctggtgtggagaacatggaaaacacaggagctcagggtttcccaggacagagaagcgagtgagcctggagccctaaaagcaagggtggggctgtgagttgggctgtgggtgtgtgcaggggccacagtgtgaagggcatgcttcagaggccacaggatttggattttataataagaatgatgagttactgaaggggtttaagccaggtagtaccttccctgcctcatctatatgagagggatctgtatccaaatgcctggaggagagcgtgcctgagaaaagtgagtgatcctgattctagattattcactaaagcacctcgtgagtctagaaacccaagggccatttgcacagttagcacaagagtagacgtggcaacattgagaagtgatggtctctgcctttgtctcctctggcattcaatacttgcaaaaacactttgcaggtaaaataaatactgatatttcaaataacctgaaagcatccagtaaaaaaataaaggtggcaatatcaagatacaaacaaattgtataacatttaggacaaatcgtttaccaaaaaatatgacacgactgtgaagaaagtgacgttttacttagggagataatggctaacctcttaaaacagagatatatgtcacactgtgacaggaaagtctacaaaatctcttaatgttcctacatcacaaaattgagtcaaatctctataaaacatatgaaaccattagatgtataacttttgctaaattgctgtctttaacatgtattggatcatttatttttcctggaaaattctcattcttcactgtccttttgaacaaccccagctgcccttcaacccagctcctcagctgacccatttttcatgatgcccaccctgatggcacatgtgggcaactcgatttttctagaatgccatgcaggggtgctgacaactttaaaagttatatagtacatggctgcacatcccacagaccaagactacttctgggagtgagaaatcacagtaataatgcatagcatgatagaagcagtgtctgggaatcagaccatggatatgtgaatacagacagtgactggagagctgcagagaccagctgggttctgaagtctctgagctttgggaaagtgtgtttcctgggaccagcgtcggatgttgtggggctgccctgtggttctgacacagctgctcagtaaggagcattcactccaagaaatccaggccttgaggctgggccctgtgctcactgatggagacttggcagctgtgtcccctctggcctggcagagttccctgagcagggacctgtgtatggtctcaacaggtgcttcctcccagggccttgcaaaaagaaaagcaaaccttcctcctgctcagtctgcagagagagcagagctgcatccccaggtctcaaggaggggcccggcaatccctgggtggaaacacatttgcatgagcagcccctcctctgcaagggtgggaagaaaaggaggcctggggcagcccagtcccactgtggggtaagcggctgtgtccaccatggcctggaatcctctcctcctcctgttcctctctcactgcacaggtaggaaaaggcctcagagaccagggtcagccacacagcctgattctgactcttgtgtcaaagatcactaaaaaaaatattaccttggtttctgtcttaaagcctatatatgcctgtgttccaggttccctctcgcagcctgtgctgactcagccaacttccctctcagcatctcctggagcatcagccagactcacctgcaccttgcgcagtggcatcaatcttggtagctacaggatattctggtaccagcagaagccagagagccctccccggtatctcctgagctactactcagactcaagtaagcatcagggctctggagtccccagccgcttctctggatccaaagatgcttcgagcaatgcagggattttagtcatctctgggctccagtctgaggatgaggctgactattactgtatgatttggcacagcagtgcttcttacagtgacacacacagatggggaagtgggacaaaaacttcaccctgatctgggtcttgttctgtaacagtttttaaattttaaaataaccagccaagggacaaactaaatttggaaataactttctagttgtaaaaggctcttctctcaatttcccatccattcttctgaagtctcagtaaaacaaaaccaaaccaaagcacctgatgaccctgaagtgttggctggttgtccatatgtgctaacaccactgcctgcggagctggacttttgttcttgaaagaagcaaaatgaggctttcctagctcacatcatagtcagagcctggggacatcctagcaggtgaacagtcccctacagcatggactctgctcttccagcgtacaagcagagacctccccttccatccccactagtctgttctcagggctgtctgaggctcactgtgtcccaggaacaaggcactcaaatatgaaatgctgcctgaggacacaggtcagggaattccagatatagtgctgacctggctcagtcctgggtacctgcatttcagtggaaatgtcaggagatgggattacgtctgagggtaactgtggacctgaggccggtaaacctctatgtaggacatgagagagtcaaggggaggctccaccatggctgaggcaaggctgaggctgctccttggccatgggggaagtaggtcccagggatgtgactttcctgcagctcattccactcaggaccacggggactgctgagggtgggtttgctgatccctcagggcctgtgttctcttctcctctattgcaccattggaggttctcactgagtcaggttctagtagtgagtctgtggaacatctgggtacagatactgtttgcttcaagtgactcctccccaggaaactcttgagaaggcccccatctcaatgtcacctttttctgcatggggagcagcagaaacattgggcattccctcccagaaagagcccctaattttgtgacttaggacatcagcgattgtccctcaggggtccaagcctgattctcctgctctgggtttattcccacagcctcctggacaacttctgcgctccagcctgaggactggctggttatcagtgtcacacagctgcatcctgactccatgttaccaagggttcctattccatggggaaatgagagaaagatctgccccactcatcctctctgccccatccctcctttatccttgcctgtgaccaacaccagttcatgccaagacttttactgtcacttgtgttactgaaagcagagcaagggtgcagggatgataactccttttcttactggtctccccaatggaaacagaatcaacttgtttctagaagcaaaaggagctgcccacacatggtgggtgtggatgaggtggggatgacaagaaagaatccagccagtgtgacccagaagtccaggagccttcagcctggtcccacaggtgtcctctccttttggtgcaggtgtgctgatcatttcctgagctctgaatctgtgggaaagatgacaagaaaggagaatccagcctgtgtgacccaagacccatatgtgagagcggaagtctgacacttaagaaaacgtgggctcagcattctgagaggtctggatctggctcggcctagagctgctctagaagagaagcaagagaaatgctcagccttaggtggcccaggcacagtggtcctgtcaaaggtctgagctctctgcaacatggatatcctgcagagacatccttgggaggctgtgatcctagaatgatgtaaaaatgctaatggaagtgagcaggggatggtttatggaggaatgaggagatgggtgtggggtcagatgtggtaaggagggtgcaccctgaagaggagactgtccattgtgactcataggagaaggatgcccggggcctagggcagtgacaaaaagaggacctggaaggaccggcaccctgaagacacgtagagactggggtttggtttgtctgtgagggttcctgaggagaatcacataaaaaatccacagtcagtgtcttctgtccagggctcactgtcgcaactgttgccccttccttccagatcctctgggtgtccaggttccttagccgtggatctgctcctctctctgccctcagcctaagagctgatggggcatccaccaggaagcgcatccgtgggcagggaggaggccgtgggcagccttctcctgtatgtgagacactgctcagcctcggtgaccccctgttcattaaggtgggaggaaaggaaaacaaaattcactgtgaacatctatgcatcatcaaagaaaaagcaatgagaagaaacaggaagtgaagcccagctctaatagtttatttctacttggaaataaataaaacaatatgcctgatgtgttatataaacacaataaactttttataaaaactatgaaaattatgtaaaggagcatggcttacactaaaaggaacatttaaaataatgacacccttgaaatgcaatcccaaaacacagcatccattttatttcagttacatatacggactggttttatttaaatgcctgcaataaatctcactattttgttgtttaaatggagcatttaaaatctcattgtggccaggcgcggtggctcacgcctgtaatcccagcactttgggagtctgaggtgggctgatcacaaggtcaggagttggagaccagcctggccaacatggtgaaacccagtctctactaaaaaaatacaaaaattagccgggcatggtggcgcgtgctggtaattccagctacttggaaggctgaggcaggagaattgcttgaacctgggagatggaggttgcatttagctgagatggtgccactgcactccagcctgggcaacagaccaagactccggctcaaaataaataaataaataaacaaacaaataaataaaaaatctcattgtattgcaactgtctgatgatacattcacaagtataaatatcaacataaccatccagctgtttccctccatccacgtaaaattccccaaacaaatatttgttaagagtccagggtgtatcatgccagaactcatgcaatcataaacacaatctatttcatttttcattttgattaacagaattatcttttttcttaagattattgtttttagtttattagattctagatgtcattacagaccaaagatgaataattttcatcatcttcaagccacccccacaagactcactactgaatttgaaccataatttttccctggaaatcctagttggggtgctcgatgctaagagctatcacatatcaggctcacctgaggacagactctggtcgtcaaaccaagttaaaattttaattcttcccatgttcaaagactgaacatctttgctctttttgctcataagtgaaacactccaaagacatttgccaggatcccccacagactggcattcagtgcttggaggacagactcctaggcaagatccttggtcacagtatccggatgactatgactgcaaatctggggaagtagagggagaacaaagatttaccaggaaaaccctctgggaattcctccccagggcatcccagaggtaagagctccctttctcctcagcgcagcaggatccacagaggaagtggagccctggccaccagggaggagtcacatgagaggagaggacccggtgtccaacactggtggggaagtgagtccatggggccggtccccgctctgggcttgatcctgaaataaaaggactttgtgtagacatcacctgagtcctctacaatgtacagccaaagagccatagacagattcactcctgaggagtccagtagagcgtgaagactgccctgaggtcacaggagggagacacaggtgccaccttactgggccgggacttgggagcgggggcagtggccagaaaacagggcggggcggaggcagcggtgaatctcagaggctctggtcacctgatcacagaacggtttgccttagtctggacactagggggcgcttggggaccatttctgagaagacttggggtaatcagagcagaaccaggcacctgccctgcctgatgtcctctgctcagggctggcagctgtgtcctgtgtcctccccaccccctgggaccacaaagctccacccctgccacaccctgacatactcaagcccaggagcctgacccagggctcagggtggggtcaaaaaccggggggatctgatttgcatggatggactctccccctctcagagtatgaagagagggagagatctgggggaagctcagcttcagctgtggtagagaagacaggattcaggacaatctccagcatggccggcttccctctcctcctcaccctcctcactcactgtgcaggtgacaggatggggaccaagagaggggccctgggaagcccatggggccctgctttctcctcttgtctcctttcgtctcttgtcaatcaccatgtctgtgtctctctcacttccagggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgagtggtcccacagtgctccaggcccagggggaactgagacaagaacccccttcctcctctgtcaggagggtgagccccggcagctgctgctcaggcccggcctgtggcttctgctgctgtagcttcccccatgggtccaagggcatccagggccctgcctgagagtggaggctcctcctccccttcatcctcagagtcatgaacaggctgtccaggaaacagaacatcctgcttcctgcaacttgggacacagggtctctgcactgaagtcctggactgaggtggcaggtacagctgtgtcgtcacagacccacctctgatgggaaacctgtgtctctgtcatcctccttttcccatttccaggagtttccagagtggtgtcttcctccccctgctcctcagtgtgaatccctgtgcttcctttctctccagccaattctttttttaataaaactcctttcatgtaggaataatgcatatttaataaaccacccagatttataataggaaattagacaaatgttgacattttttgatccttgaatacatcaccaccaacacgcagctatgcaacctgtgaccaaccccagcaacccctcatgaccccttgtcatctccctccctcccttccccagtgctatcctgtgcagccacagatctgtctctgtcactattgtttgctttccattttttggaatgtatcagtgttatcagacattatcttcccatttgttctggcttttttcacactgcaaactccttttgggattcttcctgttctcgctgaattgcacccatcccatagagggctcattactacctttgagggcctttaggttgattattcctgattttgtttatttattttaaagtttgaatttatcgtccatcaaaatcaaactcttggagttatgttcatctaaggtgacaggagagtctgtgatgtcttgtcgggattcttgcttcttcatctcttgcctctcgttctgtctatattggaagaggttctcatattctatttatttacttatttatttatttgggtttttaaggatttcagtgtttttttctctttaattattaatttttttattttaataggtttttagggaatcggtggtatttggttacataaataagttctttagttgtgatttctaagatattggtgcactcatcacccaagtagcgtacagtgtacccagtgagtagtcttttatccctcaccccgcttctaccatttcctcccagtcctcaaagtccattgtatcattgttatgcctttgtgttctcatagcttatctcccacttatgggtgagaatatgccatgctttgttttcaattcctgagttactgcacttagaataacagtccccaattctatccaggttgctgggaatgccattattttgttcctttttatggctgcatagtattccatggtatgcatatatttaacatttcctttatccatttgttggtttatgggcatttgggctggttccatgttcttgcaattgcaaattgtgctgctataaacatgcgtgtgcaactatcttttttgaataatgatttctttttctctgggtacatgcctagtcccagattttgggactttgctggatcaaagggtacatctatttttagttccttaaggaatctgttttccatagtggttgtactagtttaccttcccaccaccagtgtaaaagtgttttgttttcaccacatccatgccaacatctattattggccattcttgcggtattaaggtggtattgtattgtagttttgattggtatttccctgatcattagtgatgctgttcatttttctttatgtctgttggccattcatatatcttcttttgagaatttttatttatgcctttagcctactttttgatgagattgtttagtttttttcttgataatttgtttgaattctttgtagatgctagcccttagtcattaggtggatatgtagattgtgaagattttcttccactcggtgggctgtctgttaactctgctgattatttcttttgctgtgaagaagctttttagtttaattaggtcccatctatttatctttgttcttgttgcatttgcttttgggttcttggtcatgaagtctttgcctaaaccaatgtctagaagggtttttctgatgttatcttctagaatttttattgtttcaggccttaggtttaagtctttgattcatcttgagttgatttttgtataagctgagagatgaggatccaggtttatttctttcacatttggcttgccaattatcccagcaccatttcttgaacagggtgtcctagagtatagtttgaagttaggtaacctgatgcctctggatatgctttttgttgttgttgttgtttgtttgttttttcttagtcttgctttggctatgcaggctcttttttggttccatatgaattttaggattgttttttctagttctgtgataaatgatgttggtattttgatgggaattgcattgaatttgtagattgcttttggtagtatgatcattttcacaatattgattctacccattcatgagcatgggatgtgtttttatttgtttgtgtcatctatgatttctttcagcagtgttttgtagttttctttgtagagttctttaatctccttggttaggtatattcctaagtatttttttttttgcagctatttgttaaaggggttgagttcttgatttgatattcagcttggtccctgttgttgtatttgtgtgccttaattttgtatcccgaaactttgctgaattcattcaccagttctcggagctttttgaatgagtctttaaagttttctaggtatacgatcttattataagcaaacaatgacagtttgacttcctctttaccaatttggatgcccttaatttctttctcttgtctgattgctctggctaagacttccagaactatgttgaacagaagtggtgaaagtgggcattcttgtcttgttccggttctcggaagaaatgcttttaagttttttctgttcagtataatgttggctgtgggtttgtaatagagggctttcattaccataaggtatgtctcttctatgccagttttgcagagggttttaatcatgaagtgatgatggattttatcaagtactttttctgcatcgattgagataatctgtgatttttgttcttaattctgtttatgtggtatattacatttattgactttgtatgttaaaccatccctgcatccttggtaagaaacccacttcatcatggtggactatgatttgatagctgttggattgggttagcaagtatttagtttaggatttttgcatctatgttcatcagggatattggtctgtagttttcttgttttgttatgtccttcccctcattttggttttagggtgacactggcttcatagaataatttattccctctttctccatcctgtgggttaatgtattagtattctccagagggaaagaactaatggaatatatatatatatatatatatatatatatatatatatatatatgagtttattaagtattaactcacataatcacaagtcacacaataggccatctgcagggtgaggagcaaggagagccagtccatgttccaaaactgaagagcttggagtccaatgttcaagggcaggaaggatccagcactggagaatgatgtagggtgggagactaagccaatctctctttcacatttttctgtctgcttatattctagccatgctggcatctgattagattgtgcacgcccaggttaagggcgggtctgcctatcccagcccacttactcaaatgttagtctctttggcaaaaccctcacagacacactgaggatcaatactttgtatccttcaatccaataaagttgacactcaatattaaccatcgcaattactgtcatagacttggtgccaattcttctttcaatgtctgatagaattcaaatgtgaatctgtctggtcctggacttttttcgggggttgactttttaaaattattatttcaatctcactgcttgttattggtctgttcagagtttctacatcttcctggtttaatctaggagggttgtatatattcagatatttatcaatcttctctaggtttttcagattatgtgcatattatcttttatatagtttttttgttttaattttatttagttctggtctaatctttgttatttcttttcttctgctgagtttgggtttgcattgttcttgatcctccagtttcatgaggtgtgaccttagaaggtctgtttgtgctctttcaggctttttgatgtatgtatttaatgctaaacttttcccttagcactgcctttgctgtatcctggaggttttgataggttgtatcaagatttagaactactgcaaccttactattgaccaacaggtttttaattcctaagagtgtgacctcactgaatcctgacaacagctttatgattgcttttcatgcagtaggccctggttagagaggggagtgcttgtggcctggaggtaggattctgcaatttatcaaataaaaacactggaggtcagttaaatttgaattcagtaaaacaatgacaaagaattagtatgtgttagtatctcccacacaatatttttcagttgaaatacaacttatctgggtgccctgtcgtttatctgccaactcctcacaggattcaaggcttggaagagggagtgttggggctggcctcgtcttactgatgccagttctatgagatgaacctcaaaggcagagcttctctaacacagctaccctcaagaaagcacgtcagttagcactaaatacatggtataagttcctcaatcaatagtgcctactcacttccctaattcttctttgtattattcttcaagtctgcagactcaggacctctgctggggttgctgcagccagagttctggatgagggacctcataagcctttcaaaaccagacgcagggggactactcagtccccacgcagcggggcttaagccaggggtaaataagtaagaaatggaagagctcagcatggctctccctttgtccagtgagacagcaaactccagggtccttttgatgctgaaggtgcgtgggctgagagtagggggagacccaccctgagagcccagaacttccaggacaggacttgtcagtctgaaaaggggccacactcttgagtggggaagaaggaggcatctctcgccacaggcctgcatttctggtggcttccccttcaccaaactgtgctctctgctctgatgtctatcagagaatctccttcagtgagactaagatcccaggactttactaaaaataacagcatgaaccagatagatttgtaatggtaccagaattctctgcagagcaatgagtacaaatgcagcttaacaaaggccctcacactcataactgaaaggctcagtaggtctgggtctggggcagtactgggtgctgtaggcttgtccttgaggcatctacaagtaagaacaactgggaagccatcctgctgtgaccctgtatcatctgctcactgctcactgggctcagcagctgtgtcctcacagggaaccaggttcagccaacctggccttctccaccccacctagaacatgtattccggtgactgtctggactgaggttctatgaagggactggcagacaagaagagggggctgatttgcatgaagaaaccattgcacaccctttcctttcatctaaaacccattaatggatactctggggccacccacagaagtctagcttgtctcctaaatttgagagttaggaaggagtcatttcttatcaatctacaggtagaggggccatcagcagcagagggccagagtgagggagaaactggcttcgagagactcatcaacacagccaccaactcttggacaaatggggcacttgctataacagtcaccccaagctactcacaggagcctgagcctagtcccctcaccttattgcttttgattctggtccatgcctctgttttccctggactctttgcccatgtctgagtccagggaggcaggggttgctccatctcagtcaaaatctatgtatatgtaacagctactatggcttggagcagagtccactgttgtacctatgagggcctatcctgctccaccatccccttacacaggtgacaactgctatgtttctgatggactgacccttttcccctggaagacacaaggtatttattcctttctaacacaaggcatatagtggagggggtaggggtgggtgtgaagcagagtggcttttccagatataatgcagtaaggccctggttacagaagatcatttcacaaaattccacaccctttcatgataaaaacactcaacaaactatgaatagaaggaaacttcctcaacatagtaaaggccatctatgaaaatcctacaactaacatcgcatgcaatctgaaagaccaaagatatgtttttgtaatatctatcaggatcaaagcaacaatgcacattttcaccacttctattaagacagtattggaagacctagccagagtaattaggcaagagaaagaaataaacagaataaaaattagaaataaaaagtaaaattatctctgttttcatttgatttaatgtcatatgtagaatacccttaaaagtcccacaaaagaaaactttgtcagaatgattaaatgtattcggtaatatttctgaatacaaaaatcaccatgtaaaattatctcatggctgggcatggtgactcatgcatataatcctaacactttgagaggctgaggtgggaggactgcttgtggtcaagagttcaagaacagcctgggcaacaaagcaaggccctgtctctacaaaaagagagagagagagatgaaagaagaaaggaaagaaagaaagacagaaagaaaggaggaaggaaaagaaagaaagaaagaaagaaagaaaagaaagaaggaaggaaggaagaaagaaagaaagaaagaaagaaagaaagaaagaaagaaagaaagaaagaaagaaagaaagaaaatctcttacatttcaatacttgagcaaataggaaacaacccaaaacaaaatcgggacccacacccattaggatggctttacccaaataatggaaaataataagttgtagcaaagatgtatagaaattataactgtaatgcattgctggagggactataaaatgatgcatccactgaggtggccttgatgacagttgctcagaaaactaaacatagaattaccattttatcagaattttcacttctgggcatgtgcctcaaagaattgaaagcaggatctcaaaattgtccacccttgttcgtagcagcatcattcacaatagctaaaaggtggaggcagcccaagtgtcatctaatggataaacggaatatagtatacacacacaagggaatagtattcaaccttaaaaagaaagttctgacccatgcgatggcatggatgaaccctaaagacatcatgccaacagaaataagctggtttcaaaaggacaaatgttgtctgtttgctcttatatgaggtacctagagtagtgaaatccatagagacaagaagtagaatgatgttttccaggcatgaaattttggtttgggaggatgaaaaattcctggagacgaatggtggtacgtgactgtacaacaatattactttacttaatgacactgaagcgtgtggttgaaaatggttaaaatatgtgttttgtgtttgaataatttaccactgtcaaaaacaaaaagatttatatttggtgcagttacaagaaccataaaaatatacaggactaggagagtgtgcctgagtagccaggacacccttccttctgtgccagccccacagcatcctaacagaccaatagagttggaggtacctcattacaggtgacacaaaataacatgagaaagtctgagaatggccatgatggtaggggtgggtgcctgacccagtccaggagcagcctctagtgcaactatggccaaagaaggggagatgaagctggtggcaatggtagcagcctctccagctggagagggacatctgctgtcctatgaaaatggctcatagttgatatatctggcaaagacatgtcatcctgtctacctttcatgaccaactacagttttcatagtgctttggttaagctggcatggcagtcccaaacacaggatgaatgctatagcatttattgataaatactgggagtgcatgatgaccattcagacacctgggaaaatgactaggctggataacatcgttaaaacaatgagtaaagagagagatttattcttggtaaaggacctcctggatccagggagtaaagacctgaaagaagattgcccaagatttggacttttggatcaggactttggtaaaactgatcctgtttatgacaagcaaaagcaaagcagtgccctgtctgtgagtgggaatctgaatggggcaactgaacaggaagcagcagaaaagaggaagaggagttcagtgcaaacagcaagatgagatctcagagaccaccaagaaggcccagagtgaccctttgttttctgctcagcgccttgccccttacaccttttaaaacacccatttaacaaggatggctactggtatattccaaccgagcctgagccacacacccttggtcctcagaaggttgaagactgctaggcaggagaaattattcctgaagacctctacggagcctgtttctgtgaacaggttttgttagtctaacatgattaagctctccaggtaaagatctccaatgaccagctggctgactgtggttggaaagaagggttactctatgatgcaggcctctcatggggtatggaaagggacctgggactttgaaatcatcaaggatgagttgtcaccagacaccactgccaatggggttggtctcagtcctaaggtaaccatcaatctcccttaggttatgataaacttagctattcttggcagagcaaaagggaaccaagttccacctgtccactggcaaataatactcttctagctacggatgaggacaggtcttgggattttatattaatcttcctgaaaacacagagacagccaagttattgcctgatacttacaaagataaggctttgataaaatacaagaattatttgtattttgaggaaaaagacattttggataaagcacagaagagcctaaaacagattctgcacaggcaaataatattttataaaaatggtgtcaattaatatgttgaataaaaggtatttttgagggggttgatttccagccatctcacaggaaaacaactgcatggtttgcattaactttggactgtgctgcgagtgtcctccaaaggatctcgcttactcccttatgagtgacatgggctgggatgctgtggtagagcacactctggctgatgtcttgtatctcctggagacagaagtggatggaggcacagtcctccatgggaaccctgaacaggtccctctttcttttcaaatatggactttctggggaatgatactggacggcttctgtagttgttgttgttttttgaactgtctcaaatgttttcccaaagatgctacagaacatagcctatccatttagcaagtgaaaaggctgaataagactgggagagactccctgctcatcatcattcttcttccacttccagtgactgctcatattctgtgccataagccaacagctactgatcccaagatcttgtaatccctctgtaaaactggtgctgtactgcataccttgccagctgggactttttatcttactgcattttccaggaataaataaccttgtcccaaaaacaaacatatttaaagacatttccttctgtggacactgattccatgctatctgttttccaaggaagtggtgagcccgtttctgagaacacctggtatcaatggctgtcccttccaaaccaagcaaaaagtgatttcttgtcggtgtggatttggttttgttattaattttaaaacatacctttgaagacttagatctctgaaactactagatctctagaagtgtaattgtgaaaaaagtttgcttgcatcatcaacaacatgaaaaactctttctaaataaaatttgttttgaagttaaaaaaaagaataatgcaagattggaaactgggaggtctgaagattcccaagagcactctcaattctgaagctaattttcagctcagggaccccaaacagcccttcacttcttatgagtccctagaaggactcacatgactcactgaaaactgtgacattcattaatgtgatttttctacagtgaaataatacagattaaaataattcaaggaaagagacacatgggcagagttcaggagaattccaagcacaagcatccatttgtcctctcccagtggagtaatagacaacgctgcattctgccggcaacaatgtgtgattctatgtaggaagcattgccaaccagcaaagctcacccaggcttggtgtccagaaaaattttgattggtggggtgggtgagagtggggttgttatgtagaccttgatgaccatcctcatggctcacttgagtttccactgaattgacaataaaacttcaatcttcaacctttggtcattttcttttaaaaaattttctaaagaaaattattttaaaaagtctcatataaacgagctgtttatccaatatgaggctcaacgcaaatagtttcaaaaagtcagtaggtcattaaaacaattatttagtcattcaaactaaatatttagtcattcaaacgttgttatctggtgttcagatagcaacgaacaccatgtagcactaaaatcgcattatagtcacaggggcaggatttcagcaacagcaagagaaagtaatacaaacaggaatgagcaaagaatagacaagtaatgggtatgaattggcctgggaaatattgtggcaatgtccaaagacaaatcaatagttatttgttaaagaagtgaaagacaacacattctcagtccaggaaagccaccagggggtggtctgggtctcttggattgtaagaagctcaagaggttcaaacttaatgaaccctgcacagatgctcactgactcatggaaatgttagagcagctgcttcctcccacaggacaaatccacagcacacagccaccctgggctggccccccacagtgtagctgctctcagggctgtggacccaggtggtgataaaggcagtaaagatttgcataaagcagcacacagcacaccccctccgtgcggagagctcaataggagataaagagccatcagaatccagccccagctctggcaccaggggtcccttccaatatcagcaccatggcctggactcctctctttctgttcctcctcacttgctgcccaggttaagagagatttcaaataccagcctttggagggatccctttttctccctttctaattcctaatatatgtctgttttttttgtttcagggtccaattcccaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgctcggcacagtgacagacccatgagaggaaccaagacataaacctccctcggcccttgtgatgtggagatcacatgatcagacatgccagatcccaagatagcctacatgtggaccagccatagaaaggggaaggaaagggtttgaattgattcctatttctacttaagtcttgatgtgtaggaaatgtaagaatgatttgggagtaactggatcaaaaaaaaaaaaggaaaagttaattgttttctattctaaaaggaacactaacagcaggatcacatataaaggctgggtcaaaatgcatttcctccagaaagaagcatcttcagtgtataggctttctgagctaagagcaaagaaactttttttgcatattactgaagtttgttttattgagttactttcaaaccaatacctccagaaagaagcatcttcagtgtataggctttctgagctaagagcaaagagaagaaactctttttttgtatatgactaaaatttgctttattgatttactttcaaaccaatacatgcctattatataaaataaaaatattaaaaaccaccaagttcactgcaaagctgtctcatcagaaacaatccaatttcttcatttggatgcattctttcatttttgttctcaatatttccacaatgggggtcataccttgtgctttttctctctggttttacacatctttatgcctcctcccacaccctgtgcctctctcctgactctcagggtcctgggcagtcagggctcacttggtagcctgcacagtctgtctgtgacaaaaccagtcaccatctcctgcactggaatcagcagcaataaggttcttggaattgtgtcctggtaccaacaatgacaaggaagtgcctccaaacttctgatgtatagaagcaaatatctgcctgcagggacccaggatggatgctcgggctaccagtttggcaaggaggccttcccaagcatctctgggctccaggctgaggacaacgctgatctcaactgttggcttcagacagccccctggaggcccaaacagtgctgcagtctgggggagtgagacaggaacatgtcaggtctcctaggagcacgacctaactacagcaccatacaaccaggacagcagggctgtttaccatttgtgtgcatgtttgctggtgcttctgctaaccaggacccagggctcagattagggacagtgatctagagaatgctgctttgttttctcagggccagacttcagagagagcccttggccacagcattgtcagactgcctcagaagaatcagaaagtccttgatttctggaacaggctgccctgggaatacagccatgataggccagggcaagcagggacagaatccagctgggtctgtctcaggcatgtgcactaataaagatctctgtttgtccttattgtttactgaatacctactatgtgccaggctcaggtctcatgctaaggatacagaggtgagaagacagacagggattctgtcttcacaggactgacaccatgcagaaaagtgagggccaacaagtcaataggagtaaggcatattgtggtgtatccaagaggtgacactggccagaagggggagagcaataggaagcccttagggagttgtaagcaaggaagacacggagtctgatgggagacttaggagaaaagtccagcttctccaaagaagatgaaaaaggaggggagagagtgaaagtggagggtctaattaggagacggtagctttctccacatgagagatgaggtctccagcaagtgatgaagcagctgaggtggtgaaatatgcgtgacccacaccatggtgagtaagaccaaaggaaagaggtcactaggttgaggcccaaagcttgttcctgtgatataaacctgacaacatcctcttgccgttactgagtgtctcacacaccttttttctttggatatctcctgggactcaggactcattgctgcccttccctcgtattcagtgagattcatttcgaacatcacttttcacacccagagagagacctggctcctttgtatggagcaaaagcactgagggtcaggacagaacattctacagaacatgggatgatgccttacacactaaaggactgctgttaaagctcgtgatcaaacctccctggagctacatcagaaaccacgagaggggaggtgtcagcgcttaggtgcctgatttcagggcacactaatttgcagtttgtccagctccctcccaggcatttttatccacccctctctttacctcctttcatccttgcctccttctcagggcgggcctccaggcctgtggtgtctctgctgctctgtctccatcacaaacagagcagtagggagattatctgataatgaagttccctcctcatactcagttatctggttccccttaggaattcttctgcatcatgggaatgttctgttttatttctgccctacagtaggaacccagccatttgtgaggccaaggagattgacctctttccgttgaagcaggattatatttaacacatgtattcaaataacatcatcaacttatgaacaagtcaatccattcttcagaattatagaaatgcatgtctctcagctgtcagcaattggcctcagatccctagattggcgaacttgtcagggtggggtcagccacatgaagatgtttctttatagttagtgactctattcactgggtttcccctgttgagatccaacctccatgagactgtttatttttgttgttgttttctgtcttgtcattgcccaaaatgctgcctggcactaaggaaagacttaatacatgtttattaaatatgtgagttcacctacattggaatcccaaaaagaggtacagatctgaggtcaagttaataatttttaaaaaaattctggatattttgtgtttgagattccaagttcattcaatagaagatattaagtatgaagttttgcctttggatttggttagcaggagaaggatatggatatgaaaatacaaatggatcacacatacctccccatggcccagagtcttgagtgcctagctgctctctgcagctcctaatcacagcctctgttcactcatttatggtctgattcccatggatccatacatgctggatcccatgggcttatgtggagaaagtggagagaaggtgatggccctgctaaaaaaaccacaggaagcaagttgataatgaagcaaattctgggcacaaaatctctcaagagcaaataaactgcagaatatgggtgagttgggaaaatttctggcaatatttatataactaagaaggtttacattacatatacttcaacaaaatattaattctaaagcttccaataagtcatatgatcaatgcaattcaaacattaaactcatcagtcccaagtcccataatagactttgatggagaaattcttgaaggaagaatgatgggtttgtgagctctgtgtccacagaagagatatttctgcactaggaggactgggtaaagccattaaataattatgaatgtagtgcccatctggacttttttctaatccaatatgcaatgctgtgggctctgcctttgcaaatcgtagcattcattgtacttcctccagtctcccaattattacaataaattaattttaaacatgaatgattaaaagacaaatctattaatgttagagtccttggaatctgttgctttaatgcacaagaattatggaacacttcaaatgtatatatttgttaatttatgtaccaatgataaaatactgcttccttgatctgttctaaaaatcacctagaaagggagtaagttgatgggtaaaatgggttgaaaaattaaacaagatgaaccatattgatgatggtcaaagttggctgattggtgcaaacaattcatcagaaaattctctgtatatttgtatgactcaaacgtttccatgctaaccagtgaaaatatccttttttgcaatgagatgtttatgttctgcttttaccaggtgtacaatgtggacaaaatgtaagcttacactttgacttcaagtggaagcccatcttctcccaacaggcagaggagaagctggtgtggagaacatggaaaacacaggagctcagggtttcccaggacagagaagtgagtgagcctggagccctaaaagcaagggcaggggctgtgagttgggctgtgggggtgttctggggccacaatgtgaagggcatgttgctgaggtctcagggttcaggtttcataataacaacgaggagttactcaaggggcttaaaccagggagtgccctgcctgccctatctgagtgacagggatctctctgaatgccttgagaagagagtgtctgagaaaagtgagtgatcctgattctagattattcgctaaagcacctcgtgagtctagaaactcaggggccatttgcacagttagcacaagagtagatgtggctaaattgagaagtgatggtctctgcttttgtctcctgagacatccaactcatttgcaagagaattttgcaggtaaaatacatactgatctttctaataaactgaaaacacctagtaaaaaaatacacgtggtaatagcacaatgcaatttgtataacagctagaacaaattcttgaccaaaaaatatgatgcaactgtgcagaaaatgacgttttacttagggagataatggctaatttcataaaatagtgaaatatgtcacactgttcactggtaaaggtaagtctagcaaatctattagttttcctgtatcacaaaatcgaatcaaatctctttaaaacgtatgaaaccattgtaaatataacttgtgttgcattgctgtctttttttttttttttttttttttttagacagaatctcgctttgtcgcccaggctggggtgcagtggcccaatatcagctcactgcaagctccacctcccgggttcccgggttcacgccattctcctgcatcagcctcccgagtagctgggactacaggcgcctgccaccacgcccagctaatatgttgtatttttagtagagacggggtttcaccgcgttagccaggatggtcttgatctactgacctcgtgatccgcccgccttggcttcccaaaggaattgctgcctttaacatgtcattgatcctttatttttcctggaaatttttcattattcaccatctttttgaacaaccccagctgcccttcaacccagctcctcagctgaccccttttccatgatgcccactctgatgacatatgtgggcaaatagatttttctaaaatgccctgttggggtgctgacacctataaaagttatgtatgtacaggtctgcacatcccacagaccaagactacttctgggagtgagaaatcgtagtaataatgcatagcatgatagaagcagtgtctgggaatcagaccatggatatgtgaatacagacagtgactaaagagctgcagagaccagctgggttctgaagtctctgagctttgggaaagtgtgtttcctgggaccagcgtcagatgttgtggggctgccctgtggttccgacacagctgctcagtaatgagcattcactcagagaaatccaggccttgaggctgggccctgtgctcactgatggacactcggcagctgtgtcccctctggcctggcagagttccctgagcagggacctgtgtatggtctcaacaggtgcttcctcccagggccttgcaaaaagaaaagcaagccttcctcctgctcagtctgcagagagagctgagctgcatccccaggtctcaaggaggggcccggcagtccctgggcggaaacacatttgcatgagcaacccctcctctgcaacagtgggaagaaaaggaggcctggggcagcccagtcccactgcgggggtaagaggttgtgtccaccatggcctggactcctctcctcctcctgttcctctctcactgcacaggtaggaatagacttcagagaccagggtcagccacccagcctgattctgactcttctggcaaagatccctgaaaaactttaccctggtttctgccttagcacccattaatgtctgtgtttccaggttccctctcgcaggctgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgcttctcacagtgacacacacagatggggaagtgggacaaaaacctcaccctgctctgggtcttgctctgtaccaatttttaaattttaaaataactggcctaggcacaaactatatttggaagtactttctagttgtaaaaggctcttctctcaattttctatccatttttctgaagtctcagtaaaacaaaacaaaacaaaacaaaaccacctgatgaccctgaagtgttggctggttgtccacatgtgctaacaccagtgcctgtggagctggacgtttttttcttgaaagaagcaaaatgaggctttcctagctcacatcatggtcagagcctggggacaacatagcaggtgaacagtgccctgcagcatggactctgctcttccagcgtacgggcagagacctccccttccatccccagtagtctgttctcagggctgtctgaggctcactgtgtcccaggaacaaggcactcaaatatgaaatgctgcctgaggactcaggtcagggaattctggatatagtgctgacctggctcagtcctgggtacctgcatttcagtggcaatgtcaggagatggcgttagatattagggtaactgcgggcccgatgccagtaaacctctatgtaggacatgacagaatcaaggggaggctccaccatggctgagacaagccagaggctgctccttggccatgggggaagtagatcccatggatgtgactcctgtagctcatcccactcaggaccacggggactgctgagggtgggtttcctgatccctcagggcctgactgtgttctcttctcctctcttacaccattggagcttctcactgactcaggtctagtggtgagtctgtggaatatctggatacagaaactgcccaatatttgcttcaagtgactcctccctgggaaactcttgaggaggcccccacctcaaggtcatctttttctccatggggagcagcagaaacattggccattcccatggaaatggctatgaggcctcccagagagaacccctaagtttatgacctaggacaatagtgatggtccctcaggggtcccagcctgcttctcctgatctgggtttatccacacagcctcctggagtgcctctgggctccagcctgaggacctggctggttatcagtgtcacacagctgcatcctgactccatgttaccaagggttcctgttccatgtggaaatgatagaaagatctccccactcatcctgtctccccatccctcctttatccctgcctgtgaccaacaccagttcatgccaagacttcagctgtcagttgtgttactgaaagcagagcaagggttcagggacgataactccttttcttactggtctccccagtggaaagagaatcagtttgtttcaagaagtaaaataagctgcccacacatggtgggtgaggatgaggtggaaatgacaagaaagaatccagcctggctgggcatggcagctcacacctgtaatcctagcagtttgggaggcggaggtgggtggatcacctgaggtcaggagtttgagaccagcgtgagcaacatggtgaaacatcgtctctactaaaaatacaaaaattagttgggcatggtggctggcgcctgtaatcccagctactcgagagactgaggcaggagaatcgcttgaaccagggaggtggaggttgcattgagctgagatcatgacactgcactccagcctgggcaacaggcagagactccatctcaaaaaaaaaaaaaaaaaaaaaaagaaagaaagaaagaaaagaaaaaaggaaaagaaagaatctaggcagtgtgacccagaagtccaggagccttcggcctggtcccacaggtgtcccctcctttttgaacaggtatgctggccatttgctgagctctgaaactgtgggagtgataacaagaaaggcgaatccagcctgtgtgacccacagatgtgagagaggtagtctgatgcttaagaaaaggtgggatcagccttctgaaaggtctggatctggcttggcctagagctggtgtagaagagaagcaagagagatgcttagccttgggtggcccaggcccagctgtcctgtcaaggggctgagctctctgcaacatggaaatcctgcagagccatccttgggaggctgtgatctcagtaggatgcaaaaatgctaatggaagtgagcaggggatggtttatgggggaatgaggggacggtgtggggtcaggtgtggtaaggagggtgcaccctgaagaggagagtgtccattgtgactcacaggaggaggaggcccggggcccagagcagtgacaaaaggaggacctggaaggacctgggccctcaagacacacagagactggggttttggtctgtccctgagggtccctcaggaggatcacataaaaaatccatagtcagtgtcctctgtccaaggctcactgtcccagctgttgtccctcccggatcctctgggtgtccacatcctgtagttttggacctgttcttctctctgccctcaacctaacagctgatggggcatccaccaggaagcgcatccgtgggcagggaggaggccgtgggcagccttgtcctgtatgtgagacactgctcagactcggtgaccccctgttcattaacgtgggaggaaaggaaaacaaaattcactgtgaacatctatacatcatcaaagaaaaagcaatgagaaaaaacaggaagtgaagcccagctctaatagtttatttctacttggaaataaataaaacttaatatgcctgatgtgttatgtaaatacaacaaacatattttaaaaactataaaaattatgtaaaggcacatggcttacactaaaagaaacatttaaaataacaacacccttgaaatgcaatcccaaaacacagcatacattttatttcagttccatgtatggactggttttatttaaatgtctgtattaggtttcactatttggttgtttaaatggagcatttaaaatcttattgtattacaacttatatcaacataatcatcttgctgtttttctgtatccccttaaaattccctaaacaaatatttattaagagcccagggtgtatcatgccagaactcaggcagtcacagacataacctgtttcatttttcattttgatcaacagaattatgttttctgttaagcttgttgtttttagttcattagattctagacgtcattacagatcaaagacgaaaaatttctatcatctttaagccacccccacaacactcactactgaatttgaaccaaaatcttctcctagaaatcctcgttggcggctcgatagtaagagctgccatgtatcaggctcacctgaggacagacgctggttaaaccaagttgaagttttaattcttcccatcttcaaagactgagcatctttgctctttttgctcataagtgaaacactccaaagtcatttgccaggatcccctgtagatgggcattcagtgtacagactcctaggcaagatccctggtcacagtatccaaatgactttgactgcaaacctggggaagtagagagagaacaaagatttaccagaaaaaccctctgggaatgtcttcccaaggcaccctagagggaagagctccctttctcttcagctccacaggatccacagaggaaggagagctctagccagcaggaaggagccacatgagaggagaggaccaggtgtcccacacaggtggggaagtgagtccatggggctggtccccgctctgggcttgatcctgacataagaggactctgtgtagacaccacctgagtcctctgcaatgtacagccacagagccatggacagattcactcctgaggagtccagtagagcgcgaagactgccttgaggtcacagcgggaagacacaggtgtcacttgagctggcctggacctgagagagggggcagtggacagaacagaggggaggcagtggtgtgaatgagaggctctggtcaccttatcatagaatggtttaccttggctggacaccaggggacgctgggggaccatttctgagaagacgcgcggggggcgggggtgggcggtgatgggagcacaaccggccacctgttgtgcctgttgtcctctgctcagggctcacaactgtgttctccccaccctctgggaccacagagctccacccctgccacaccctgacatcctcaaggcaaggagcctgacccagggctcagggtggggtcacaaagctgggggggtctgatttgcatggatggactctccccctctcagagtatgaagagagggagagatctgggggaagctcagcttcagctgtgggtagagaagacaggactcaggacaatctccagcatggccagcttccctctcctcctcaccctcctcactcactgtgcaggtgacaggatggggaccaagaaaggggccctgggaagcccatggggccctgctttctcctcttgtctccttttgtctcttgtcaatcaccatgtctgtgtctctctcacttccagggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcccacagtgctccaggccaatagggaactgagacaagaacccccttcctcctctgtcaggagggtgagccccagcagctgctgctcaggcctggcctgtggcttctgctgctgcagcttccttcatgggtccaggggcatccagggccctgcctgagagtggaggctcctcctccccttcagtcctcagagtcaggaacaggacatccaggaaacagaacatcctcctccctgcagcttaggacacagggtctctgcactgaagtcctgggctgaggtggcaggtccagttgtgtcatctcagacccacctctgatggggaacccgtgtctccgtcatcctccttttcccatttccaggagtttccagagtggtgtcttcctccccctgctcctcagtgtgaatccctgtgcttcctttctctccagcctattcttttttaataaaactcctttcatgtaggaactatgcacatctaataaactacccatatttataacaggaaattagacaaattttggcatttttctggttccttgaaaacatcaccatccccgggagctattgtgaccatcccggcagctcctcatgatgcttgtctcctccctccctcccctaatggcctctcaggaagccacagatctgcctctctcactactgtttggtttttttttctggaatgtatcagtgttatcaaacgttatcttcccatttgttcaggcttctttcactctgcacacttgctttgagattatccctgctgtcgctgaattgcacccatcccttagagggctcattactatctttaagggtccttaggccatttttttctgattttattcatgtatttcctttaaagtttgaatttattgttcatcaaacaaactctatgggtgatgttcatctaaggtgacaggacagtccgtgatggtttgtcaggattcttgcttcttcagttcttttcttggctctctctatagtggaagaggttctcatcttttatttatttatttatttattttggggtttttttaagggttttagcgattttccctttttaattatttttaaaatttgttattttattttaataggtttttggagaacaagtgttgcttggttacatatataagttcgttagtggtgattcctgagattgtggtgcactcatcatccaagcagtgtacactgtatccaatgagtagcctctcatccctcacctccctcctatgctttcccccgagtccccaaagtccattgtatcattgttatgcccttgggttctcatagcttatctcccacttatgagtgagaacatacagtgttttgttttccattcctgagttacaccagttagaatgatagtctccagttccatccaggttgctgtgaatgccattattttgtttatttttatggctgtgtagtattccctggtatgtgtatgtatacatcacatttgctttacctacttgttgatttatggacatttgagctggttccatgtttttgcaattacagattgtgctgctataaacatgcgtgtgcaagtatctttttttgtataatgacttctttttctctgggtagatacctagtcgtgagattgctggatcaaagggtacgtctatttttgtttccttaaggaatctccacactgttttccacagtgattgtactagtttaccttcccaccgccagtgtgaaagtgttttgttttcaccacatccatgccaacatctgttatttttttattatagctattcttgtgataggaaggtggtaacacagattgtggtaccgatttgcatttccctgattattagtgatgttgaacatttttctatatgtttgttggccatttgtacaagttcttttgaaaattgtttattcgtgtccttagtccaccttttgatggaagtgtttatttttttcttgataatttgagttcttcgtacattctagatattagtcatttgttggatgtatagattgtgaagattttcatccactttgttggttgtctgttaactctgctgattctttcttttgctgtgcagaagtttttttcgtttaattaagtcccatctatttatctttgttcttgttgcatttgcttttgtgttcttggtcatgaaatatttgcctaaaccaatgtctagcaaggttgttctgacgttatcttctagaattcttaccgtttcaggccttagatttaattatttgattcatcttgagttgatttttgtataaggtgagagatgaggatgcagtttcattcctctacatttggcttgccaattatcccagcaccatttgttgaatatggtgtcatttttctactttatgtttttgtttgctttgtcaagcatcagtgggttggaagtatttggtttcatttctggattctttattctgttcctttggtctgtgtgcccatttttatatcagtaccaagcagatttagtgactatggagtcaaactttactggagtttgaagctgggtaatgcgatgcctccagatttgttccttttgcttagtcttgctttgtctatgcaggctctttttggttccatatgaattttaggattattttttccaattctctaatgaatgatggtgatattttgatgggaattgcatagattttgtaacttgcttttggcagtatgatcattttcaatgtattgtttctacccattcatgagcatgggatgtgtttctatttgtttgtgtgtgtcatctatgatttctttcagcagtgttttgtagttttccttgtggaggtctttcacctccttggctaggtatatcctaagtatgtattttgcagctatttgcgaaaggggttgagttcttgatttgattttcagctcgtttgctgtcattgtataacagagctactgattcgtgtgccttaattttgtatcttgaaactttgctgaacttatttacagttctaggagctttttcgatgagtctttaaggttttctaggtatatgatcatattatcagcaaatagtgacagtttgaattcctctttgtcaatttggatatctttgatttgtttctcttgtctgattgctctggctaagccttccagtactatgttgaatagaagtggtgaaagtgggcattcttgccttgttccagatctcaggagaaacgttttccacttttttccgtttaatataatgttgactgtgtgtttgtaatagagggcttaatagaggacataagttatgtcttttctatgtcaattttgcaaagagttttaatcatgaagtgatgctggattttgtcaagtattttttctgcatgtattgagataatcatgtcatttttgtttttaatgctttttatgtggtatatcacatttattgactcacatatgttaaaccatctctgcattccctggtttgaaaaccacttgatcattgtggactatgtttttgatagctgttggatacatagaataatttaggaaggagtccccctttttccttcctgtggattaatgcattagtcagcgttctctagagggacacaaataatggaatatatatatatgtttattaagtattaactcacatgaacacaaggtccaacaataggctgtctgcaggctgaggagcaaggagagccagtccgagttccaaaactgaagaagttggagttccatatttgaaggcaggaagcatccagcatgggagaaagatgtaggctgggaggctatgcccatctctcttttcatatttttctacctgcttattttctagccatgctgtcagctgattagattgttcccacccagattaagggtgagtgtggctttcccacccactgacaaaaatgtgaatctcctttggcagcaccctcaacagacacacacaccaaggatcaatacttttttttttttttttttggagatggagtcttgctctgtcacccaagctggagtgcagtggcgcgatctctgctcactgcaagctccgcctccagggttcaagcaattctttgcctcagcctcccgagtagctgggactacaggtgcccaccaccatggccggctaatttttttgaatttttagtagagacggggtttcaccgtgttagccaggatggtctcgatctcctgacctcgtgatccgcctgcctcggcctcccaaagtgctgggattacaggcgtgagccactgcgcccggccaatactttttgtccttcaatccaatcaagttgacgctcagtattactcatcacaagtccactccttgtcagcatgaacccatatacaacttgtgatatcgtacataatcttcaaataaagacaataataaagtcataattacgcctaacataatacaattatccttcatacaaccagaacgcacgaatccctaacacaaatactattacatcaagttactgatacttaaatgctgatgtgacgtcaataaatcttatgttatatgacaaaggagaaaggaaataaaatgaagatattttcttagtacgagtttatagatgcgcaaacatgtttttaacaaaagaaggaggaaatactcttgacaattacactcctcgtttctgccgctggccatagctggtattgatgactaccttcttctactacccattctgtattccctttgccttcagcaagcacctcagtaggttgtgttttttttcctggtggagtgacccaaatcttcattcctgaagggtcccattgaccttaatcacagggcatggtaatagcaagaaatgccctaatgcatctcctgtattccatgcatgttcttcagtaactccattgtggagtagtaaactgatttcattttgatagtctgggtcaatcaccccagccgacactgtaactcccttcttagccattgacttaaaggtaggagaagcccaaaatgtccaggtggcaatcttaacttccagtttaatggaatcattgttgtgtctccaggtggtagtgttccttcctctggaagtaaatcctttgagccagcagaacataatgtctcaggaacaggaagcaaaacatttgctagtggatcactagggttgatggtgagtggtgccacttccacttccaccccttgattcctggatccatgaatcctggctacaggagggacagtaccatatattggatgctgatttaaagcatacacagccatctggagaactttgccctggccctgcaaagtattgtcacctagttggcaatgtaattgtgacttcaaaagccattccactgttctatcaatccagctgtttcaggatgatggggaacatggtaagaccagtgaattttgtgagcttgagcccactgctgcacttctttagtcataaagtgagagcctttgtcagagcattgttgtgtggaatatgatgacagtgaatgaggcattccaagagtacacggatggtagtctcataggcaaaccaatatctaggataagtgtctatttcagttaagacaaacctctgcccttcctgtgatggaagaggtctgttgtatttctcctcacacagggcaccagttgagatattgctcctcagaagacagcattagctgcgggggtctgcctgcagaccctgactcaaacgacggatgaataaaaacggacactgacacacagatattctgtttggccagtccggctgggttctttgattctgagtgtccgacaacatacacaccaggagaggtttgtcactgtggtgggtcctgagcagctggtactccaggcatttatttagtatacaattaacaacagaagctttgagtaaacacacttgtggataattaacatggttaagagagtagttctacgaatgattaaagctcaggtaccctggtctaaagtaaataccattacggggcaatatccctggttgacctcccaccgagagggccatctggctcaaaggttagttaatggagatagggtaaacaggcttaactgggaaagcctccattgtccctagcatttaccctatgacctaatgctctaaggtaagaaccagctgccttcagcctgtacaattattacaagctatgtaacattttagccttccaaaatgtttgtgattattccctataactttccctaatatttccctttgatatttctgccaccatcctgagtgaatcccaacagaggtccaatataatcaacctgccaccaggtagctggctgataaccccaaggaatggtgccacatcaagggctcagtgttggtctctgctgctggcaaattgggcactcagcagtggctgtagctaggtcagccttggtgagtggaagtccatgttgatgagcccgtgtgtaacctccattcctgccagcatggccacttccctcatgggcccattgggcgatgacaggggtgtctggggaaagaggatgcgtggtgttcacagaactggtcatactctcctcttgattattaaaatcctcctctgctgaggtcacccgttggtgagcgctcacatgggatacaaatactttcacagtttttgaccactcagagaggtccatccacatatcttttccccaaatttctttgtcatcaattttccaatcatacttcttcctagtccctgtgacagttactacaggacagaatgaagggggactaacacagaaatgaagacaaagacaaagggatctgttttaaagaaggggtcagggggctccttgcttctagtgagcaagggccctgagctactgcaatccttcatatttattaggtagaaagaacagggaggaggaggtaacagttggtcagctgcttgatttatcacaggttcacaggattgctttctttatacaacatacttcagatgtgctgcagataatcaaaagaaacactgtgcttggggcgtgacggctctcagcattcgttctggtggtagatgcagtttgtcgtttgccaacaacctgcattcatgagaacagcttgctgtttgctccagtggtatactgagttggtcacgaccctcattctttcggcctccaagaagtccctgatcgtccagccaaaccgttgactacagcaaataaattcatatataatcacacatctggagatttctccttccatgcaaagagcacaaccaggtgtgctcctcaaagttctgcccaatgggaagatttcccttcaccgctgtacttcagggatgtcctggaaaggggctgtagtgctgcagctgtccactttccggtggtgcctgcatatcatgcagatacatttgtgaaccaggccctagtcttctttctgtcagctgatcatagtgaactgcccctgagaccaccagtgcaggctgggggatagtgcaggctggtggcaggagtggaggtcatggacatttgagccacttccccatgtaacttacttgtgccttcagcccaaatacgtatataccacttccactgaatgatggaatgctgctgtgcatgatccactttatggctaaatgggttagaaagcacccacttcatgacaggcagttcaggttgcgtggggactttaagacgcatagtcaaatgttcagtttccaccaaagcccagtaataggccaagagctgtctctcaaaaagagagtagctacctgcagaagatggcagggccttgcaccaaaatcctagaggcctccactgtgattcacttacagtggcctgacaaagactccaagtagctttgctatctgccgctgacacccaaataccattgggtctgttgggtcatacggcccaagtggcagagcagcttgcacagcagcctggacctgttgcagagccttctcctgttctgaatcccactcaaacctggcagccttttgggttacttgataaatggactggagtaacacacccaaattagagatatgttgcctccaaaatccaaataggcccactagccattgtgcctttcttggttgtaggaggggctaaatgcagcaacttatccttcaccttagaaggaatgcctcgacaggccccacaccactggacacctagaaattttattgaggtagaatgcccttgaattttagttggatttaccgcccatcctcttgcatgcaaatgtctcaccagtaagtccactgtgtttgctacttcttgcccactggatgcaaccagcacaatgtcatcaatttaatgggtcagtgttatatcttgcaaaagagacaagcaatcaaaatttctttgaataagattatgacacacagctggagagctcatatacccctgaggtaggaccgtaaaagtatattgctggccttgcctgctgaacgcaaattgcttctggtgggccttatggaccggaatggagaaaaaggcattttccaagtcaatggctgcatatgaggtgccaggagatgcattaatttgctcaaacaaggaaaccacatctggtacagcagctgcgattggagtcaccacttggttaaacttccgataatccactgtaattctccaagatccatctatcttctgcacaggccaaatgggagagttgaaaggggatgttgtgagaatcaccacccctgcatttttcaagtccttgatggtatcactaatctctgcaatccctccacagatgcaatattgtgggtttatttttttttaataaagtttcactctgttgcccaggctaaactacgatggcagaatcatggctcactgaaacctccatctctggtttcaagcaattctcctgcctcagcctcccaagtagctgggattacaggtatgtaccatcacaccccacgaattttttgtatttagtgtagatgaggtttcaccatgttggtcaggctggtctcgaactcctgacctcaggtgaggtgatccacactaagatccagcttatgtggatcttttctcttcttttcttggttaatctcactagtggtatatataattttatttatcttgtctaagaattggtttttgtttcatttatcttttctatcatttttttgtttcaattttatttagttctggtctgatattgctatttcctctcttctgctgggtttgggtttgcattgttcttgattctccatttccatgaggtgtaaccttagattgtctgtttgtgctctttcagactttgtgatgtacgtatttaattctaaacattcctcatagcactgcttttgctgtatcccagaggttttgataggttttatcaagatttagtacaactgcaaccttactattggccaacggcttttgaattcctaagagtgtgacctcatttaatcctgacaacagctttatgattgcttttcattcagtaggtcgtgattagagagggagtgcttgtggcctggatggaaggttctccagtttatcaaataaaaacaccgaaggtcagttaaatttgaattcagtaaaacaatgacaaagaattagtatgtgtaactcccacacaatattgttcatttgagatacaaacttaccttgtagttcatctgccaactgcacacagggttcaaagcctggaagaggcagagttagagctggtcttctcttcctgatgccaggtctatgagctgaacctcaaagacagggcttctctaacacagctaccctcaagtaagcacatcggttagcactaaatacacagtatacgatgcccaatcaataatgcctactcacttttctaattcttctttctattattcttcaaatctgcagactcaagacctcccgaaacattgcggcagccaggattttgaatgagggtcctcatatgtctttccaaacaagatgcaagggtgctccttggtccctacacagaggggcttaagccaggagtgcataagtaacatgtaagagacagaagaactcaacctggctctccctctgtgcagtgaaacacctaattccagggttctttgattctgaaggtgggtgggctgagagaaagaggagccccaccctgagagctccgagtattcaggacaagacttggcagcctgaataggggctatactcttgagtgtggaagaagcaggcatctctgggcacaggctgcttttctggtggcttctccttcaccaaactgggctccctgctgtgatgtctatcagagaatctccttcagtaagaccaagattccaggatttaactaaaaatagcagcacagaccagaaaggtatgtcatggtacttgaattctgtgcagagcaataagtacaaatgcagcttaacaggggccttcagagttgtatctttggtgaaggagaaaatagacaatggcagggagaaactgaaggactcagtaggtctggaactggggcagcactgggtgctataagcttgtccttcaggggtctacagatgctgacacctgggaagtcatcctgcatcatctgctcactgctcactgggctcagcagctatgtcctcacaaataaccagattcaatcaacctggccttctccacccaacctggggaatgtattccagtgactgtttcaactgaggttctatgaaggggttgggggataagaagaggggactgatttgcttgaagaaaccattgcacaccctttcctttcatctaaaacctattaatggaaactctgaggccacccatagaagtctagctggtcttctaaatttgggagttacgaaggagtcattcctgatcaatctacaggataaggggccatcagcagctggtggtcagagtgaggaagaaaatggcttccttgagagactcatcagcacagccaccaactctggggaaaatggggcacttgctataacagtcaccccaaactactcacaggagcctgagcctcgtcccctcaccttattgtttctgattctggtccatgcctctgttttccctggacccctcgcccatgtctgagtccagggtagcaggggtagttccatcccagtcaacatctatacagaagtaacagctgctatggcttgaagccgagtctacagttctacccatgagggcctctttttctccccaatcccctcacacaggtgaccagtgctgtgggtctggtggagtggccactggccactggtcccaggcgaacacaaagtatttattcctctctaacaccaggcatatattggagggggtttggtgggtgtagaacagagtggttcttccagatgcaaagcagtaagaccctgtctacagaaagtcatttcacaaacctccacaccctttcatgataaaaacgctcagtgaactatgaatacaaagaaactaccctaacatagtaaaagctatctatgaaaatcccacagtcaacatcacacataatcttaaagaccaaagatatgtttttgtaatatcaggaacatagcaacaatgtacacttcactgcttctattcaaaacagtattgaaagtcctagccacagcaataaggcaagagaaataaataaacaggataacaattagaaataaaaagtaaaactatctctgttttcaatggatttaatgtcatatgtagaatacccttaaaagttccacaaaacagcttttgtcagaatgattaaatgtattctgtaatgttcagaatacaaaatcaccatgtaaaaacacctcatggctgggcatggtgactcacgcctataatcctggcactttgagaggctgaggtgggaggattacttgggatcaagagttcaaggacagcctgggctacaaagcaagagcctgtctcaagaagaaaaacgaaagaaagagagaaacaaagaaagagatagaaagaaagaaagaagaaagaaaatctcttatatttcaatacttagaaaatctcttatatttcaatatttaaacaaggacacaggaaaaaacccaaaacaaaattaataaaacaaatcaaattgcaacatcattagagagagtaaaatatggctgggcacagtagctcatgcctgcaatctcagcactttgggaggctgatttggacggatcatctgaggttagaagttcaagaccagcctcaacaatatggtaaagcctcgttcctacaagataaaataaaataaaattgctagctgtggtggcacatgcctgtaatcccagctactcaggggtccaagtcacaagaattgcttcagcctaggagggagaggttgcagtgagccaagatcttgccactgtactccagcctgggtgacagtgagacattgtctcaaagaaacaaataaataaaaatgaaacagtaaaatacttaagaataaagttattcaaagaggtgaaagacttgtagattgaaaagtataaaacattactaaaagaaattaaagaatacacaaataaatggaaagaaatcctttgttcatatactggaaaactcagtattgttatgctaacaaaacaaaccaggaggaattgacagattcatttcaatctctgaaaacattccagtaatattttatgcaagaatagaaaaaaattaaacctaaaatatatatagagtatgaagggaacctaaacagtcaaagtcatcttgtaaaagaagaccagtgttggaggtctcacactttctgatttcaaaacatactacaaagctacactaatcaaaacagagtggtatatatgtaacatacatactgacaaataaaatagaactgagtgcctagaaaaaaaactcttagttatacagtcaaataattttaaacaaggttgtcaagacttttcagtggaaacagtacagtctttcacaaatatagacgttctgggaaataatactgaatggcttttgctgttgttgtttttgaatggtctcaaatgttctctcaaagatgctgcagaacatagcttattgattttgtaagttaaaaggctgagtaagactgtgagagactccctgctcatcatcattcttcttccacttccagtgactactcttatattctgtgccataagccaacagctactgaccccaggatcttttaatccttctgtaaaactgtcattaaaaaaaaattgtctaaagtaaattttttaaaaaattctcacttaaaccagctgtttatccaatataaggctcaacacaaatagttacagaaagccagtaggtcattaaaacaattaatttagtcattcaaataaaaatgaacaccatgtaacactaatatcaaattatagtcacaggggcaggatttcagcaacagcaagagaaagtagcacaaataggaatgagcaaagaatagacaattaatgagtgtgaattggcctggaaaatattgtggcaatgtccaaagataaatccacagttatttgtgaaacaagtgaaagaccacgcattctcagtccaggaaagccaccagggggtggtctgggtctcttgaactgtaagaagctcaagaggtccaaacttcatgaaccctgcacaggtgctcattgactcatgtaaacgttagagcagctgcttcctcccacaggacaaatccacagcacacagcctccctgggctggcccctcacagtgtagctgctctcaggcctgtggacccaggtggtgataaaggcagtaaagatttgcataaagcagcacacagcacaccccctccatggagagagctcaataggagataaagagccatcagaatccagccccagctctggcgccaggggtcccttccaatatcagcaccatggcctggactcctctctttctgttcctcctcacttgctgcccaggttaagagagatttcaaataccagcctttggagggatccttctgtctgcccttctaatttctaacatgtgtctgttttttgtttcagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgctcagcacagtgacagactcataagaggaaccaagacataaacctccctcggcccttgtgatgtggagattgtgtgatcatacacaccagctctcaagacagcctacatgtggaccagccatagaaaggggaaggaaagggtctgaattgatttctatccctccttgtgccctgaagtggaggaaatgtgagagtgatttgcagtaattgaatgagacaaagcaaaagttatttgttttatatgaaaaaaaaaaacagaaacagcaggatcagatctaaaggctgagtctaaatgcatttcctccagacagaagcttcttcaaacgatgggctttctgagctaagagcaaagaaaataaactctccacgggtatattattaaagtttattttattgagttactttcaaagcaatccatgactattatataaagtcagaaagtattaaaaatcaccaagttctctgctaagctaccttatcccatgcaatcaaaataagtacttttcttcatttggatgcattttttatttctgtttttaatatttccacaatggtgattaaacctggtgctcattcctctggtttgatccacctttatgctcttgtcatttaaagttaatgtaagtagtgttccatttatttaaaaggataaaatattttaatagttgatcattgcattttgaactgagtaccagtgaagtattctagcttttaggtaatttcaattgtttgctagtcaatgatgttatacgttgttgtcattaaaccattcctggtcatttctgtggattttgtgaggtcagagaaaatgtctgtgcttttcaatggaaagccttgggtacattattcctgacttcccaacgcacaaaatagagaaacacaaatttcctgctcatgttagttagagcataagagattcaggtacgaggaacaatttataccccaaactacatacagtgtcttcaggcatgtattagaagtgtacttctcaaactctctgatacccttagttctgaagaagctcaaagttggctaatacttttatatttatctttttattttttttacctcagccagcactttctcctgattcctggggttttctgcatttccagtgaatccagtgaatcacacaaataggctaactgattcttcccaaactccagcactctcccttatgtgctgatctagtgaggaatcacatgggaagagagacccatggatttctggcggcctgggaagtgagttcatggctggcctcagcttgcaaaccagacacttgtctccttgtttccctttactgttcattgggttcagcagctgtgtccttccaggtttcctggacagtgatggaccacactctcccaactcccaaccacccgctcctcaaaaggaataaccagactcagcaacttatgtgaggggcacagccaggggtcaggatagattggcattaagtcccctcaattaagagaggccagggaaggggggctgttccccctaatccgtgtggctcaggaagcagagctctagagacatctctaccatggcctgcaccccctcctcctcaccctcctcagtcgcggcacaggtggctggagacagggagtcagggactggcactggcaggaccagggctctgctttgctcccctggctcactgagctgcctccctcaccctgtgtctctctcccgactctcagggtcccgggcaatcatggctcatcaggtaacctgcaccgtctgtctgtggctaaaccagccaccatctcctgaactggaagcagcagcaataaggttcttggaattgtgacctggtgccaacaatgaccaggaagtgcctccaagcttctgactcatagaagtaaatatctgcccgcagggattcaggacagacgctcaggctaccagtcttgcatgaagcccttcctaagcatctctgggctttaggctgaggacaaggctgatcactcctgttggcttcagacagccccctggaggtccaaacagtgctgcagtctgggaaagtgagatgagaacacgccaggtctcctaggagcatgaccttccaatggcaccacccacaaccaggacagctggtctgtttaccatttgtgtggatgtttcttgatgctgccgctaaccagggcccaagacttagttcggggacagtgatctagagaatacagctttgttctctcacagccagccctcagaggaagcccttagcaacagcattgtcagactgcctcaaaaaaatcagtctttgattccaggaacaggctgccctggggacagactcaagatgagtcagggtaagcagggacagaatccagctgggtctgcctcaggcatgtgcactaacgcaaaggtctgttcatccttattgtctactaaacacctattatgtgccagtctcaggagagtgctcaggatacagagtttacaagacagacagggttcctgtctttacagggataatgcctcacagaagagtgagcaccaacaaatcaatgagaataaggcatattgtgaggtataaaatggttgacatgggccagaagacagtgagcaacaagaagctattaggaggttgtaagcaaggagatacagactctggtttgagattcaggaggcaaagtccagcttctctaaggaagatgaaaaaggaggggacagagtgaagaaagatggtccagttaggacatggtggctttgtacacatgagagatgaggtttctggcaagtaatgtggcagctgagctgaggcctgtgctgtggatcccagacgggagccacctgctaggcctaggctggagccctctgcctctgctcacgaggaccagcagctgtgtccttacaggtccttagggagccacagaacagccccaccctggtccaccccatcccaggctcagctttctaggcaagggtcagagtcagggcctagggtgggacttggccagcccaggggaggaggctggtgtgcatgaagagaccctccttcatcctgggctgctggcgaaagtaatagggactgggggagctcaagcccagctgagtgtcatcaggatgcagagctgtgtgtgggtccccaccaaggcctgagctcctccctttctcccccttctcattcactgcacaggtaactagggctagggatcagggctgtgggtgaatggaacgaggaccctgcatgctgccctctcaactgacccacctctctcaccctctgttagtccaggtgtcaaggttctgggcccagtctgtgctgactcagtggtgtgaagagttcctgtgggtggggtaaactgccgccatctatcacacttgaagcagaagcaaggctgggtgtgggcctgtgtcctggtatcagcagtgcccccaaactcctcatctatgacagcagtcattggtctgcacaggtcccagcgaagttctcaggtcccaggttggggatcatggcatccctgagcatctctgggctccaggcagagaatgaggctgattctttcgctcatcttgagacccaaggatccatgattaggcagtgctgcaggccagtgggtagctgggaggaaaaccttctgtctccccagtaatgtgtcttccctcttcagcctccaccccttcagcacaagtttctggggaggagggtctgaagcccgggtgagaaaaagggtcaaggctggccttaggacctggatgggcacagtgaccccctgctgagagggccttcatgagcaagaaggctgggggaggtcctgagttgatttttacaatggaaacagacaccagctccccatccttgttcaaaagcatctcaggaccttttcctctgcagatggcaagggggagaatctccctctgagatacatgagaattcccttcccatgacctgtcctgtcacctggatgaattcgtatttggaaaccaaatgactccccagtgccaggcattacatcctcacagaaaacctgccagaatgagcaagatcttccctccctgacccactggccaggaatctcggacatcaggatggctggactagatcactcatgccatctcccctgacatcatcatggttaccggggggactctctgattaatttgggccacacagtgcctgtccctggcattgcagttggggacgcttacaggctaagtttatggctgggagacctagggtctagaaaggagaggaatagaacagaagctttgcctacatggccccctgtgtgcatcactcttccctccacctttatcctaagttcatgatgggtgatgtctccttgaggctggaacctgggcagtgacatgggcctgtgtgtcctcatctcacaatgcttcatcttgggctccctgacctttctgatattcctataatggatcaatttcaggctaggacacagccatgcccatacaggaggcagtgatctgagaatcaggtagtcttagaagagacagaaagcaaataaacaccctcatgttggcctcctaagcccagaggacataaggaaatgaaaggaattcaagaagaaacataagtggtcactgcccaccatcacctgggcacctgttctccacctgcccctctctcagtgaggaccagactcagaggcctagagaaacacgtcttcatctgttcacaccgtggggtgcctccttctggactcatcccaagactgctgctcccccagcttacctgtgtaactgctgagagtcttcacagggacctggtcacagggtttgggatcaggatcagcctggctttaactcagctgtgaccctgccccttcaggacaaaaagtgaactattagggctctaactgaactctcctgatttacttaaatcttatattctccttctcaatatccttctaggaagttctgtctctacccaataatgtcaggtcatttcctcaggcctagagccatttgatttccagacttctatactcacacttatgctctcattctctgtcatggttcatttactacgcagcagctaatgaggccaaccatgtatctacagcccattgacatgaaaaatggggaggagagggttccttagataaatacagggttagcaaaggaaagtttcttaggaatcacttcaggatccaagaaaattcattccagagcttcgagagtttacaactcaaaaacaacagcataatatatgaggtggtgaatcttcttggccttctcaatgaataacctcagaaatggtcagagaatatgcttcaaaaaggtaagagtatgactttcacaaacatatagtattcacatatgtcaacaattttaattggtttatgtattttggagaaaaacagtatgatgataaataaatgttaaaaagcatttttaaaaactcagtgcttatactccaccaggatagaacctgtgaaggaaatttctgtgttgaagatacactgtcttttagaataatagcaacatagctatgaattttgtcttctcatctcacaatctacaaattaaaatcaccccatttatgtgaaatatctagaaaaatacaggtacatttggacattcccatctgccaccacccatccatcttctcctaaagtggaatccctctgcccccattctgctcctctccacacatctacctgctaacacgtgactcctccctgccttcctttccagatccctagcagattgggcccaccaggggaacaagctcttggacctggggatcaaaagtgcatcttgttggacttctgaggacttgccctgcaagggtctctttctggatcacaatccctctgttcctgggcatccccttttgctggatcctgttatttatctctgtgttactccatctaggtctactctgtggacttccctgcatcttcacctgaaccccaggaatcttcaagtcatgccaatattccctcagttctcctgaaatgtcttattttctcttctcctgagatcccaccaagtcatcccttctgagacccctgagtgtagcagggccctctctggtctctttgcttcaattatgaatgaggagaatgggaggtcctctttgccgctcctacccctgtgttgccatcaggatcagcttcatgaggcagaatgaggctgtctagatcaacatggctttcccaacattgagctctgtgcccagcacaaggtaggtgctcagtaactatttgagaaaacctacatttcatcacactggccacattacactgagtccaggatggggatgaactgggagaagcagtggtggaaatattcctctctctgctttcaggctaagaactgatgggacgttcaccagggagagcatcccttggcagaaagggggccatgggcatccttgtcctgtatgggagacactgctcagcctgggggaacctctgttcatgaaggtgggagaaaaagataaacaaaattcactgtgaatgtctatgtatcatcacagaggaggcaatgacaagaaaataggaagtgcaagcccagttacaattggtttctactttaaaagaaataaaatttaatatgcctggtgtgttatgtaaacacaacaaacatttttcgaaaactataaaaatatttaaagtaacatggtttacaataaataggaacatttgaaataatgacaccctggaaatgcaatcctaaaatacagcatacattttatttcagttatttatcttgactggttttatttaaatgtctatattagagatcactacttcattgtggatttttgtttgtttgcttgtttgttgtttttgagatagagtctagctctgtcacccaggctggagtgcagtagcacaatctcgacttattgcagtctccagctcccaggttcaagcacttctcctgcctcagcctcccacgcacctgggaccacaggtgcgcaccagtatgcctggctaatttttgtgtttttagtagagatggggtttcttttttttttttttttttttttgagaccgagtcttcctctgttgccaggctgaagttcagtggcgcaatctcggtacactgcaacctctgcctcccaggtttaagcaattgtcctgcctcagccttctgagtagctgggactacaggcacccgccaccatgcccagctaattttcacatttttaatagagatgggatttcaccatgttgcccaggatggtcttgatctcttgacctcgtgatccgcccaccttggcctcccaaagtgctgggattacaggcgtgagccactgcacccggcctaagatggggtttcatcatgttgaccaggatggtctcaaactcctgacctcaagtgatccactcacctcagcctcccaaagtgctgggatgacaggcgtgagccacagtgctcgacctagtacattgtttaaatggtgcatgtaaaacctcatggtactacaactgcctggtgacagactcaccagagtaaataactatcctgctgttctccaaccacatgggattgccccaaaaaatatttgttgaatcccaggtgtatcatgccagaactcttgcagtcatatatacaatctgtttcattttaataaataggattatcttttttcttcagtttactgtttttaatgtatcatattctagatttcattacacatcaaagatgaataatttctatcatctttcagacatgcccaaaacactcattagcgattttgaacagtattctttcctaaacatcctagttggaatggttgatcctaaaagctaccacgtgtcaggctcacttaagtacagactctggtcaaaacaagctgaagttttaactcttccatcttcaaatactgagcatatttgcttgttttgctctttagcaaaacactgcaaagtcatttgccaggatcccccgcagattggcattcagtgatggagaacagactcctaggtgagatccctggtcacaggatcccgatgactatgactgcaagtctggaaaagaagagacagaacaaagatttaccagcataaccctctgagaatgtgccccaggcatcccggagggaagagctccctatcgacccaggactgcagaatccacagaggaaggagagctctggccaccagggagcagccacacgagaggagaggacccagtgcccccacaggtgaggaaatgagtccatggggctggtcactgctctcgatttcattctgacataagaggactttgtgtagtcaccacctgagtcctatacagtgaacagccaaggagacatggacagattcacccctgaggaacccagtagaatgtgaagtctgccctgagctcacgaaaaaaatgactcagggggctgcctggcctggccctgatggagggggccatggacagaacaacggggagtgaggggtgtctctgagaggctctggtcaccttgttatacaatggtggtgtacatgaccaaaatggacaccaggggatgcctgcgtaccattactgagaagactgggtgtgatgagagcaggaccagcgccacctgtcctgcttggtgccctatgcttagggcttacagatgtcaactctgcaccccctgggaccacatagccccacccctggcactctctgacatcctcaggcagaggagcctgacccagggcccaaggtgggatcagaaagctggagggtctgatttgcatggatggaccctccttctctcagagtataaagaggggcagggagagacttggggaagctctgcttcagctgtgagcacagaaggcaggactcgggacaatcttcatcatgacctgctcccctctcctcctcacccttctcattcactgcacaggtgcccagacacagggtcaggggaggggtccaggaagcccatgaggccctgctttctccttctctctctagaccaagaatcaccgtgtctgtgtctctcctgcttccacggtcctgggcccagtctgtgttgacgcagccgccttcagtgtctgcggccccaggacagaaggtcaccatctcctgctctggaagcagctccgacatggggaattatgcggtatcctggtaccagcagctcccaggaacagcccccaaactcctcatctatgaaaataataagcgaccctcagggattcctgaccgattctctggctccaagtctggcacctcagccaccctgggcatcactggcctctggcctgaggactaggccgattattactgcttagcatgggataccagcctgagagcttgcacagtgctccaggccaatggggaactgagacaagaaccctcttcctcctccgccaggagggtgagtgcctgcagctgctgctcacacctgacctgtagcttctgctgctgtagcttcccccatgggcctcggggcatccagggccttgcctaggagtggaggctccaccacttttgtcctcagagtcaggaacagggaccccaggagacagaatatcctgctcctcagcttgggacacagggtctctgcactgaaatcgtgggctgaggtggcaggtccaactgtgtcttcacagtccttcctgtgcctgcccatggtgtggggacggagtgaggaagtgtgggccattgagcttcactagaggcctgagggagcagaggtgctcccgaagacctggactccttccgtcaccctcctcccatcactctcctcactgtagctgtggccaggtgagggctcagggctacttgaggaccttgctcaacccagggcctccatcccaggcattgtttccaaactctgtaagggctgtctctgaatctgtagaaacatttatttctatgtgcccaggactgggttagagggcaccaaccccaccccttgcaaactgctcatcacctctcagtgaaacaatgaggagaagaaagagttagaaatcagaagcctccccaaggctcccctctctcctctcaaccagcctccccttggcttcctccttccacagaaataaagaggaggcagccacagaaggcaagggaaggtccaggcattataccaggcagtggagccagccagtccccccagatggtggagggaggtggtggaggtgtctgggaccagaaaatagtgaggaccctcttactaaagtgaggaggggtggcataaactgaggctcagatggtggaccagatctcctgagccatctactcatttcttcttgagtttcagtttcagtaagaataggataaaaaaaaagtctgaagaggttcctttcctcagataagaattcgtagaggattattgcccactcaggcattgaggggaggctgagcctccctctcaggccaatagaactgggggctttcatgggaatttgattgtactgaagctcccagactctgacatctaagacttatgctctcgtagcagagcccagcactgataccaaaatggataaaggctgattgataagcctggaatatcctagctgacaccgacttgtggaaaagagaatcaagttagaatattgatgtgataaggtggcatcgcacagtgaggagaggagagcttgtgtgggggagggtagaggagccattagagggttggacaaagaggacacagaatctgaggtaagtttgtgaggaaaactccagatgcttcagagaagatggacaaggaggtaggcagtatgaaggccatgggaccagctctagtcaccgggagtgagtggtgagattcagcaccagtgtctggggaggaggtactgaagcctgggtgaggggagatgctcaaggctggccttaggacctgagtggggcacagtgatcacactgctggggggtccttcaagtgcaagggggctgcaggaaggctcgagctcattgtcacaatgaaaacttagacaacagctccccagacttgttcaaaggtgtcacaggactttttcctctccacatggcaacggggagaggaaaacttatctctgagatatataagatgtttgttctccataacctctcctgtcccctggctgaattcctatttggaaacaaaatgactctccagttttacatatgacatcctcactaaaaaaaaagttccagaatgagaaagatctgccctccctgacccactggtgaggaatctcagccttcaggacaaccagacgaaatcgttcatgccatctcccatgacagcatcatggggaccagggagcatatcttatgggtttgggccacacactgcctgtcccaaacattgcagctggggacacttatatgctgaactcatggctgggagatctggggtctagacatgacaggaagaggaaaaagaccaggagctctgcctaagtagccccagtgtgtgaatcactctaccctccaccctcaacttcagttcgtgatgggtgttgtcttgcgaaaactgacagctgggctgggacacaggcaagagagactctgacccacaaatctccatcgtgggctctctggcctttctgatattctttttgcacatcaattctgggccaagacacatccatgctcatcaagaaggcattgataggagaatcaggtagcctccagagagacaggaagcagataaacaccctcatgttggcctcctaagctcagaggagaaaaaaaagggaaagaagttcaagaagccacactagaagccactgatcaccatcacctcggcacctgtcctccatctgcccctctttcaagtaaggaccagactcaggggacagcacctgcacctccctttctgtccatgcactgtgtagggagcctccttctgctctcatctcaaggcgactgctccgccaggtcagccgtgtcactgctgagagtcttacctcagtcctggtcacagggtcttggatcagcagcaacctggctttgattcagctgtgaccctgccccttcaggacacaaagccgatgattaaagcctaactgaactctcctagatttctcaaaccttagattctccttctctgtgtccctctagaaagtgccacctctaccaaataatttcatgttatttcctcaggtctagagctatttgattaccaaaattctatactcactcttctgctctcattccttgtcatggtccattttccactcaggagctaatgatgccaaccctgtatctacaggccattgtcacaaaaaaaaaaagaaatgagagggttccttagataaatacagggttagcaaagaaaagtttcattaccccttaggaattactccaagatctaagaaaattaattccagagcttcaagagtttactcctcagaaacaacagcatgaatacattaggtagtgaatgttcttggtcttctcaatgaataacctctgaaaggttcagagtatacgtttcaaaaagataagtgcataactttcacaaaaatgtaatcttaacttatgtcatcaattttaattggtatatatatttctggaaaaaaaagcagtatgatggtaaaagaaatgtaaaaaagcctttgtaaaacccagtgcttacagtccaccaggatagcacctgtgaagcaaattttctttgctgaagatacaccgccttttagaataatagcaagatagtttgaatttgtcttcttctctcacaacaatctaaaaattaacatgatcccatttatatgaaatatctagaaatatatctgtacatgtggacattcccatcgcacacctcccatccaggctgtcctaaagtggcatctcctcttcttctgctcatgttctccccctctcctcacctctcctgctgacacgtggctcctccctgccttcctctccagtagccccagcagatcaggcccaaccagtcaacaagctcctggacttggggaacaaaagtacatcttcttggatttctgaggacttgccctgccagggtgtctttctcaatccaatctctccttcccggcagtccacttctcctagatcctgtaatttatctaatcttattcatctgtatctacttcgtggacttccttacatcttcacctgaacaccaggaatcttcaggtcatgcccatatgcccttggttctcctgtagtcccttcttccttcttcccctgtgatgccaccaagtcgaagtctcttctcagaccctggagtgcagcagggacttctctggtctctgccccagggattaagggggtggaagagtggactcctgtgcccttcctatgcctgtgttttcatcagggttagctgcaaaaggtagggattaggctgtctaggtagggattatggcattaggtagggattatggcatttccagagctgagctctatgcccagcaaaagatacgtgctcagcaactacttgacagagacctacctcttatcacatgggacacattatactggacccaggatggggctgaactgggagaggtagctgtggacctgctcctcgctctgccctcaccctaagagctgatggggcatccaccaggaagagcattcctgggcagggagagggccatgagcagccttgtcctgtatgtgagacacagctcagcccggtcacaagatccagatgactatgactgcaattcaggggaagtagagaatgaagattgaccagaataaccctctgggaatgtgccctgggcctcctagagggaagagcttcccttctattcagcgctgcaggatccacagaggaaggagagccctggccaccagggaggagccacatgagaggacccggtgtccccacaaatgggaacgtgagtccatgaaagtcggtccctgctctgggtttgattgtgacctatgaggacattgtgtagtcaccacctgagtcctctacaataaacagtgagagcgccacggacagattcactcccgaggagcccagtaaagtgggaggactgaggtcacagggagaagacacaggcaccacctggcctggccctgacagggggcagtggacagaacagtgcggaggcagtggggtctctagaggctctggtcaccttgtcataccatggtttgtctcggtctggacactagagggcacttggggatcattcctgagaagactgaggttgatcagagcagaaccagccacctgtcctgcctagtgtcctctgctcagggctcacagctgcgtcctttacacccgtgggaccacacagccccacccctgccaccccctgacatcctcaggcatagggacctgacccagggcccagggtgggattagaaagctgggggtctgatttgcatggatggaccctcccactctcagagtatgaagaggggcagggagagatttggggaggctctgcttcagctgtgggcacaagaggcagcactcaggacaatctccagcatggcctggtctcctctcctcctcactctcctcgctcactgcacaggtgactggatacaggtccaggggaggggccctgggaagcctatggattcttgctttctcctgttgtctctagaagccgaataatgatgcctgtgtctctcccacttccagggtcctgggcccagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttccacagtgctccaggcccggggggaactgagacaagaacccacttcctcctctgccaggagggtgagccccggcagctgctgctcaggcctggcctgtggcttctgcggctgctgcttccctcatggtcccaggggcatccagggccctgcctgggagtggaggctcctcctccccttctgtcctcagagtcaggaacagggaatccaggaagcagaatatccctctcccttaacttgggacacaaagtctctacactgaagttctggactcaggtggcagatccagttgtgtcacctcagacccacctctgatagggaacccatgtattcattattctcctttccccaattccaggagtttccggagtggtgtcttcctctccctgctcctcaatgtgagtccctgtgtttcttttctcccaggcctattctttttttttttttttaacaaaactcctttcatgaaggaaaaatgcacacctaataaaccagctgaatttatagcattaaattcggcccattttggcatttttctggatctttgaaaatatcaccaccactgagctatgcaacctctgactaaccccagcagcccttcatgatgctttgtcatctccttcactccccgaatgccctcctgggcagccaggaatctgcctttgccactactgtatggtttccattttctgaaacttactagtgttatcaaacactatcttcccatttgttcgagcttctttcactctgcacacttcttttcagattctccctgctgttgctgaattgcatcccattctacagagggctcattacaacctttgagggtctaggacattctcttctgattctatttatttacttatttattttaaagtttgaattcattgtccatcaaatcaaactctacgggtgatgttcatctaaggtgacaggagtcagtgagggcttctcaggattcttgcttcttcatctcttccctctaattctttctataatgggagaatttcttatctttttaaagtttttctatttattattttatgttggcttttaaggtttttagtgttttttaaaatttttttatttcaataggtttttgggaaacagatgttgttttgttacataaataagtttgttagtggtgatttctgggattttggtgcactcatcacccaagcagggaacactgtacccaatgtgtagtcttttatccctcaccccatcccaccctttctcctgagtccccaaagtccgttgtatcattcttatgcctttgtgtcctcatagcttagctcccatttatgagtgaaaacatatgatgtttgcccttttattcctgagtgaattcacttataatgatagtctccattccatccgggtttctgttaatgccattatttcattcctttttaaggctgagtagcagtctacatatatatatatatatatatatatatatatatatataccacatttgcttcatccactcattgattgatgggcatttgggttggttctatgtttttgcaattgcaaattgtgctgctataaacatgagtgttcaagtaattttttcatgtaatgacttcttttcctcttggtagatacctagtagtgagattgctggatcaaatggtagatccagttctttaatgaatctccacactcttttccatagtggttgtactagtttacattcccaccaacagtgtaaaagggttcccttttcaccacatccatgccagcatcaattattttaatttttttattatgcccattcttgagggagtaaggtggtattgcattgtgactttgattttcatttctctaatcgttagtgatcttgagcattttgccatatgcttgttagccatttgtatatcttcttttgagaattgtctattcatgtctttagcccactttttgatgagattgtttgtttttttcttgctgattagtttgagttctttgtagattctggatattaatactttattagatgtatagattgggaagattttctttcactctgtgggttgtcagttaactctgctgactgtttattttgctgtgcagaggctatttcatttaattcagtcccatctatttatcttcgtttttaatgcatttcattttggattcttggttataaagtctttgcttaagccaatttcttctagaatttctaaggtttcatgtcttagatttaagtctttgaccaatcttgtgttagttttgtataagatgagagatgaagatccattttcattcttctacgtgtgacttgcctattatctcagcaccatttgttgaatagcgtctccttttcccactttatgtttttgtttgctttgtcaaagatcagttaactctaagtattttgcttcatttctgcattctctattctgttacatcggtctatgtgcctatttttataccagtaccatgctgttttggtcattatggctttatagcatagtttgaagtcaggtaatgtgatgcttccagatttgttatttttgtgtagacttgttttggctaccggggctctttcttggtttcatatgaattttagttctatgaagttctgtgaagaatgatggtggtattttgatggaaattgtattaaacttgtagattgttttggcagtatggtcattttcacaatattcattctatacatccatgagcataaaatgtatttccatttgtgtcatctgtgacttctttcagcagtgttttgcagctttcctggtagaggtctttcactttcttggttaggtatatttctaagtattttagttttttggcagctattgtaaaaggggttgagttcttgctttgattctcagcttggttgctgtcgttgtatagcactgctactgatttgtgtcctttaattttgtatcctaaaacttgctgaatactttcactagtgctagaagcatttggggtgagtcttcagggttttctatgtatacaatcatattatcagcaaacagtgacagtttgacttcctccttatcagtttggatatccctgatttctttctcttgtctgattgctctggctaagacttccagtactacgttgaatagaagtggtgaaagtgggcatccttttgttgttccatttctcaggggaaatgcttttaacttttccccattgagtataatgttggctgtgggtttgccatagatggcttttgttgccataaggtatggtcccttctatgctgattttgccaagtttgaatcataaaggatgctggatttcgttagatgccttttctgcatctattaagataatcatgtgattttgtgttttaattctgtttatatggtgtatcacatttatcaacttgtggatgttaaaccatctctgcatttctggtataaaagcaatttgatcatggtagattatctttaagacagctgttggatttgggtagctagtattttgttgaggatttttgcatctagattcatcagaaatattggtctgtagtttatttttgttatgtcctccctggttttggtatcagaatgatactgtcttcacagaatgatttagaaaggattcccattttctctatgctgttgaatagagtcagaaggattggtaccagttcttctttgaatatctaatagaattcagctgtgaatccatctggtcctggattttttgttgtttgcaattttttttattaccatttcaatctagctgcttgttattggtctgttcagagtttctacatcttcctggtttaacctagtagtgttgtatatttccaggagttcatccatctcctttaagatttctagtttatgtacataaaagagttcatagtagcctttaatgatcttttgtatttctgtggtatcaatagtaatatctcccgtttcatttctaattgagcttatgtgggtcttctctcttcttttcttggttaatctcgttaatggtctgccaattttatttatcttttcaaagaaccagctttttgtttcatttatcttttgtatttttttttgttttgacttcatttagttctgctctgatcttcattatttcttttcttttcctgggtttgggtttggattgttgtggtttctccagttctgtgaggggtgaccttagattttctacttgtgctctttcagactttttgatgtaggtatttaatgctataaactgtcctttaagcaccacttttgctgtatcccagagcttttgacaggttgcattaagatttagaacaattgcaatcttactatcaatcaacagctttttaattcctgaggatgtgacctcatttaatcctgacaatagctttattattgcttttcaggcagtagaccgtgattgaagaggtaatgctttgtggcctggaggtaaggttctaaaatttatcaaatattaaattggtgcacaagtaattgcaggttttacaaataaaagtaatggcaaaacccacaaggacttgtgcaccaatgtgatataaacactggaggtcagttaaatttgaattcagtaaaaacaatgataaagaatctgtatgtgtatcacccacacagtattgttcaattgtaatacaaacaactgggtgccctgcattttatcgggaaactccacacagggttcgcagcttgaaagaggcagagctgtggcaggcctgcccttcctgatgccaggtctaggtgcttaacgtcaaagacagagcttctctaagagagctaccctcaagtgaacatgtcagttggcactaaatacatgtgatatgatccccagtcaatgatccccactcacttccctaattctttctattatcctttaagtttgcagactcagggcctccccagaaattgctgcagcctgagttctggacctgggaccgcatgtcctgtcacaaccagatgcaaaagggctctttagtccctacacagaatggcttcagccaggagagcataaataacatgtaagattagaagagctcagaggggctctccttctgtcccatgacagatgaaacttcagggctctgatgcttgtcagggaatctccttcagtgaggccaagatcccaggactttactaaaattagcagagtggaccagacaggcatgtcatggtacaggaattgtgttcagaacaataagtgcagatgcatcttaacaagggccttcacgttctatctttggtgaaaaaggaaatagacaaaggcatggagaaactgaaggactcaatgggtctgggactgaggtagcgctgagtgctttgggcttgtcctggagcagtctgcagatgataacagctgggaagtccacccctgctgtgaccttgtttcatctgcccactggatcagtggctgtgtcctcacaggaaagctggctgtagccagactggccttctccatcccacctgggaaatgtattcagatgactctctggggtgaggttctactaagggcttgggagttatgaggagggggctgatttgcatgaaagaaccatttcaccccctttccttcatctaaaacccattaatagaaacttcagggccattcatagaagtccagctggtctcctacatttgtggggcataaaggatcaatgcctgatgaatgcctgatcaatctaaaggaagaggggctatcagcaggtagtggtcagagtgagaaaggaactgacttttttgagagattcatcaacacagccaccaactctgggacaaatggggtgactctctgtaactgtcaccccaaattacccacaggacactgagccagtcccctcattctattgcttctggttctagtccattcccctattgtccctaaacacgttgcccatgtctgagtccagggtggcagggatacctccatcccagtcaacatctacagagggcctcttctgttcccctctcacctcatgcaggttactactgttgtgggtctggtggagtggcccctggagaacacaaggtatcccttcctctggaaagccaggcatgtaatagacatggtatgggttgatgtagagcagagtggctcatccagatgcaaagcagtaagaccttggctacagaaaattatttcacaaaattccacaccctttcatgacaaaaacactcgatgaactataaatagaaggaaactacctcaacatagtaaagaccatctatgaaactcccatagtttacatcacataaaatctgaacaaccagagacattttctgtaatatcaggaacaaaccaaggatgcatactttcacatcttcaattccaaatattattggaagacctaggcagagcatttagcctagaaaaagaaataaacagaataaaaactagaaataaaagtataaaattatctctgttttcagatgacataatgtcatatgtagaacgccattaaaagacccagaaaataattctgaaagaatgattaagtgaatttggtaatgtttcaggatacaaaatcaccacttaagaacatctcatggctaggcatggtggctgacgcctataatcccaacactagggaggctgaggtgggagaattgcttggggtcaacagttcaagaacagcatgagcaacaaagcaagaacctgtctctaccaaaaataaaaaaataaaaaggaaggaaagtcacttgtatttctatacttaaccaaacaggacaccacccaaaatgaaattaagaaaacaattcaagaggacccacagaccctctgaaggaaggggactgcacccgcaggacccgggagacaccgcaaatactgtgagtgcctcaactgcggaagtgggaaaaggagaccctcctctcccaaacacacacccctactgaagaatgtgaaagtctgttagcaggagaagttctcaactttacctggaacggagttaagttagacagccaagctcagtgaaatacacaggtgtaggaggtagcggggaggccctgggaacttgctgaatccccaagcaacccattcctttctggcaccacaggaatacatcaggaaggaggacagacaagcagcgggtaaaactccacgggaagaaggacttccctagctgaactttgcaacaattcgaatcgggtgagaggcctcctggctctagtatccatggcactagtatccatggctgagaggcccatggatagttcacatcacaggactctgtgcagaaacccccagtaccagcccagagccgggtagacttgctgggtggctagacccagaagagaaacaaaaatcactgcagttcagctcgcaggaagacatccacaggaaaagggggagagtgctacatcaagggaacaccccatggaacaaaaaaaatcttaccagcctttagccctagacctctcctctgacagagcctaccaaaatgagaaataacttggggggaagagtgggagaggggcgaggagtaaaagacaacaaacatggtacagtgtatactgctcaggtgatggctgcaccgggatctcacaaatcacccctaaagaacttactcatgtaaccaaacaccatcttcccaataacttacagaaaaaaaaaaaagaatattataacaatggaatcatatattatgcagcctttcagcattggcttttttcacggagcacaatttccttgagatatatctgagttgcgttgtatcaattatatagtttgtttctttttattgctgagtaatgtttcatggtacggttgtatcaagcttgtttaaccattcgccagttgaggaacatgtggattatttccagtttatttttttggctattaggaataaaactactatgaacattcttatacattaaaaaaaaaagaaaacaattcaaatttcgtcattagaatgagtaaaatgcggctggcacggtatctggtgcccataatcccagcactttgggaggctgagacgggggatcatctgaggtcaggagttgttagagaccagcctggccaatatggtgaaaccctgtctctactaaaaaaagattaaaaaaaattagctgggtgggtggcacactcagtgattgcagctactcatgaggctgaggcacaataatcacttgaacccaggagacagagtttgcagtgagaggagatggtgccactgcactctaacctaggtgacacagtgagactctgtcccaaataaataaataaatgtaaaatacttaagaataaacttaagaaggtaaaacacttgcacattgaaaacaataaaacattgctaaaagaaattgaagaatacacaaataaatggaaagacgtttttgattatgtattggaaaactcaatattgttaagataccagtagaaaccaaaataaaatatactatagagtcatcacaatctttatcaaaattccaatactacttggtacaagaatggatataattctaaaatccagatacccaaaatagccaaaataatcttgtaaaagaagaacgttgttggaatcctgacacttcctgattccaaagcatactaaaaagatacactaatcaaaacagagtggtacatatagacagacatacagacaaatagaatagaattgagtgccttggagaaaactctcagttatatggtcaaatgattttcaacaagcttgccaagaccattcgtgagggaaagaacagtctttttaacaaatgctgttgagaaaactggatatccacatgcaatctggaagtgaatcaaagacacaaatgggagagccacaactgaatcttaaaagaaaacattgggaagtaggtccacaacgtagggtttggaaatgatttcttggatatggcacaaaaaagacagggaaaacatagaaaaagaagaatatagataaattgcatttcatcaaactgtaaaacttatgtgcagcaaaggacactaccaacagagtgaaaatgcagataatagaatgggaaagattgttacaaactttatatctgataaggcatccaagctatagaaagaacttctacaactcaacagtaacaacaaaaataggaataacccgaaaaaaacaaggacaaaggacttgagtagatattactacaaaaaaagatctacgaatgtccaataagtacatgaaaagatgtacagcatcaccaattattagtacactgcaaatcaaatcacaataatatacaactctatacccattaggatggcattaaccaaataacagaaaattaaaagttctagcaaagatgtttagaaattgcaactgttacgatttgctggagagactgcagaatgatgcttccactgtggatgccttatggctgttcctcataaaatcaaacatagaattaccattttatcagaattttcacttctgggaatgtgcctgaaaaaattgaaagcaagatctcaaagagaaaattgtacatcctcgttcatagcagcattgttcacaatagctaaaaggtggaggcagcccaagtgtcaactaatgaatcaacaagatatattatacacacacaagggaatattattcagccttaaaaagaaagtctgacccatgcgatggcatggatgaacctttaagacatcatgccgtcagaaataagctgacttcaaaaggacaaaaattgtttgccagcccttatatgaggtacctagaatagttaactccacagtgacaagaagtaaaacgatgtttcccaggtatgaagttttggtttgggaaaataaaaaatttgtggagatgagtggcagtactgtggttgtacaacagtgttaatttacttaatgtcactgaagtatacatttgaaaattgttgaaataatgtattttgtgtatgaatattttactacagccaaaaagaggaagatttatgtttggtgcagtttctctacctccaagaacagtggaaacctacaggactaggagagtgtgcatgagtatccaggacactcttccttttatgccagccccacagcatccaggacacccttccttttattccagccctgcagcatcctaacaagttaagagagtcagacgtacctcattacaggtgactcagaataatatgagaaagtctagaggtggccatgatgttagcggtgggtgcccaacccagcccaggagcagccgcaaatgcaacagtggccaaagaaggggagatgaagctggtggcagaggtagcagcccctccagctggagaggggcatctgcttctgtacaaaatggttcacagttgataagtcttgcatagatgcctcatcgtttacctcatgaccaactacagttttcattgcaatgtacgttatcatagcagtaatgtctatttcctcctgtagcaagcaaacatgaacgaaacgtgctttactgctttgtccaacaggacatgttagtcccaaacacaggctgaatgtttaaaggtaacgttctctaaagataaggatattataccatttattgataaatacggggattgcatgatgaccattcagacacttggaataattacttggctaaataacattgtttaaacaatgagtaaatttagttattctttgcagagcaaaaaagatccaagtttcaccagtcccttggcaaacactacatttcaaactatggaagggagacatcctgaaattttgtgctactctttctgaagacacagaaacagtcaagtcatacctaatacttatgagcataaagctttgataaaattcaagaattatttgcattttgaggaaaaagactttgtcgctaaagcagagaagaacctaaaacggactcctcatagtgagctaatattttataaaaaggtgtcaatcaaggtgtggcttacaaaaatactttcaaggatgtttactttccagccatctcactggacaagaactgggtggttttcattaactttggactgtgctttaatttcctaaaaatgatgtcacttactgccctgagtgacatgggatgggatgctgtggtagagcacactctggctgatgtcttgtacctgctggagacagaaaaggatgggagacacagtcctccacaggaaatctcaaatgggtccctctttcttttcagatatggactttctggggagtaatactgtagggcttttcttgttgttgcctttaactgtctcaaatgttctcccaaagatgctactgaacacagcctctcctttgagcaagttaaaagtctgggtacgactgtgagaggctcctgcctgccaacactctttctccactttcagtgactgctcttcttctgagggccgtaaaccaacaactgctcatcccaagatccactaagccctctgggaaattggtgctgtactgcataccctgcctgctgggacttgttacattgatgtattttctaaggagtgaataatcttgtccaagtaactaacttatttaaagacattttcttcggtgggcactgactccatggcacccgttttccaaggagttggtgagcttgtttctgagaatgccagaaatcaatgtacattccaaatcattctaaaagtgatttcttttcggtgtgggtttggttttgttattaattttgaaatatatctttgaatactgagatctctgaaactactagatctctagaagtgtaattgggaaagaaggttgcttgcagctttaacaaaatgagaaactcttcccaaatacaacctgttttgaagttaaaaaaaaatgtgacattagaacctgcaaaatctaagagtttccaacagcagtctcaattctgatgctaactgtaagctagggactcccccaacaacgcttcacttcttatgattcccaagaaggactcacatcactcactgaaacttgtgacgtttgttgatatgattttttacaacaaaagaatgcagattaaaataattcaaggaaggaggtacatgggcagagttcaggagaattccaagcacaggcattcagttgtcctctcccagtaaagtaatagacaatgctgcattctcctggcagcaatgtgtgattctgtgcatgaattattgccaaccaggaaagctcgctgaagcttggtgtccaggcaggtttttttgggggtgtgagttggggatggggttgcttatgtagaccttgttgatcatccttatggctgactccgacttgaatttccactgaattgacaataaaacttcaaccttaaatatttggttattttctttttaataaattctctaaaataaattattttgaaaatgctcgctttagctagctgtttatccaatatgagactcaacataaatagtttcaaaaagccagtgggtcattaaaacaattcctttagtcatccaaaacattcagataaaaattaacaccatgtaacactaaaatcgaattatagtcactggggctggatttcaacaacaggaagagaaagtagtacaaatagggatgagcaaaaaatagacaagtaatggatgtgaattggcctaggaaatttacagtggcaatgtcaaaaaggtaaatcaatagttatttgacaatacatgctcagtccaggaaagccaccagggggcggtctgggtcgtctgcatcataagaagctcaaggagttcaaactgaatgaaccctgcacagttgctcactgggtcgtgtaaaatgttagagcagctgcttcctcccgcaacacacggccactctgggcagtcccctcacagtgtggctgctctcagggctgagaacctgggtggtgctaaaggtggtgaatgtggtaaagatttgcataaagcaccacacaacacacctcctccacacagggatctcagtagcatcttcaaaggatgggctttctgagctaagagcaataagaagaaactttctaaacttactaaaatttatttattgagttatgttcaaagcaatacatgcctattacataaaatcagaaagtatttaaaatcaccgagttctcggcaaaggttctttattccaagcaatcaatatgactatttttttttatttggatgcattctttcatttttgttctcagtatttccacaatggtgatcaagccttgtgctttttcatctgcttttatacccctttatgatctagtcatttcaggttaatgtaagtagtgttccatttcttaaaagggataaaatatttaaatagttgctaattttatttttatttgaataccaatgaaatattatcatttttagataattcttattgtttgctactcaaacgaagatatgatattatcttattattaaaacactcctggtaacttctgtggattttgtgaggtcagaaaaaaaatgcctgaaattttcaatggaaagccttgagtacattacacctgacttcacaatgcagtaaatagagaaacaagagtttccgattcatgtaagaaggagcataacagattaaggtatgaggaataatttatatccaaaactacaccagtgtctccaggcatgtgttagaacagtaccccccaaattctgttgtgcatatgcatcttctggggattttacaaaatgcagattctgattcagtggctctggagtgaggacacagtctctgcatttctagaaagttcctaccacacaaaatccacatatatgtttgaacaataacaaggccagccaggagaagaggctcaggtgtgtaatcctagcactttgggagtttgaggcaaaagaattacttgaggccaggagtttgagaccagccagggtaacgtcacaagatcttttctctacaaaacatgtttttaaataataaaaaatgaattagccaggcgtagtgtggcatgcttgtcatcgtagatacctaggaggctgaggcaggagggtcgcttcaccccaggagttcaaagctgcgatgagctatgattatgccactgcactccagcctgggtgacaaagtgagaccttacctctaataacaaaaacagccataacaaattcataagaatagtgtaaaataaggagaaaccttggcagacaataacctaagagatatctcagacatagtgaactaatgtgtttggatgacagaagaaccccacacttggctggctgtggtgactcaggcctgtaatcccagcactttaggaggccaaggcgggcagatcacctgaggtcgggagttccagaccagcccggccaacatggaaaagccccgtctctactaaaaatgcaaaattagccgggcgtggtggcgcagcctgtaatcccagctactcgggaggttgagccaggagaatcactggaatccgggaggcggagtttgcggtaagctgagatggaacgagccacactccatgcaggaagacgaccagggaggacagctgcaaagcagggagaggctcccctttctttaagaaacaaaacaaaagcaaacaaacaactaacctgacctcccctctggctcccatccaacattcttactagcttctcatctagtcttttctgtagtgtagcccatccttaccctctcccctcccacatctctgattcctgaattcccttcttgggtctctctccttttcctgtcaaccacttctcccctctatcatcctgagttaattatcaagagctttatagcaggaagcctattggtatttttccagattttttttcttggaattggacattcatacattttctctctttttttgggggggtagggtggggtgggggtgggggtagggacagggtctcaccctggttgcccaggctgtggtctcaactcactgcaaccttcacctcctgactcaagcaatcttctcagctcagcatcccaagtagctgtgactatgggcacgcaccaccacaccctgctaatatcttgtatttttggtagacatggggtttccccatgttacccaggctggtcttgaatttctgagctcaagtgatccaccctcctcagcctcccaaagtcctggaattacaggcatgagccgctgtgcccagcctattttttctcttttacgagcctctctgattccctagttctgaagtagcccagagttggctgattctcctattttgcctcagctagcacttcctccttctcctttttttttttctccttctgatccctggagtcctctgcatttccactgaatccagtgaaccacacaagcatgctcatttattctccccaaactccaccactctgccttatgtgctgatccagtgagaatcaagaaggaagagagacccatggatttctgtgcagcctggaaagtcagttcatggctggacttggctgggacaccagacacctgtctccctgtctctatttagtattcatagggcccagcagctgcatcctcccagggtgcctgaagagtcactgaccatgctctcctacccagcctcaagaagccacccagtcctcgagaagtataatcagactcagcatcttatgtgaagggaacaaccatggggacaggttagacttgcattgagtcccctcctctaagaagggccagggaaaaggggctgttccccctaatctgtgtggctcaggaagtagagctccagagacttctctaccatggcctgaatccctctgctgctcaccctcctcagtctctgcacaggaggctggagatagaaaggcagggactggcactgggaggaccagggctctgccttgctcccccggctcaccgagccacttcccacaccctgtgtctctgtcctgactcttagggtcctgggcagtcagggctcacttggtggcctgcacagtttgtctgtgactaaaccagccaccatctcctgcactggaaacagcagcaataacgtccttggaattgtgtcctggtaccaacaatgaacaggaagtgtccttaaacctctgatctgtggatgtaaatatccacctgcagatccagaactgattcttgagtgatcagtctggcaaggaggccttcctgagcatatctgggctccaggctgaggacaaggctgatcactaacgttggatttggacagttctctggaggcccccacggtgctgcagtctgtggggaagtgagatgggaacatttcaggtctcctaggagcacgacccgacagcaccacctacaactgggaaaactgggctgtttaccatttgtgttcatgtttgcttgggctggtgctagccagggcccaggtctcaggtcagggacagtgatttagagaatgcagctttgtttcctcagagtcagccctcagagaaagcccatagcaacagcattgtcaaattgcctcaaaaaaaatcagaaagtccttggttcctggaacaggctgccctaggaacagagcccaatcggtcagagcaagcagggacacaactgtgcagaaaacaacaagttttacttagggagataacggttgactgtataaaatgagaaatatgtcacactactcacttgtaaaagtaagtttaccaatgctattcatttccctatatcactacgttgagtaaaaactctaaaatgtatgaaaccactgtagagataacttttgctgaattgctactttaacatgtcatggatcatttatttttcttgcaaaattctcattattcaccgtccttttgagtaacccccagctgcccttcaacctagctcctcagctgacctcttctccatgatgcctaccctgatggcacatgtgggcagttaggtttttctagattttaaaagttatatatgtacatgtctacatcccatggaccaagactcactctgggagtgagaaatcacaataatcatgcatagccttatggaattagtgtctagcaatcagaccatagaggtgtgaatagagacagtgactaatgagctgcagagatcagctgggccatcaggaggtaagtgtcctctaaccagcatgggatgctgggggactgccctatggtccctacacagctgctcagtaaggaccattcactcaaagaaatccaagactaggggctaagaccccgtgctcactgaggggtacttagcatctatgtcctcccatggcatggcagagtcccctgagcaggaaggtgtgtatggtttcagtaggtgctttcttccggagccctctcaaggggaaaagcaaaacttcttcctcctcagtctgcagtgtgagctgagcttcagccccagagcttagagaggggctgggcagtccctggatgaaaacacatttgcatgagcagcccctcctctgcagagtatgggaagaaaaggaggcctggggcagcccagtcccactgtgcatgtcaggctgtgtccaccatggcctggactcctcttcttctcttgctcctctctcactgcacaggtagggacaggcctcagagatcagggccagccacccaacctgattctggctcttctggtaaagatccctgaaaaacctcaccctgaaccctgcccatcaaccatgagtgtctgtgtttgcaggttccctctcccagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgcttctcacagtgacacacacagatgggaaagtgggacaaaaacctcaccctgctttaggtcttgttcttaaaaaattttaaattttaaaataactggcctaggcacaaactacatttggaagtactttctagttgtaaaaggctcttctctcaatttcccatccattcgtctgaagtctcagtaaaacaaaacaaaaccaaagcaactgatgacactgaagtcttggctggttgtcatatgtgctaacaccactgcctgtggagctggacttttgttcttgaaagaagcaaaatgaggctttcctagctcacatcatggtcagagcctggggacatcctagcaggtgaacagtgccctgcagcatggactctgctcttccagcgtacgggcagagacctccccttccatccccagtagtctgttctcagggctgtctgtggctcactgtgtcccaggaacaaggcactcaaatatgaaatgctgcctgaggacacaggtcagggaattctagatatagtgctgacctggctcagtcctgggtacctgcatttcagtggcaatgtcaggagatggggttaggtattagggtaactggggacctgagaccagtaaacctctatgtaggacatgacaggagagtcaaggggaggctccactgtggctgagacaagccagaggctgctccttggccacgggggaagtaggtcccatggatgtgactttcctgcagctcatcccactcaggaccatggggactgctgagcgtgggtttcttgatccctcagcgcctgtgttctcttctcctctcttacaccattggagcttcttgctgaatcagggtctagtggtgagtatgtggaaagaccaccacatctcaaggtcacctttttctgcatggggagcagcagaaacattgggcattcccgtggaaatggctacggaggcctcccagaaagagcccccaagtttatgacctaggacagcagtgatggtccctcaggggtcccagcctgattctcctgctctgggtttatccacacagcctcctggagcacctcttggctccagcctgaggactggctggttatcagtgtcacacagctgcatcctgactccatgttaccaagggttcctgttccatgtggaaatgagagaaagatctgccccactcatcctgtctccccatccctcctttatccctgcctgtgaccaacaccagttcatgccaagacttcggctgtcacttgtgttactgaagcagagcacaagttcagtaaaaataatcccttttcttactggtctcccaatgcaaacagaatcaatttgtttctagaagcaaaaggagctgcccacacatggtgggtggggatgaggtagggacaagaaagaatccaccctgtgtgacccagaggcccagaagcctttagtctggttccaaaggtgtctcctcctcttggtgcagttatgctgaccatttcctgagctcagaaactgtgcgagagatgccaagaatgaagaatccagcctgtgtgacccagagacccaaacgtgagacaggaagtctgatgcttaagaaaacgtgggttcagcattctgaaaggtctagatatggcttggcctagagctggtgtagaagagaagcaagagagatgctcagccttaggtggcccaggcacagcggtcctgtcaaggggttgagctctctgcaacatggatatcctgcagagacatacttggggaggctgtgatcccagaatgacacaaaaatgctaatggaaatgagcaggggattgtttatgggggaatggggagacaggtgtgggataagatgtggtaaggagaatgcagcctgaagaggagactgtccattgtgactcataggaggagtagggccggggcctacagtagtgataaaaggaggacctggaaggacctgggccctgaagacacacagagactggagttttggtctgtctgtgagggtcccatgaggataaaaatccatggtcagtgtcctctgtccagggctcactgtcccagctgttgtccctcctggatcctctgggtgtccagattccgtagctgtggacctgttctcctctctgtcctcagcctaagagctgatggggcatccaccaggaagcacatctgtgggcagggagggggccatgggcagccttgtcctgtatgtgaggcactgctcagcctcggtgatccctgttcattaacgtgggaggaaaggaaaacaaaattcactgtgaacatctatgcatcatcaaagaaaaagcaatgagccaaacaggaagtgaagcccagctctaatagtttgtttctacttggaaataaataaaacttaatatgcctgatgtgttacgtaaatgcaataaacattttttgaaagctataaaaattatgtaaaggaacatggcttacactaaaaggaacacttaaaataatgacacccttgaaatgcaatcccaaaacacagcatacattttatttcagttccatatatggactggttttatttaaatgtctatattaaatctcactattccatttttaaatggagcacttaaaatctcattctacggcaactgcctggtgatacatttaccagtggaaatatcaacaaaaccatccagctgttttcctccatccccatagaattccccaaactagtaattattaagagcccaggatgtatcatgccagaattcatgcagtcgtaggcataacctgtttcatttttcattctgatcaacagaattacaatttttcttaagcttgtttttagcttattagattctagttgtcattacagatcaaagataaataattttctatcatccttaagccacccccataacactcactactgaatttgaaccataatttttccctaaaaatcctagttggggtgcttgatgttgagagctaccacgtatcaggctcacctgaggacagactctggttaaaccaagttaaaattttaattcttcccatcttcaaagactgagcatctttgctctttttgttcataagtgaaacactccaaagtcatttgccaggatcccctgcagatgagcatttagtgtacagactcctaggcaagatccctggtcacagtatccagatgactatgactgcaaatctggggaagtagagggagaacaaagatttaccaggaaaaccctctgggaattcctccccagggaatcctagaggaaagagctccctttctcctcagcgccacaggatccacagaggaaggagagctctagccaccaggaaggagccacatgagaggagaggacctggtgtccaacacaggtggggaggtgagtccatggggctggtccctgctatgggcttgatcctgacataggactttatgtagataccacctgagtcctctacaatgtacagccaaagagccatggaaagattcactcctgaggagtctgaagactcctcagtagagcgtgaagatagccctgaagtcacagggaggagacacagacaccacttggcctgccttggacctgagagagggggcagtggacagaatggggggaggaagccatgtatctgagaggttctggtcaccttatcatagaatggtttaccttgatctggacaccagagggcgcatggggatcattcctgagaagacaggggtgatcagagcagaaccagccgcctgccctgcctggtgtcctctgctcagggctcacagctgtgtcctccccaccccctgggaccacaaagctccacccctgccaccccctgacatcctcaagccaaggagcctgacccagggctcagggtggggtcacaaacctggggggggtctgatttgcatggatggactctccccctctcagagtatgaagaaagggagagatttgggggaagctcagcttcagctgcgggtagagaagacaggactcaggacaatctccagcatggcctggtcccctctcttcctcaccctcatcactcactgtgcaggtgacaggatggggaccaagagagaggccctgggaagcccatgcgaccctgctttctcctcttgtctccttttgtctcttgtcaatcaccatgtctgtgtctctctcacttccagggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggtcccacagtgctccaggcccagggggaacagagacaagaacccccttccttttctgccaggagggtgagccccggctgctgctgctcaggcctggcctgtggcttctgctgctgcagcttcccccatgggtccagggatatccagggccctgcctgagagtggaggctcctcctcccctgagtcctcagagtcaggaacagggtgtccagaaaacaaaagcagggtgtcctgctccctgtagcttgggacacagggtctctgcactgaagtcctgggctgaggtggcaggtccagctgtgtcatcacagacccacttctgttggggaacctgtgtctccatcatcctactttttccatttccaggagtttccagagtggtgtcttcctcccccttctcctcagtgtgaatccctgtgcttcctttctctccagcctattctttttttaataaaactcctttcatgtaggaataatgcacatataataagccacccatatttacaatagggaatgagacaaattttggcatttctatggatccttgaaaacatcaccaccaccgggagctatacaacatacaacctgtgaccaaccccaatagctcctcatgacccttgtcacctcattccctcccccaacaccctccttggaagttgcagatctgcctctgtcactactgtttggtttctcttttctggaatgtatcagtgttatcaaacattatcttcccatttgttcaggcttctttcactctgcacacttcttttgagattctcgctgttgttgctgcattgtacccatctcgtagagggctccttactatctttgaaggtccttaggccatttttttctgattttatttatgtatttattttaaagtttgaatttattgtgcatccaaatcaaactttaggggcaatgttcatctaaggtgacaggacagtctgtgatggcttgtcgggattcttgcttcttcatctcttgcttctgattctctctatagtggaagaggttctcgtctttcatttatttatatatttatttatttactgatttatttgggtttttaagggttttagtgatttttctctttttggttatttttcaatttttttattttaataggtttttgggggacaagtgttgctttgtcacataaataagttctttagtggtgatttctgagattttggtgcactcatcacccaagcagtgtacactgtacccaatgagtagtcttttattcttcacccccctcctaccctttctcctgagtccccaaagtccattgtatcattgttatgcctttgtgttctcatagcttatctcccactgatgagtgagaacatacaatgttttgttttccattcctgagttactgcacttagaataacagcatccagttccatccaggtcgctgtgaatgccattattttgttccttttatggctgggtaatattccatggtatgtgtatgtatacatcacatttgctttatccacctgttgatttatgggcagttgggctggttccatgcttttacaattgtgctgctataaacatgcgtgtgcaagtatcttttttgtataacgacttctttttctctgggtagatacctagtcgtgagattgctggatcaaagggtacatctatttttatttccttgaggaatctccacactgttttctgtagtgactgtactagtttaccttcccaccaccagtgtaaaagtgttttgttttcaccacatccatgccaacatctattattatttttattttttgattatggccatttttgtggtagtaaggtggtatcacatcgtggttttgacttgcatttccctgatcattagcgatgtcaaacatttttctatatgtcttttgtccatttgtatatcttcttttgaaaattgtttattcatgtctttagtccatcttttgatgggactgcttattttttttcataatttgtttgagttctttgtagactatagacattagtcatttgttggatgtatagattgtgaagatttgcttccactcggtgtgctgtctgttagctctgctgattcttttgctgtgcagaaggtttttagtttaattaagtcccatctatttatctttgttcttgttgcatttgcttttgggttcttggtcatgaagtatttgtctaaagtaatgtctagaagggtttttttaatgttatcttctagaatttttacagtttcaggccttaaatttaagtctttgattcatcttggcttgatttttgcataaggtgagagatgaagatccggttttattcctctacatttggcttgccaattatcccagcaccatttgttcaataggatgtcctttttccactttatgtttttgtttgctttgttaaagatcagttatttggctccatttctggattctctattctgttcctttggtctacgtgcccacttttgcaccagtaccttgcagttttagtgactgtgagtcaaattatgctagagtatagtttgaagttgggtgatgtgatgcctccagatttgttccttttgcttagtcttgctttggctatgcaggtcttttttggtttcatatgaattttaggattgttttttccagttctgtaatgaatgatggtgatattttgatgggaactgcattgaatttgtggattgcttttggcaccatgatcattttcaacatattgattctacccattcatgagcgggggatgtgtgacatgattttttcagcagtgttttgtagttttccttgtagaggtctttcacctccttggttgggtatattcctaggtgtatttttttgcagctatttgtaaaaaggtttgagttgttgatttgattctcagcttgttcactgttattgtataacagagctactgatttgtgtgccttacttctgtatcctgaaactttgctgtatttatttaccagttctttttttttttttttttttttttgagatggagtctcgctctgtcgcccaggctagagtgcagtggcgcaatctcagctcactgcaagctccgcctcctgggttcacaccattctcccaccttagcctcccgagtagctgggactacaggtgcctgccaccatgtccggctaattttttgtatttttagtagagacggggtttcaccgtgttagccaggatggtctcgatctcctgactttgtgatccgcctgcctcggcctcccaaagtgctgggattacaggcgtgagccaccgtgcctggccatttatttaccagttctaggagatttttggatgagtctttaaggttttctaggtatatgatcacattatctgccaacagcaacagtttcacttcctctttaccaatttggatgtcctggatttgtttctcttgtctgattgctctggcttagacttccagtactatgttgaatagaagtggtgaaagtgggcattcttgtcttgttccagttctcaggggaattgtttccaacttttttttcctttcagtataatgttgactatgggtttgaaagagtgggcttttcttaccataaggtatgtctcttctatgtcaattttgcaaaggcttttaaccatgaagtgatgctggattttgccaagtgctttttctgcatgcattgagataatcatgtgatttttgtttttaatgctttttatgtggtatatcacatttattgacttgcatatgttaaaccatccctgcatccctggtatgaaacccacttgaacatggtggactatgtttttgatagctgttggatttggttagctagtatttcatttattatttttgcatctatgttcatcagggatattgttctgtagttttcttgttttgttatgtccttccctcattttggtatgagggtgacactggctacaaagaataatttaggaagaatttcctctttctccttcctgtgaattagtgcattagtcagggttttctagatggacagaactaatggaatctgtatatatatagcatgatcacaacatcccacaataggctgtctgcaggctaaggagcaaggagagccagtccgagttccaaaactgaagaacttggagttccatgtttgagggcaggaagcatcaagcataggagaaagttgtaggctgggagcctaggcccatctctcttttcatatttttctgcctgcttattttctagccatgctgttagctgattagattgttcccacccagattaagggtgggcatggctttcccacccactgactcaaatgctaatctcctttggcagcaccctaacagacacacccaggatcaatcctttttatccttcaatccaatcaagttgacactcagtattactcatcacaagtccaccccttgtcaacttcaacccatatatatcttctgagatcatacataatcttcaaataaagacaataataaggtcataatgacacctaacataatacaactatcattcatacaaacagaaacacatcaatccccaacccaaatactgttacataaagttaacgatacttaaacgctgatgtgaagtcaataaatcttatgtcacatgataaaggagaaaggaaataacatgaagatattttcttaggacaaaggtatacacgcacaaacatgtttttaacaaaagaaggaggaaatactcatgacaattacactcctcgtttctgcagctggccatagctggtattgatgattactttcttctactatccattctgtattctgtattccctttgccttcagcaagcacctcagcaggtcgtggatatttttccagatggtgtgatccaaatcttcattcctgaagcatctggttcatttgtagtcctgcctggatagggctgttttagttttccatggaccttaatcacagggcatgataatactaagaaatgccctaatggatctcctgtattccatgcatactcttccttacctccgttatggagtagtaaactgatttcatcttgatagtctgtcccaaacaccccagccaacactgtaactcccttcttagcctgttgacttaaaggtaggaggagcccaaagtgtccaggtggcaatcttaacttccccagtttaatggaatcattgatgtgtctccaagtggcagtgttccttcctctggaactaaatcctctaagccagcagaacataatgtcgtgggaacaggaagcaaaaattttgctagtggatcactaggggtgatggtgagtgctgccacttccacttccaccccttgattcctagactcatgaatcctggctatgggagaaacagtgccatatattggatgctgactcagagcatacacgccttctggggaacttagccccagcactgcaaagtattgtcacctagttgacattgtaattgtgacttcaaaaggccattccattgttctatcaatccagctgcttcaggatgatgggaaacatggtaagaccagtgaattttatgagcatgagcccactgctgcacttctttatgaataaagtgagtgccctggcgagaacaatgctatgtggaataccaggatggtgaataaggcattccatgagtccacggaggatggtagtcttacaggcaaacccatatctggaataagtgtctatatcagtgaggacaaacctatgcccttctcataatggaagatttccaatataatcaaccttctaccagatagctggctgatcaccccaaggaatggtgccatatcaagggctcagtgttggtctttgctgctggcaaattgggcactcagcattagccatagctaggtcacccttggtgagtggagagccagttcgagttccaaaactgaagaacttggagtatgatgttcaagggcaggaagcatccagcacaggataaagatataggttgggagggtaggccagtctctcttttcacatttttctgtctgcttatactttagccatgctggcagctgattcgattgtgcccacacagattaagggtgggtctgcctttcccagcccacttactcaaatgttaatctctttcagcaacaccctgaaagacacacccaggatcaatactttgtatcctttaatccaatcaagttgacactcggtattaaccatcacaattaatgtcataggattagtactaattcttctttgaatgtctgatagaattcaactgtgaatctgtctggtcctggctttattttgttgattttttttaaattaccatttcaatcttgctgcttgttactggcctgttcagagtttctatatcttcctcatttaatttgggagggttgtatacattcagaaattgatccatctcctctgggctttctagtttatgtgcatagaggtaatcagagtagccttgaataatcttttatatttctgtggtatcagtattaatatcttctgtttcatttctatttgagcttatgtggatcttctcccttttcttggttaatcttgctaatggtctattaattttatttatcttttcaaagaaccagttttttgtttcatttgttttttgcattgctttttgtttcaattttatttagttctggtctaatcttcgttatttcttttcttctgctgggtttgggtttgccttgttcttgagtctccatttccatgaggtgtaaccttagattgtctatttgtgctctttcagactttgtgatgtatgtatttaatgctaaacattcctcatagcactgcttttgctgtatcccagaagttttgataggttgtattaagatttactacaactgcaaccttactattgaacaatagctttttaattcctgagagtgtgacctcatttatgcccaaaaacaactttatgattgcttttcatgcagtaggccatgattagagagggagtgcttgtggcctggaggtagggttctccaatttatcaaataaaaacattggagtgcagttaaatttgaattcggtaaaacaatgacaaagaattagtatgtgtatctcccacatgatattgttaaattgaaatacaaatttacctgggtgcgctgtagtttatctaccaactcctcacaggcttcgaggcttggaagaggcagtgttggggctggtctcctcttactgatgccaggtctatgagctgaacctcaaaggcagagtctctctaacacagctaccctccagtgagcatgttagttagcactaaatacaccatatacgatttccaatgaataacacctactcacttccctaattcttctttctattattctccaagtctgcagactcaggacctccccaggggttgctgcagccagagctctggatgagggacctcataagtctttcaaaaccagatgcaaggggactactcggtccccacacagtgaggtttaagccaggggtgcataagcaacatgtaagagacagaagagctcagtatggctcttatggctctccttctgtccagtgagaaaactccagggtccttttgatgctgaaggtgggtgggctgagagtaggaggagacccaccctgacagcccagagattccaggacaagacttggcagcctgaaaaggggccacactcttgagtggggaagaaggaggcaactctgctcacaggcgtgcatttctggtggcttcccctttaccaaactggactccctactctgatgtctatcagagaatctccctcagtgagaccaagatcccaggacattgctaaaaacagcagcatggaccagacaggtatgtcatggtacaggaattctttgcagagcaataaatacaactgcagcttaagaggggccctcatagtcataactttggtgaagaagaaaatagacaaaggcagggagaaactgaagggctcaataggtctgagactggggcagcactgggtgctataggcttgtccttgaggggctgcagataatgacagctgggaagccatcatctgttcactgctcactgggctcagcagctgtgtcctcacagggaaccagattcagccaacctggctttctccaccccacctgggaaatgtattccggtgactgtctggactgaggttctatgaaggggctaggagacaagaagagggagacaggctggtttgcataaagaaagcattgcacaccctttcctttcatctaaaactcattaatggaaactctggggccatccatagaagtctagctggtctcctaaatttgggagttatgaaggattcattcctgatcaatctacaggaagggccatcagcaggaggtggtcagagtgagggagaaactggcttccttgagagactcttcaacacaaccaccaactctggggcaaatggggtgacttgctataacagtcatcccaaactactcacaggaacctgagcctagtcccctcaccttattgcttctgattctggtccatgcctctgttttccctggaccccttgcccatgtctgagtccagagtggcagggatggttccatcccagtcaacatctacaaagaagtctacatctacagctactatgacttgaagcagagtccacagttgtacccaagagggcctcttcagctcccccaccccttcacacaggtgacctctactgtaggtctggttgagtggcccctggaccctggtgaacacaaggtatttattcctctctaacaccaggtatatagtggagcaggtctgggtgggtatagagcagagtgtctcttccaaatgtaatgcagtaagaccctggctacagaaaatcatttcacaaaactccacgccctttcatggtaaaaacacccaatgaactatgaatagaatgaaactacctcaacacagtaaagaccatctatgaaaatcccacagctagtgttggccgggctggtctccagctcctaacctcgagtgatccgccagcctcggcctcccgaggtgccgggattgcagacggagtctcgttcactcagtgctcaatgttgcccaggctggagtgcagtggcgtgatctcgtctagctacaacctccacctcccagccgcctgccttggcctcccaaagtgccgagagtacagcctctgcccggccgccaccccgtctgggaagtgaggagcgtctctgcctggccgcccatcgtctgggatgtgaggagcccctctgcccggctgcccagtctgggaagttaggagcgcctcttcccggccgccatcccatctaagaagtgaggagtgtctctgcccggcagcccatcgtctgagatgtgcagagcgcctctgccccaccgccccgtctgagatgtgaggagcgcctctgcccggccgcgaccccgtctgggaggtgaggagcgtctctgcccggccaccccgtctgagaagtgaggagcccctccgcccggcagccaccccttctgggaagtgaggagcatctccgcccagcagccgccccgtccgggagggaggtggggggccagcccccgcccagccagccgccccgtccgggagggaggtggggggtcagccccctgcccggccagccaccccgtccgggagggaggtgggggggcgcctctgcctggccgccccttctgggaagtgaggagcccctctgcctggccaccaccccgtctgggaggtgtacccaacagctcattgagaacgggccatgatgacaatggcggttttgtggaatagaaaagggggaaaggtggagaaaagatagagaaatcagattgttgctgtgtctgtgtagaaagtagacatgggagacttcattttgttgtgtactaagaaaaattcttctgccttgggatgctgttgatctatgaccttacccccaaccctgtgctctctgaaacatgtgctgtgtccactcagggttaaatggattaagggcagtgcaagatgtgctttgttaaacagatgcttgaaggcagcatgctcgttaagagtcatcaccactccctaatctcaagtacccagggacacaaacactgcggaaggccacagggtcctcggcctaggaaagccagagacctttgttcacttgtttatctgctgaccttccctccactattgtcctatgaccctgccaaatccccctctgcgagaaacacccaagaatgatcaataaaaaataaataaataaataaataaataacaaaaaaaaaaaaaaagaaaatcccacagctaacatcatatgcaatctgaaagaccaaagaggtttttgtaatatcaggaacaaagcaataatgcacactttcaccagttctattaaaagcagtattggaagacctggcaagagtaattaggcaagaaaaagaaataaacagaataaaaattagaaataaaaaataaaatctctgttttcagatgacataatgtcatatgtaaaatgcccttaaaagtcccacaaaaaattattagaatgattaaatgtattcagtaatgttttataatacataatcaccttgtaaaaacatctcatggctaggcatggtgactcatgcctgtaatcccagcactttgagaggttgaggtgggaggatttcttgggttcaagagttcaagaacagcctgggaaagaaagcaaggctctgtctctaagaaagcggtggggggtggggggaagagagaaagagagagaaagagagagaaaagaaagaaagaaaaagaaagagagagaaagaaagaaagaaaggaaagaaaaagaaagaaagaaagaaaatctgttataattctatacttaaataagcaaacaggaaacaactcaaaatgaaattaagaaaagaaatcaaattacaacatcattcgaaagagtaaaatacggctgggcacggtggctcatgcctgtaatcccagcattttgggaggttgatttgggggtatcacctgagattagaagttcaagagtagcctggtcaatatggtgaaaccctgtctctactaaaataaataaataaataaataaataaataaataaataaataaataaataaaatttaaaattagctaggtgtggtggcacatgtctgtaatcccacctgctcggggttgaggcacaagaatcactcgagtatggtaggcagaggttgcaatgagccaagatcctgccactgtactccagcctgggtaacagagtgagacaatgtctcaaataaacaaataaataaagataaacgagtaaaatacttaagaataatattaatcaaaatggtgaaagacttgtacattgaaaactataaaacattgcaaaaagaaattaatacacaaataaatggaaagaaatcctttgttcatttattggaaaactcaatattgttaagctaggcatacaaaccaaaaggaatctacagattcattgcattctctatcaaaattccaagttagtatggagatcattaaaaagtcaggaaacaaaagatgctagagaagatgtggagaaataggaatgcttttacactgttggtgggagtgtaaattagttcaaccattgtggaagacggtgtgatgattcctcaaggatctagaaccagatataccatttgacccagcaatcccattactgggtatatacccaaaggattataaatcattctactataaagacacatgcacatgtatgtttgttgcagcactagtcacaatagaaaagacttggaaccaacccaaatgcccatcaaggatagactggataaagaaaatggggcacatgtacaccacggaatactatgcagccataaaaagggatgggttcatgtcctttgcagggacatggctgaagctggaaaccatcattctcagcaaactaacacaggaacagaaaaccaaacactgcatgttctcacttataagtgggagttgaacaatgagaacacatggacacagggagggtaacatcacacaccggggcctcttggggatgggagctaggggagggatagcgttaggagaaatacctaatgtagatgatgggttgacaggtacagcaaatcaccatggcacgtgtatacctaggtaacaaacctgcacggtctgcacatatatcccagaacttaaagtatatattttttaaaaagtgcaagccaaacaaacaaacaaaaagaatagaaaaaaattaatcctaaaatttatatataatattgagagaatctaaatagtcaaaatcatcttgtaaaagaagaacagtgttggagatttcacaccgatttcaaaacatactacaaagctacactaatcaaagcagagtggtacatatagacagacatactgacaaataaaacagaactgagtgcctaaaaaaacctcttagttatacagtcaaataattttaaacaaagttgtcaagaccatttagtggaaaaggacagtctttttcacaaatactgttgagaaaactggatattcaccagcaatctggaaatggatgaaagacccaaatggaagagccaaaactgtcaaaatcttaaaagaaaacattagggagaaggttcataatatagggtttggaaatgacttcgttaatatgacaccaaaggcacagaaaaaaatagaaaaagaagaatatagataaattggattttatcaaattgtaaaacttatgggcatcaaaggacactatcaaccgagcaaacatttgaatcatagaataggaaagattgtcgcaaattttgcatctgataagagatgcagactatagaaagaactcctaccactcaagagtaactacaaaaatgaaaacaatctgaattatatgggcaaaaaacttgagttcgtattgagtagactccaaagaagatctacaaatgggcaataagcacatggaaagatgttcagcatcactaatcattaggccagtgaaaatcaaaccacaataatatacaactccacacccattaggatggcattaccaaaataatagaaaataacaagatctagcaaagacgtatagaaattataactgttatgcattgctggagggactataaaatgatgcacccattgtggaggtcttatggcatttccccaaaaaaattaaacgtagaattgccattttatcggaattttcagttctgggtatgtgcctcaaataattgaaagcaggatctcaaagagaaaattgtacacccttgttcatagcagcgtcgttcacaatagctaaaaggtggaggcagctcaagtgtcatctaatggataaacgggatacagtatacacacacaagggaatagtattcaaccttaaaaagaaagttctgctattctgaataatgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtctcagtaaactattgcaagaacaaaaaaccaaatgccgcatattctcactcataggtgggaactgaacaatgagaacacatggacacaggaaggggaacatcacactctggggactgttgtggggtgggggtaggggatagggatagcattgggagatatacctaatgctagatgacgagttagtgggtgcagcgcaccagcatggcacatgtatacatatgtaactaacctgaacattgtgcacatgtaccttaaaacttaaagtataataataataaattaaaaaaaaaaaagttctgactcatgcgatggcattgatgaaccttaaagacatcacgccagcagaaataagctggcttcaaaaggacaaatattgtttgcttgcccttatatgaggtatctagagtagtcaaatccatacagacaagaagtagaatgaagttttccaggtgttaagttttggtttgggaagatgaaaaatttctggagataaatggtggtactgtggttgtacaacagtgttaatttacttaatgacactgaagtatacacttgaaaatggttaaaataatgaattttgcatttgaataatttaccactgtacaaaagaggaagatttatattcagtgtagtttctctaccaagaacaatcaaaacatacaggattgggagagtgtgcctgagtattaggacacccttccttttatgccagcctgcagcttcctaagaggccaatagagttggaagcgcctcattactggtgactcaaagtaatgtgagaaagtctgggagtgaccatgatgtaagtggtgggtgtctgacccagcccaggagcagccgcaaatgcagcagctgccaaaaagggggagatgaaactgatggcagcagtaacagcctctccagctggagtggggcatctgctcttgtgcaaaatggttcacagttgatacatttagcacagaatctcatcctgtctacctgtcatgatcaactacaatttttattgcaaagtatgccatcagagtggcatattttatccagcagcaagcaaacatgaaggaagtttcccttagtgctttggtcaaactggcatggcagtcctgaacactgaatgaatatccaaagacaaggttctccaaagataaagatattatactatttattgataaatactgggagtgcatgatgaccattcagacacctgggaaaatgacttggctgaataacattgttaaaacaatgagtaaaaaaagagatgtgctcttggtaaaggaacacctggatccagggtataaagaccggaaagaagactaccgcagatttggacttttggatcaggacttggtaacattgaccctgtttacgacaaccaaaaacaaagcagtgctgtgtctacagtgggaatctgagtcaggaaactgcagcaggaacagcagaaaaaaggaagaggagctcagtgcaaacagaaggatggggagaccacagggaccaccaagaaggcccagagtgactttttgttttccgctcagggctgtcctcctcacaccccttggatcacacatttaatgaagacggctactggtatagtctaacttagcctgatcctcacacggttggtcctcagaagcttgaaattaactgctgggcaggaaaacctattcctggagacctctacagtgactgcttctatgaacaggttttgttagatcaacatgattaagctccccagttagagatctccagtgactggctggctgactgtggttggaaagaaggtctactttatggtgcagacctctcatgggatacggaaagggtcctggtactttgaaatcaccatgaatgagatgccaccagacaccactgccagactgggttgatctcagccctaaggtaactatgaagctcccttaggttatgataaatttagttattattggcagagcaaaagggaatcaatttccaccagtccactggcgaacactactgttttagctatgggcagggagacatcctacgattttatattaatcttcctgaaaacccaagagacagccaagttaccaagataaggctttgataaagttcaacaattatttttattttgtggaaaaagactttgtggctaaagcagggaagagtctaaaacagattccatatagtaaaataatattttataaacatggtgtcaatcaagatgtggcttcaaaagatatttttagggggttacttttagccatctcactggacaagagcttcatagtttccattaactttggactgtgctccaagtatcctccaaagaatctcacttactgccctgtgagtgacatgggctgggatgctgtggtagagcacactctggctgatgtcttgtattttctggagacaaaagaggatgggggcacagtcctccatgggaaccctgaacaggtccttctttcttttcagatatggactttctggggaataatattgggtggcttttgttgttgttattgtttttgaactgtcttaaatgttctcccaaagatgctacagaacatagcctatccatttaccaagttaaaaggctgagtaggactgtgagagatgccctgctcatcatcattcttcttccacttccagtgactgctcttatattctttgccataagccaacaaccgctcatcccaagatctcataatccctctgtaaaactgatgctgtactacataccttgccagctgggacttgtaatcttactgtattttctaaggagtgaataatcttgtccaggtaactaacatatttaaagacattttcttctgtggacactgactccatgccacctgttttccaaagaagtggtgaagctgtttctgagaacacctaaaatcaatggttgtacattccaaaccaatctaaaagtgatttccttttgctgtgggtttggttctattactgatttggaaatatacctttgaacactgagatctctgaaactactagacttctagaagtgtaattgtataagaagtctgtttgcagctttaacaaaatgagaaactcttcccaaattaaagctttctttgaagttaaaaaaaaaagaataatgtgagattggaacctgtgaggtctgaggattcccaagagtactctcaattctgacgctaattgtaacctaagggctccccaacagcccttcacttcttatgattccctagaaaaactcacataactccctgaaacctgtgacatttattgatacaaatttttacagcaaaataatacagattaagataattcaagggaagaggcacatgggcagagttcaggagaattccaagcacaagcacccagttgtcctctcccagtggagaaatagacagtgcttcattttgctcacagcaatgtgtgattctgtgtatgaaacacctatttcctgggtgagccaaccaggaaagctcacccaagcttggtgtccagagggcttttaaggggtggtctgggtgagagtggggttattatgtagaccttgtggatcatcctcaaggctcacttcagtttccattgaattaacaataaaacttaaaccttcaatctttggttattttctttttaaaaattctctgaagtaaattattattaaaattctcacttaagacagctgtttatccaatatgaggctcaatataaacagtttcaaaaagtcagtaggtcattaaaacaatttcttcagtcattcaaaccattcagataaaaattaacaccatgtaatacaaaaattgaattatagtcacagggacaggatttcagcaatggcaagaaaaagtagtgcaaataggaatgagcaaagaatagacaagtaatgggtgtgaattggcctcggaaataccatggtaatgtcaaaaagataaatcaattgttattttgttaaataagtgaaaggccaggcattctcagtccaggaaagccatcacagggcagtctgagtcttctgcatcttaagaagctcaagaggttcaaacttaataaaccctgcacagttgctcactggttcatgtaaaatgctagagcagttgcttcctcccactcagcaaatccacagcacacagtcaccctggtctggcccttcacagtgtagatgccctcagggctaagaacctgagtggttctaaaagtagtaaagatttgcataaagtaccacacaacacaccctctccacatagggagctcagtaggacataaagagccatcagaatccagccccgactctggagccaggagtcccttctaatatcagcatcatggcctggactcctctccttctccttctccccatgtacctcctcacttgctgcccaggttaatagagatttcaaataccagcctttggagggattcctgtgtctccctttctaattcccaacatgtgtctgttttttgtttcagggtcaaattctcaggctgtgatgactcaggaaccctcactgactgtgtccccaggagggacagtcactctcacctatggctccagcactggagcagtcaatgggggtcattatccttactggttccagcagaagcttggccaagcccccaggacactgatttatcatgcaagcaacaaacactcctggacccctgcccagttctcaggctcagtccttgggagcaaagctgcccagacactcttgggtgtgcagcccgagaggtgaagctgagtactactgcttactgcaccatagtcgtgcttggcacagtgacagactcagaagaggaaccgagacataaacctctctaggcccttgtgatatgaagatcatatgatcacgcacaccagctctcaaggcagcctacatgtggaccagccatagaaaggggaaggaaaggatctgaattgattcctatccctgcttaagccctgaagtgaaggaaatgtgagaatgatctgggaagaactggatcaaaaaaaaaatcagaagtttattgctttgtattctaaaaggagcactaacagctggatcagatctaaaggctgaggctaaatgcatttcctccagaaagaagcatcttcaaagtatggggtttctgagctaagagtaaagagaagaaactctacttttgtatatttctaaagtttgttttattgagttactttcaaagcaatacatgcctattatgtggaatcagaaagtattaaaaatcaccaagttctctgcaaagctaccttatcccagataatcaatagaagtacatttcttcatttggatgcattctctcatttttgttgtcaatattttcacaatggttatcaaaccttgtgctcattcctctggttttatacagctttttgctctgtcatttaatgttaatgtaagtagttttccatttatttgaaagggtaaaatatttgagtagttgctaattttatttttatttgaataccaatgaaaaattataatttggggtaattcaaattgcttgtcagacaaagatgtgacattgggctattattaaaatgctcctggtcttctctgtggatttagtgaagtcaaacaaaatgcctgcaattttctatggaaagccttgagtacattatgcctgacttcacaatgcagaaaatagagaaacaagaatttcctgctcatgtttgctggagcataatagattcaggtacgaggaacaacttatattgaaaactacgtcaatgtctccatgcatgtgttagaacagtacttcccaaactctattgtgcatacaaattatctggggattttataaaatgcagattcttattcagtgggtctggagtgaggacacaatctctgcatttctcacatgtgcctgccacacaaaatccacatatatatttgaataataacaagtccagccagcagtggaggctcatatgtgtaatcttagcactttgggaagctgaggcaaaaagattactcgaagccaggagtttgaaaccagccaagagcaacatagcaagatattttctctatagttttttttaaataataaaaaatgaattagccaggcatagtgctgtatgcttgtagccctaagtactaaggaggctgaggcaggaggagagcttcagcccaggagttcaaacctgcagtgagctatgatcatgccactgcacttgagcctgggtaacagagtgagaccttgtctctaataataataagaaaaacgacaacatatccataagactagtatcaaataaggagaatccttggcaggcaagaacctaggagaaatctctgacatagggaatttaccagcttgcatgatagaagaaccccacactccatggagggagatgaccagggaggacagctgcaaagctaggaaaggctcccctttctttgagagcaaaaacaaaagcaaacaaacaacaaacctgaccttccctctggctcctgtccaacactcttactggctcctccttcagcctttcctataatgtggcccatccttaccctctccccttccacatctctgattcctgaattcccttctttgttctctttccctttgctaccacccacttctcccctctaatctcttgagttaattatcaagggctttataacaggaaactcattggcattttttctgcatctgtccttgaagttgacactcatacttttatctctttcttgaacctctcagatatgcttagaactgaagaagcccgaagttgattgattctgttttttcacctcagccagcaccttcttcttctcctttccaggagaatctgtatttctctgtatttccagaattctctgtatttccagtgaatctgtcagacacagtaagtactcttcaaaggtttaatttctgacttcattgttctttgttctcgagatgaacttccttgtcccttctcctaagctacctgctctgtaaacaacttctcccaccagtcccaatctgtaactcacatctcctccttatttagaaagagtcctcttttactccttgctacccattctgtaaactgcccctcccacaaaactacccttcccacatttgccatgccctgacatgcccaaacataccttgtaccataatggactgcctctcccttcccacctaattagccatactcaattttaaacagtagccaatcaggtcagtttagattgtgtggtccaactccagccaatggggacaggacacagaagcagggactaaccacgttagggatgaaaaccccttccctcctttgtttggtgtgctcttgcagtggtcagaagtgcaagcggcactcttctgtagaaataagtttgccttgctgagaaatattttgtctgagtgctcattttccttgcgactctgagctcttgtttctaacaaaatagggggtcatctgggattcccattctcctctgaggaagggcctctgatcacctcttaggaggagatgcatcccactgcttcattgcagtggcctcaggggtaaggaatcaggacccacccagcatgataaataaacccagactctcagcaacacaggaagaaaaggcctacagttaccgtggcgaccaggtaactgtgcacagacaaaggtaagaaaaaccactagggcagtgaagtacttccttagtggtcaggacattctgcaggttgaaaatgtgtgaatgagatgcacaattaagtgcaaagtgagtgtggagtaaagtaaagggtgcaagaaatctctagtaagagaggttgagccccagggaaatggtgcaagaaatctctagtaggagaggttgagccccacgcacactcagcagggaaaggagagcgagaaacctccagtagcggggattgagcctccagggaaaagggtgcaagaaatctttaatacgagagattgagcccccattaacctccaagacgggagtgcaagaaatctctaatatgagagatatgagcccccattaacttccaggatatgaaataccctagtaaaacaagaactacaaagggcaaaggagataacacaattccctctgatagccttctaggtctcatgttaaaatattggagggataatgaaaggactaaacacaagaaaaagcaacaaatgatcaaatatgggaattgttttatttggaccaaagaacctattctcaaaccttcagttttctggccaaggtttggatcaaatgagagttggatttgtcaacttttaatagagtatgtaaatgacaaaagtcctgcttcccaagaggaaatagactctgctgtgtcttggtggcaggggccggtcctcctctacccccttaaaactagtaaggataagccagaaactaattcccctgtaggaactaaggccccacccctgagcaatccatgtgggatcccttagaccatctgcctccaccagatacccctaacttctctcaagcagccacccagacccttcccctgctcacattatgccctccctccttataatcctgactgttagggctgtccccaacctgaacgccctcctgcaagaaggcttcaacgtgagatagagcaatgtaaaaaggatattcaaaacttccctttcccctcctcctcaaaagagtctgccccaatcgtttttcccttaagggaagtgtttctaggaggagagggagttggctttgtaaatgtccccttaactagttcagaggtcagaaacctgagggaagaacttaaaccactattagattatccttttggggtcgtggatcaaattgaccaatttgtaggatcacaagtatacacttaggctgagctaatgtccatcttaagtgttctctttccgggggaggaaagaaccatgatacagaaggctactatgatagcctgggagtgcaaatatcctcccagtcaaaatacccctgcagcagaacaaaaatttctggcccaaaacccccaatgggataataacaatgcagccaactgagaaaacatgaaagaccttagggaaaaggtagttaaagggattcaggaatcagtgcctcaaacccaaaatatttcctgagcatttaatatacagcagggaaaagaccagggagccatggagtttttaaacagactcaaggaacagatgagaaaataggcaggcttaaacataaaggatccccttaggcagggatgttaaaactccattttgttactaatagttggccagatatcatgaagaaattacagaaaatagagacctggaaatatcggcctatagagggaacaagagggcagggagaggagagagaaagactgacagagggaacggagggagccagggagagagggggggagatacaaaggcagaaagagagagagggagggagagacagagaggcagatagatggagaggcagagagacagtgaggaaaagtcagagacccagacagagagggagagaaagagaggcagagggagagaaagaggacgaaacaaatgtttcaaatgtgaaaaaataggtcacttcaaaagagaatgtcctgaatgggaaaaagaaacaaaagtcatatataaaagcagatcagctaatattaaatttctgttaattccagaggcaggaacatatctattagggagagatttaatgctaaaatttggcttaggcctttatattaatcagggaaaatttctcatctccttaaacctactcaccaccacggatgaagagcgtatccatcctgacacatggtcaaaagaagaaaattgggggaaattacagttcctccaatcaagcccaaattaaaaactcctggggaggtagtaaaaaaccaaaatctttcttttgaaagctgagggaataacctcacagaccaaatagccaaacaagctgccatttcctctgaaacgcccatgtttcacctcaccccttgcctttctcccccaaccgccattgccatcttctcccctgctgaaaaggagaaattaataagaataggaaccaaggaaaactcagaagggaaatgggtgttaccagatcaaagagaaatgctatccaaacctctcatgagggaggttttatctcagctgcatcaaggaacccactggagacctcaagctatgtgtgatgcagttcttagagactatggatgtataggaatttatactctagcaaaacaagctacagatagttgtttaatatgcaaaaaaactaataagcaaaccctaagaaaaccatcctttggaggaagaaacccaggaaattaaggccattccaaagcatccagatagattacaccaaaatggcctcaataggtcacctaaagtatctaccagtaatagtggatcaccttactcgctgggtagaagctattcccttttcaagtgtagccaccagtaatgtagtttagacattaactgaaaatattatacctaggtttggattaatagaaaatattgattcagataatggaaactatttccctgcacatgtcattaaaaagctagcccaagtattacaaataagatgggaataccatatccctggcacccacctttatcagaaagagtagaaagaatgaaccaaatcctaaaaagccacctaatcaaactagttttagagactcgactaccttcctattgcctaattgagggtccgaactgcccctcggaaagatattggcttatctccttaagaaatgctatacgggttgccttatttacactccactgctgacattcctacatttgaaactaaagatcaatttctcaagaactatataattggtctgtcttccactttctcttccctcagaactaaagaccttttagcactgacaccacccttggagctcccagcacatcagcatcagcctgggatcacattctcatcaaaagctggaaagaaggaaaactcgaaccggcttgggaaggacactatctagtgcttctaactacagaaattgctgtccgcacagctgaaaggggatggacaccccacacacaagtgaaaggagtgattttcacagcgagagaaaaatgggccgtcaccccagggcccacccgcaccaaattaaaaagggctgaataatcatttgtttattttcccttttctttccaacagaaagtcacctcatcatcagtgtgcctcaaactaatcgtcccttaaccctccagttcgatgcttgttcagtcacctcatgtagagatgaacgagctcaaaggcagctatcaaatgtagataagtatctgtgtccgtaccgtagtgagtcaaccaagtataagtatagagccttaaaaagtccctgtggtgactggacagatgtttggtggaccacccaatatggagggtggacagccaggccccctttttcaaacaattctgaggactgaaacagaaactccaacttattcgtggtaccaccccaccaaattgtaagtcattgcagtgtaaccccttattgctaattatagataatccccaaacaatgacccaagaaccctccatattcgaatgatatgggttaggagcagatgttacaggacaggaccccataggaatcttctttctgaggttggctagaccatcagttaaaaacaataaagaaatccagacccagagtccagggaacctatgggagccaatgctctccccaaacatatcaggctcagcattctcttctcatctccagaatgacccaactaaggtaatggttgtggaggtaaaagatttaaagcagactacagctctagagacagggtacaaagacgcaaatgcctggctggaatggattaaatctcctgtccacactctaaacaaaagcaattgttacacttgtgcacatggcaggccagaggccctgattgtcccctttccacttggaaggtcctccagccaaccaggcatgaactgtatggtagctgtcttccaacaccccacagcctggggtaatgaattatgctgaactctctctctgctatttcctgaagtccagcaccctgtgggtcagcccctgagggccatccagcttctgtctcctgatgcaagtttcaccccatgtctctcacgacaaggggaaaacttagcatttcttggagacctaaagggatgcagtgagcttaagccattccaagagctgatcaatcagtctgccctgatccatccctgagcagatgtatggtggtattgctgcggaccattactagacacttccaagtaactggagtggcacttgcactctgatctaattggccatccctttcactctgacattttgtcaaccaaaaaggataaagacaaagcatcataaaacaaaagatgctcctcatgggtcctttgactctcatgcttatatagatgtcattggagtccagagaggagtgccagatgaatctaagccccaaaatcagatagttgcagggtttgagtccatactattctggtggttgactgtaaataaaaatgtatattggataaattacatctattacaaccagcaaggatttgttaactatactagagatgctattaaaaggatagctaaacagttaggacccaccagccaaatggtttgggaaaatagaatagcattagacatgatactagcagagaaaggtggagtctgtgttatgagtggaactcaatgttgtacttttatacctagtaatactgctcctgatggaaccataacaaaagcattacaaggtcttactgctttatccaatgaagtagctaaaaattcaggaataaacgatcccttcactaatttaatggagaaatggttcagcaaatggaaaagacttatgtcctcaatctttacttctcttgacattgtaataggtttgcttattcttgtagaatgttgtatcataccctgcacctgaggcctactacaaaggcttattgaaacaactctcactaaaacctttttcaaatccaccgcccccccaccttattcagataagctcctacttttagaaaaccaagcagaacaacagagtcaaggcatgttaaaaaggtttgaagaggaagaattataaaaatcaaaagggggaaactgtcagatacagtaagttcctcttaaaaggcttaatttctgaattccttgttctttcttcctgagatcaacttccttgtcccttctcctaagctacctgctctgtaaacaacttctcccaccagtcccaatctgtaactcacatctcttccttatttggaaagagtcctcttttactcctggctacccattctgtaaactaaccctcccacgaaactacccttcccgcctttgccacaccctgacttgcccaaacgtaccttgtaccataacagacagcctctcccttcccacctaattagccatattcaattttaaatagtagccaatcgggtcagtgtagattgtgcagtacaactccagccaatggggacaggacacagaagcagggactaaccacattagggatgaaaaccccttccctccttcatttggtgtgctctcgcagcagccagaggtgtgagtggcacccttctgcagaagtaaatttgccttgccgagaaatcctgtttgagtgctcattttccttgtgactctgagctcttgtttctaacaaatccagtgaaccacacaaatatactagccaattttctccaatccccaccattctgccttatgtgctgatctagtgaggaatcaaataggaagagagacccatggatttctatgcagcctgggaagtgagttcatggatgcactcagttgtaacaccagacacctgtctgccgtttgctgtttagcattcacagggcccagcagctgtgtcctcccagggtgcctggagcatcactgaccacaccctcctacctcccacccacctactcctcaaaaagaaaaatcagactcggcatcttatgtgaggggcacagccaggggtcaggatagatttccactgagtcccctcccctaagagacaccagggaagaggggttgttccgcctaatctatgtggctcaggaagcagagcactacagacatctctaccatggcctggaccctctcttcctcaccctcctgagtctctgcaaaggtggctgtgacatgactctgatgactggagaaacaccagggtcctttgtctcacactgagaaaattagtgacatggacacacattgagtggttttaaggaacagaaagtttaataggcaagaaagaagaaaacagctcccccatacagagggaggagggatcctaatggaaaatcccacatgcaatggaaaacagctgattatattgggaggctggaggaggcagtgtctgatttgcaaagggcccaggggattggtttgaccaggtgtgacattcatgcagcctgtaaaaaaaactggccctcccaccttagccttttaatatgcaaatgcaggtcaccatgatgtcctgcacatgtggcttttatctggaggctgccatgacacctggcacacgtggtgacaaaaagaggagggcgaaagccaccatattgggtggacctggcttctagccaccagcatttgcatatcagtgcttgccagtctggtttttcaagctgctttctgttagcaaagaaatggtttgggggtcgctttttattaaaggaaaattccaccgagaacttacaccatttctagctgcctaaaaattatttcttaatgactcctgttatttcccccctcaggagaagtaaacctaactgtcgttaggggatgttggacaacaattctttctggctacttccttctggaaaggggcgtcatgtaaggggacagcagttgggcctcctcctgaggttgatctaaggattctctgaagaatggcatgtccatgtgtggctctgtctgcagcattatttggagtttgattgcttctaggtgaaaagagataaatcttacaagaaggtttaaaatatagggttagaatatgagtattaagattaccactgttagtgggggtactatagaccacaactatgacagcagagtttgatacttgttagttacaccagtggattgtaatactgggttgtctccactagatgtcactgaatattaccagaaagattaatatgaaagtgacatttttccttgagaaaaccatacatttccccctttacttgccattagtgaatagttttaggcttagaccatttttataacttgcaatataattgggagaaatacattattgggtggctaaattaactttagtgttaatcttgacaattccttttctttaattattaaattatttcatgactttcacagaccctcttacaacatactcaaactttccgacttgtcctaaacatccttcctttaaataaccagtcatttgcttttaggacaagaatttcccacacaagatcttttcttatataaagttccttcttttataaccttctttctatagcttagagtgcaccatacaaccagtcttcaataaaaagtcctatcaaacttaatgatagtaaaactttcatgctatatccataactattactcctgctataagcaaaacagccttgactaaatctttcctgcaattgttaatcctgttataaggatgataattagacaagatgttacagcaattagaattttacaaccagaattccacattgtgagtgccatagtgtatagttctattgcaaatagtagtgtgactgtaacaattcccacaagactggcatagtaaataatttccattgaaaactttacttgccaagatataacatttccctttgggaatctacaaggttacaaatgcaattctatgaataatcaaaatctccctgcgaatatgcattaaaaagaagttctaatatttggtggcaaatttttagaggaaggggtacaaataataaaaagtggccgggcatggtggctcacacctgcaatcccagcgccttgggaggctgaggtgggcagatcacgaggtcaagagactgagaccatcctggccaacatggtgaaaccccatccctactaaaaatacaaaaaaattttgggaggctgagacaggtggattatgaggtcaggagatcgagaccgcctgtagtcccagctgctcgggaggatgaggcaggaaaatggcatgaacctgggaggcagagcttgcagtgagctgagatcgcgccactgcactccagcctgggcgacagagcaagcctccatctcaaaaaaaaaaaataaaataaatagctgggtgtggtggtgcatgcctgtaatcccagctactagggaggatgaggcagaagaatcacttgaacccgggaggcagaagttgcagtgagctgagatcatgccattgtactccagcctggtgacagagcaagactctgtctcaaaaataataaataaataaaaagcatctggtgaggtaggagtgggactgagtaggatgagtagccctcactcagttacttatcttttatgattttcagcttaagatcttctatttctccactttgatattcaggacgttcctctgggctgtcaggggttgctccctcaggcattcaggctttgacttgagtgtgatgtattcagaagttgacacctgtaacttttgctgccaagggggttgaaagagaacagtgtagggcccttcgcagcttggcttagggaaggagagagaggtgagagttttcactagtaccaaatttcctgggttaaataaaggtggttctatttcctggggctgggcttctgccagttgtgtcaatttctgttggaagtgaggtagagaggttacatgcttaaccaatttataggttttctgcctgaaaacagtctctgagcacattgacaaattttatcctttcctaagtgaaaagcttggtgaaggattttaagaactttccattggctggaggctggcaaatggagtttgccatcctctggctgtagccatcctgagagataaaaagcatacccttgagaagtggcctattctgtttctgcaggaaaatactgaggtttaatttctgttatggagcattcctagattagaagggggcttgaagtgtgttaatgccttgaggcttccttgcctttgacttagctgcctgattaatctatttcctttggctactttatttgctgccttttggtgttcctataatgtatccctgctatttctcacggcataaaaagtgaagataatagcctgctaattttctggtgatattttacaggaaatccattagtggtaagaggatgtctttccttttaaatggcagcatgagtatggagagctaagaaagcatacttggagtccgtgtaaatgttggctacctttcccttgcttaattgaagtgttctcgtaagagctattagttcagctaattaagtgcttgtgtctggggagagatgttgtttagagtgactactgcttatcctgccttatgtatttcttgctttaccggctgttagttaaaagcgccccctaaaggacagtaatcctgccacattacgtggggtgtaaacagttaagttctttcccaggattaatttggaggcttttctaactgtaaagctatcatgacaatggcttggaagcatgtgtaaataggtcctcctaactgcaactaaggttgagaaaaatattgtactagagtttttcctgagatgttccttatggtgatgctatgagaagaggggaggcctggattagagagaagaaaagagagagattggctttagtatttagaaggacatctactttccttcaatttccagaatcacccaggtcctggcaccctgttaaatgtgccacccatgtttgcaagcgtgaccctccaagccatggcaccagaggaactaagcttgtgggcctagtcgtgctaccccaagcagctctagtcctctgcctatgatttccctttgacttcctagacttgtgtgatctgtgtgtctcaccccacccccacccccaaaaaaatagatcttggcagaaactatatggaaggaaaggctcctttaatggagggaatgtgctagattgcctgctattatggcctgtgctaaagcatttacccttagaaaaatggttccagttaacttccagacttaaaatctccttactaattaagtactgttttaatcggagagagaacaggtgtcttaaaggaacgcggggacctaatggcgactttcctgctaatgggacagtatcggggcacaaattcggctgcagaggaattttactcctaatagttaaaagcagaattttcccgttcacaggagcagcataaatcctggtttccagtagaaaggtgcaaaaagaaaaaaattgagaagctgcggtgtaccgcggagatcagcaatgtgtcgcataaagaggattttatttccactaggtggcgctgttggcctagaaataccatgtgctcaccagaggaattttagggagtaacctcactgaggggcaaaggaagacttctgttcctagaagattgcaatggcattttcctgagctatctccccagttactacagcattttctgatcttgcctaccaggattacttccctacgctgtaaaaattcccgcacatttgacacacagagagagtaagagacataacgaccacggataaaaaaggaagaaggttctgcgacaggatagctagggatcctttaccaacatccagagcaggccgttggaggctgggtccagtcccgaaacctttgaataacaccaggctgtgccctggccagaaattctcagttgcttcagaacttttcccagcctcacgcgatggctaagtttccccatgaaaagaaactgatttgaagcatgaccaacattcccaaagacccgtgagtattgcgggttctccgtgttctgaccagcaagcctaacactcaagtctttagaacaacagccatgataagcgtatttagacggccaatggatgcccataattgatttgattttgattttaaaatagagaccaagaacctctgaatgacagaacagactttgagttcactcctctaatcactacgtcgatgaatgttgtaccttggattcccagtgaaggcaccagaaaggatacggctctgatgactggagaaacaccagggtcttttgtctcattctgagaaaattagcaacatggatggacatatgtggagtggttttaaggagtggaaagtttaacaggcaagagagaagaaaaacagctcccccatagagagggagaagggctccgaacggaaaaccctacatgtggtggacagcagctggttatattgggaggctggaggaggcagtgtctgatttgcacagggcccagggaatgagtttgaccaggtgtgtcattcacgcagcctgtaaaaaaactggccctcccaccctagccttttaatatgaaaattcaggttgccatgatgtcctgcacatgtggcttttatgtggaagctgccgtgacacctggcacatgtggtgacaaggagaagagggcgaaagccaccatattgggtggacctggcttctagccaccagcatttgcgtatcaatgcttgccagtctggtttttcaagccgctttctgttagcaaagaaatggtttgggggtcgctttttattaaaagaaaattccaccaagaactttcaccctttcttgctgcctaaaaattatttattaataactcctgtagtagctggagacaaggaggcagggatggcactgggaggaccagggctcttccttgctcccctggcttactgagccacctccctcaccctgtgtctctctcctgactctcagggtcctgggcagtcagaactcacttggtaacctgcacagtctgtctgtggctaaaccagtcaccatctcctgcactggaagcagcagcaataagggtcttgggattgtgtcctggtaccaacaatgaacaggaagtgtccccaaacctctgatccatagaagccaatatacacttttagggatgtaggactgattctcaagctatcagttttccaaaaaggccttcctgagcatctctgggctccaggatgagaacaaggctgatcactaatgttggcattagtgatcatgtttgtgatttgctataaaatcatccagcgatggagtaagatgatgggtaaaaagggttgaaagattaaacaagatgagtcacactgatgatgtcaaagctagctgatgggtgccaaggattcattagacaactctcagcatatttatataactcaaaaatttccataataatcactgcctaaaaaaatccatgtctgtgatgagaggtatatgtcctgcttttaattggtatgtaacctgattttaacaatgtggtatataatctgcttttaacaacgtggacaaaatgtaagcttacattctgacttcaagttgaagcccatcttctcctaacaggcaaaggaggagctggggtggaggctatgaaagggaccggagctcagcgtttcccaggacaaagaagtgagtgaggccggagtcccagcagaaggacgaggggctgtgagatgggctatgggagtgtgcaggggccacaacgtgcaggtcatgctgctggggccacaggattcaggttttatataaacaacaaggagccactgaaggtgtttaagccagggagtgacatgccacatctgaatgagaagcatctctctgaattccttgaggagacagtgtctgaaggaagtgagtgacctgattctagattatttactaaagcaccttgtaagtctagaaatccaggggccatttacaattagcacaagtgtagatgtgggctacattgaagaagtgatggtctcttgtcattcttcacagaactagaaaaaacaatcctaaaattcatatggaaccaaaaaagagcccacatagccaaagcaagactaagcaaaaagaacaaatctggaggcatcacactacctgatttcaaactatactataaggtcatagtcactaaaacagcatgacactggtataaaaataggcacatagaccaatggaagagaacagagaatccagaaataaacccaaatacttacagccaagtgatatccaacaaagcaaacaaaaatatagagtgggaaaatgacaccctattcaacaaatggcgctgggataattggcaagctagatgtaggagaatgaaactggatcctcatctctcaccttatacaaaaatcaactcaagatggatcaaggacttaaatataaaatctgaaactataaaacttatagaaaataacatcagaaaaactcttctagacattggcttaggcaaggatttcatgaccaagaacccaaaagcatatgcaacaaaaacaaagttcaataggtggaacttaattaaactaaagagctaaagaaaaaaaagagcttaattaaactaaagagctaaagaactaaagaaatcaaaataatcacttatagaatgatgaaatcggtgtctgggaatcagaacatggatgtgtgaatacagacagtgactggtgagctgcatggcaaaaggaacatcagcagagtaaacagacaacctacagagtggggaaaattcttcacattctatacatctgacaaaggactgatatatccagaatctacaaagaactcaaacaaactagaaagaaaaaaaaaactcatcaaaaagtgggctaaaggcatgagtagataattctcaaaagatgatatacaaatggccaagaaacatatgaaaaaatgctcaacatcactaatgatcagggaaattcaaatcaaaaccacaatgagataccaccttaccacctgcaagaatggccataattaacatataatagatgatggcatagatgcagtgaaaaaggaacacctctacactgctggtgggaatgtaaactagtacaaccactgtggaaagcagtgtggagatttttttaagatctaaacatagaactaccatttgatccagcaatcccactactgggtatctacccagaggaaaagaagtcattatacaaaaaagatatttgcacacacgtttatagcagcacaattcacaactgcaaaaatgtggaagcaaccaaaatgcccacaactcaatgagtgaataaagaaacaatatatatatgatgatatactactcagccattaaaaggaatgaattaatggcattagtagcaacctggatgggattggagacttattctaaatgaagtaactcaagaatgggaaaacattgcatgttctcactcagaagtgggagctggccaggagtggtggctcaagcctgtaatcccagcactttgggaggccgaggcgggtggatcacaaggtcaggagatcaagaccatcctggctagtgtagtgaaaccctgtctctactaaaaacacaaaaaaattagctggccatggtggtgggtgcctgtagtcccagctactcaggaggctgaggcaggagaatggtgtgaacctgggaggtggagctttcagtgggctgatatcatgccattgcactgcagcctgggtgacagagtgagactccatctaaaaaaaaaaaaagaagtaggagctaagctatgagaatgcaaaggcagaagtgttacgggaagtcagggaccccaaagggagggaccggctgaagccatggcagaagaacataaatcgtgaagatttcatggacattcattagttccccaaattaatacttttataatttcttacgcctgtctttactgcagtctctgaacataaactgtgaagatttcatggacatttatcacttccccaatcaatactcttgtgatttcctatgcctgtctttactttaatctcttaatcccatcatctttgtaagctgaggatgtgtgttgcctcaggaccctgtgatgattgtgttaactgcaaaaattgtttaaacaacactaaatctgggcaccttgaaaaaagaacaggataacagtgatgttcagggacaagggagataaccattaggtctggctgcctgagagccatgtggaacagagccatacttctcttctttcaaaagcaaataggagaaatatcgctgaattatttttctcagcaaggaacagccctgagaaagagaatgtgttcctaggggtaggtctctgaaatgaccgctctaggaatgtctgtcttttacagttgtagataagggatgaaataagccctggtctcctgcagcgctcccaggcttattaggatgaggaaattcccgcctaataaattttggtcagactagttgtcttttctcaaaccctgtctcctgataagatgttatcaatgacaatgcgtgcccgaaacttcattagcaattttaatttcactccggtcctgtgatctcgccctgcctccatttgccttgtaatattttattaccttgcgaagcatgtgacctctgtgacccacaccctattcatacactccctcccctttgaaaatcactaataaaaacttgctggttttgcagcttggggggcatcatggaacctgccgacatgtgatgtctcccccagacacccaactttaaaatttctctccttccctttatttctcagaccggccaacacttagggaaaatagaaaagaacccacactgaattatcgggggcgggttcccctgataagaagaatgacacaatggactttggggactcaggaggaaagggtgggaaggagggaaagtggtaaaaactataaattgggtacaatgtatactgctcgggtgatgggttcagcaaaagctcacaaatcaccactaaagaacatactcatgtaaccaaatatcacctgttgatattactcctatcaacattactcctacctgtgtctgtgtatctttgtcatgtgacttatcccccttgactttgtgcttggccctgttctcactttgagtaatggaacatttgtggaccttatgcaagctcaagtttaaatgtccttgcaccacttggtttgccctcttttgcaactctcattactaagatcttgtcctggatagtttttggcccttcaggctgggtttccaaataaacacgtgtgagtaataaatgctgatatttgtgactgttacatagcaatatatgaatgatacatctaacataaagcagacactggatattggtgtggtgagtgaaaacactcaggcttgtatgtatgtagattcctctcccacagagggcagtcatcaatattaccaactcaactaagaggatgattcttatttggtgcagtttctctaattccaagagcagtggagaagtctaataccagggcagtgagcacgaccatctgaacaactcttccttttatgctggccctgacgcatcctaacaggccaagaaacttggaagtgcctccctggaggcagctgggagagtgatgacagatcgggctacgtgggtgatttatttatattcttctattgtctaagatggatatgtttatttaaaattggaaataactgctataattaaagcattgaataaaactaaaattaagaattaaaaatttatatattctccaacatcctatcagtcaaagaaaattacaggtgggtattaaattgtcagataaaagaagaactttcagagcaaaggaaagaaatgaatatttataatctccaagcattgcatgtatattttctctaattctaccatttggctacattttaaggtgccctaaaatttgctttttttttttaaattttctttcgctttccaattctatctcattatcacccatgaagtcccatctttatttttttaacaacaaaatattaggagaaaattaatcatcatttaatccatttatttttatttatttatttttgagatggggtcttgctctgtcatccaggctggagtgcaatggcacaatcacggctcactgcagcctctgcctctggagctcaagtgatcctcccacctcagccttccaggtagctgggactataggtgtgcgccaccacacctggctgagtttttaaaatttgtatagagatggggtctcactgtgttgctgaggccggtctcaaactcctaggctcaagcaatcctcccacctgaacctcctaatgtgctgggattataggtgggagcaataatcatttaatctaaaattctctcagatgagtaggtatgggaaaatttttaaaaaaataataatattaaaataataatataatctaaaacctttttttcacaaatatatctcaggcccaaattttcatccgtccatccatacattcatcaattcattcactcaaccatcaaacatttatttatttatttttttgagacagagtctccctccattgcccaggctggagtgcattggctcgatctccactcactgtagcctccgcctcccaggttcaagtgattctcctgcctcagcctcccaagtaactgggactacaggtgcaagctaccacacttggctaattttttgtatttttagtagagatggggtttcaccatgttagccaggatggtgtcgatctcctgacctcgtgatctgcccacctctgcctcccaaagcgctgggattacaggcatgagccaccacacccagcccatgaaacatttattaagggcccattctgggtgacatattatgttaggttggactgtgagggtataaatacaggacaaatgagaagggttccttctgtcaaggagaacacactcgaagatactagaaataaaatagaaacttctacgctaattactaatacagagaattaccagatttttgaaagctcaactaataaagcaaccacccttttctggatatatcaagaaagtgtctgccttggatgtgggatcttagaaaaagaagagtaagtatggaggaaatgaggtcatctccaacagagggactgtgtgatagtatggactgcatatttctgtctcccccaaaattcttagattgaaaccctaaccccccatgtgatagtatttggaggtagagcctttgtgaaataattaggtttagaagaggacatgagagtggagccctcatgataggattagtgtccttaaaagaagaaaaagagactagatctttctgccatgccaggctacagagaaaggtgccatctacaaaccagaaagtggaccctcgccaagaaccaaatctgcaggcaccttgatcttagacttcccagcctccagagctatgagaaataaaggtttgttgtttaagccatccagtctttgctattttttttatggcagcctgaactaagacagcctggcaaacacaggaaaggaagctataaaagggcacaatgggctgggtgcagtggctcacgaatgtaatctcagcactttaggaggccgaggcaggtagatcacttgaggccaaggagttcgaaaccagcctggccaacatggtgaaactccatctctacagaaaatacaaaaattagccaggtgtggtggtgggagcctataatcccagctactcaggaggctgaggcagaagaatcactttagcccaggaggtggaggttgcagtgagccgagattgctccactgcacaccagcctgggcgacagattgagactccgtctccaaaaataaaaggcaccaatgactgtgtgttgagtgaccaattgtgttgagccatagaggaaagatgtaggcaccagtgacttgtccaggatcagggatgacacacttctttttcttgatagctattctgtcctctcccagacattttttttttttttttaacactgctgtcgcccaggcaggagtgcagacatggctcattgcagcctgaacctcctgggctcaaatctcccacctcaggctcccaagtagctgggaccacaggcatgtgccactatgcttggctattttttttttttatgtttcgtatagatagggtctcgctatgttacccaggctggtcctgaactcctggcctcaaatgatcctcctgccttggcctcccaaagtgctgagattgcaggcatgagccgcctcacctggcccctctcccaaactttcttttgaggttaaataatgtaaaaaggaagagtgtgtagaacaaaagtaatagctaatgtaaaaaaaaaagtttaaaacaaaaattatccatatctcactacttagagataaccattatatatattttgacaacaaatacccttctggatttctgcatttgctctgtcagatgttagttgaggtgggacagggaaaggggttaagggaggaggcaaggaaagaagggtcagaatgcaatttatcttacgaggcgttttcccatttagtaatacataatcaacatctctgcatgttttcaagtatataaagctccttagatcattacttattcatagtattacagggattctatgttttctctattataaactacatgttgttgaacttctttcaaactacatctattcatacagcaagtcatttactttgtaaaaattcctaaacttaaatatctggttcaacacaagtatgcaaaattttgtacagattttatttaccatagaactatggctacaaattaaatgaaaataatagtaataaattataataatataggagtcacctcacagatgtttccagtcacaaagtaaggcttttcctgctttgtacttaagttgaaatccccccaaagtgcataaaggcggatacatcctttctagggtacccttttcaccctgtagatgaaccctgacgtggccaactgatctaccgacagtagtacactctagatgtcttttattaaaataatagataatagagtaatccacaaactaggaccttacacacatacgcacagagcaaaagctcctgaggtgcagagcctacaggaaacctcatcaaaagctctgatggctcctgtcgatgagcacctttaggaggggctgctgttgtcttaagtcagaacagagatagtttgtgcctctccattttgaaatgctccagatttcccttccctgtcttggtctctcagagcctaatgtctgtgctggactagcatagtcagtctttggttatgtgtctgtattttctatttaaagtagtctaggctgggtgcagtggctcacacctgtaatcccagcactttgggaggccgaagtgggtggatcacaaagtcaggagttacagaccaccctgaccaacatggtgaaaccccatctctactaaagatacaaaaaattagttgggcgtggtggcgaatgcctgtaatcccagctactcaggaggccgaggcaggagaatcgcttgaacccgggaggtagaggttgcagtgagctgagatcacaccattgcactccagcctgggaaacagggcgagactccatctcaaaaaaaaaagaaaaaaaaaacattagtcggggtggcggcgggcgcctgtaatcccagctactcagaaggctgaggctggagaatcactgaacccaggaggcagaggttgcagtgagctgagattgcaccactgcactccaacctgggcaacagagggagactccgtctaaaaaactaaaataaaataagatactctaaagtaaattatttaaataattctcatcttaagcaagcagtttattcagcatgaggttcaaagtaaataacttcaaatcagatggtcatgaatataacttctttagtcattcaaaacactcagataaacaagacggataacactgaaatgaaatacagacaatgcagtggattttcaacaataactacaaaaaggactgaacaaagagacaaacaatgaatgtgggcttgcctaggaaatacagtagaaatgtcaaaaaaagttaaatgaatgagaggggtactacaatcctccaccccaggaaaccacagcaaggtgccgtggatcctctctgaagcctgacgttcaggttgttcatattttaggtaccctggacacttgctcataggccctgcaagaggttacagcagctgttccctcccacagggcaaagccagatctcacagccacctaggcctccccatgacagggagttgctccctgggacaaagaccagaataggaggaggagggagagataaaaggctcagatttgcataatgtgtcccacaaatacctaacctttatgcaagaggtgaggagggcataaaagagccattagagagtccaacactagctgtgaggccagtgggcccttggaacttcagcaccgtggtctagactcctctcctcctcctcactcagtcactgcccaggttcacagagatttcagatcagcctttagaatgattcttctgccttcttttgggagaaagtgggtctaggaaaaatagaatgcaaatatttttccaatccatagggaacaataagaggtatactagatgaagagtttatggtcaaatattttttcaaaaaaaaaatctctctatgatgtaattctgactgataatagcaaagaaaacaagctccttattttatataaaaaatttttctttttttttttttttttgagatggagtcttgctctgtcacctaggctggagtgcaatggcacgatcttggctcactgcaacctccacctcctgggttcaagtgattctcctgcctcaacctcctagggattacaacctcctagtagctgggattacaggcagccgccacaacgcccggctaatttttgtatttttagtagagacagggtttcaccatgttggtcaggctggtctcaaactcctgacctcgtgatccgcccgcctcggcctcccaaagtgctgggattacaggcatgagccaacgcgcctggcctaaaaaatttttcaaaacaatgcaagtttactacataaaatctggctttttttttttttttttttttttttaatgatgtggtcctgctctgtcattcaggctggagtgcagtggcacaatcactgcttattgcaggcttgacctcccaggttcaagctatcctcccctacctcaatctcccaagtggctgggaacataggtgtgtaccaccacacttggctaatttatttattttctgtacagcctggatccccctgtgttgcccaggctggtcttgaacttctgggctcaagctatccttcctcctcagcctcctaaaattccggaattacaggcgtgagccaccatgcccgacctagaagtatttgtttcaaggagcatatttaactacgccgtaaagaccaaatagttcagaagttagatgttacaattttagtctcttctcctacttcttcttttttttttttttttttttttttgagacagagtctcactctgtcacccaggctggagtgcagtggtgcaatcttggctcactgcaatctctgcctcctgggggggtcaagcaattctcctgcctcagcctcccgagcagctgggagtacgggcatctgccaccacgccggctaatttttgtatttttagtagagacggtgtttctccacgttggccaggctggtctggaactcctgagctcaagtgatttgccccgcctcggcctcccaaagtgctgggattacaggtgtgaaccgccgcgcctggctgttctttcacatattttctccatagttcagatcacaatgtatacaaatttttttcctgctagttttctttcacattactgcaatctatctcttttaaaaaaagtatatagtgcagctatttcagccaggcacggtggttcatgcctgtaatcccagcactttgggaggcagaggcggctgaccacttggggccaatgagtttgagaccagcctgggcaatgtggtgaaaccccatctctactaaaattacaaaaaaataattagccgggcgtgggggcccgcggctgtaatcccagctcctcaggaggctgaggcaggagaatctcttgaccgcaggaggcggaggttgccgtgagccgaaatagtgccactgcactccagcctgggcgacagagtgagtgaggctccgcctcaaaaaaaaaccaaaccaaaacaacaataacgaaaaacaacaaaaaaagtagattgtgcagctatgaaatgaaaagtacaaaactgttcagtttccaggcatttaaaattatttctggccaggcctggtggctcatgcctgtaatcccagcactttgggaggccgaggtgggcacatcacctgagatcaggagtttgagactagcctgaccaacatggagataccctgtctctaactaaaaaaaaaaaaaaaaattatttctactttacatttacattagtacaaccaaagtattgatgaattatcttacatactcaattttggatatatacataaacattcattctgtaaatttttattggatatgttaaaagcatcccatgaggccagcagtggctcacgcctgtaatcccagcattttgggaggccaaggcaggtggatcacctgaagtcaggagtttgagaccagcccggcctacatggtgaaaccctgtctctactaaaaatacaaaaaattagccgggcatggtggcaggtgcctgtagtcccagctacttgggaggctgaggcaggagaactgcttgacccctggaggcagaggttgcagtgagccgagattgcgccattgaactccagcctgggcagcagagtgagactttgtctcaaaaaaaaaaaaaaaaaaagcatcctatgaaaaaaatgaaattattacctttttattcatatattgaaataacttccaaaaaggcttatgccaattgaaactccttttaatacatcctcactgacagtaaacattacaatttatataatattcatcagtacgctaccattgctttaattcccatttttgtttttgctatggagactaaatattttgcatttatttaccaatcagctatatttattctttgtgaaatggacagggatttttttctttacaacaattttataatagtgcattagagatttgtcttagtaatctttttttttttgagatggagtctggccctgtcacccaggctggagtgcaatggtgcgatctcagctcactgcaacctccacctgctgggttcaaataattctcctgcctcagcctcccaagtagctgggattacaggcgcccaccaccatcatgcccagctaatttttgtatttttagtagagatggggtttcaccacattggccaggctggtctcgaactcctgaccttgtgatctgcccaccttggcctcccaaagtgttggaattacaggcgtgagccaacacacccggcccccgatttttcttagtaatctttggaaacacttcagaaatatttttaattagccctttcataatctcaggctataattttcctgtttatatgccataaaatgtgaacatgttacaccgtcaaataaaaaaagcaaggtgcagaagactgtgcataatataaatcagttatttaaaaaaaagaaaagaaaaaataagaaactatctgaaaggctaaaaaaagaatctgagttgttactttttcgatgtttgaagaatgtgaatatattatatactcaacattttaaaataaatgaactttaaaaagaatcctctcaaaatggtgtcagccacaatggcacaccagagagtgggaaggcaacacaatgaccattaactcagttttagctgccttccttgtatcataaaaacttctaatgttccattttccctgtggtaacttccaagatggcctccagtgattccccaccctctggtattcctatctgtatatggtccattcccacatagcatcagggttgctctgggtgaccaagagtatacaacagagtgaagttattttacctccaaggctattataaaaaacattgcaatgccttccttgttctcttttggatcactcattctgtaggaagccagctgacatgtcatgaggaccatatgacaaggaacagagggaggcctcctgccaatacccaagtgagtttgaaagccctagtcaagcctttcacatgatatggccccagtcaacatcttaactgcaacctcatgaaagaagctgagacagcaccactcagttaagtgaccccaaattcctgaccctcggaaaccatgagataacaaatagtggtggttttagttgataagtttgcagtaatatattatacagcaataggtaactaatacagattttagtacctggaagggaggtgctggtgtaatacctaaaatgtaggagtggctttgaaactgggcagtgggcagaagctaaaaaatcttcaaggagattgtcagtgcaagccttagtagaaaactggactctgagaaggctctggtgtagcttaaaatgaagtgaggaacatgttattagaaaattgagcaaggggttacgtagttacgtagtggcagaaagtttagtgactatcacctagtcaggtgaaagtagaaaatgtacctgagtcatctaattgagatttccagccagaatgctgaaagtgctgattggtttcttcttgctacttatagtaaaatctgaggggacagaaacaagctaagggaagaagtgttaaacaaaaaagagccaagagccaatacctgctggttttgaaaattcccagtctttccagatggcaaaagatgctaaaattaactgctcccaagcaaaggttatatccagggcactaaagaaaggtgcagaaatatgaaagatgagggtaaaaatcctttttactttttctttgagacagagtttcacccaggctggagtgtaacggcttgatctcagctcacggcaacctctgcctcccaggttcaagtgattctcctgcctcggcctcccgagtagctggagttacaggtgcaggccaccatgcccagcaaatttttttttttttttttttttttttttagtagagacggggtttcaccatgttggccaggctggtcttgaactcctgacctcaggtgatccaccagccttggattacaagtgtgagccactgcacccagtcagagggtaaaatcctttaaggctctgaaagatcaaaaatgatgcttcagagtacagtagtcccctttatctgtggttttactttccatggtttcagttacccacagtcaattgtggtccaaaaatattaaacggaaaattccagaaataaacaattcataggttttagtttatttatttatttatttaatgacagggtcttgctctgtccttcaggctggagtgcagtggcgtgatctcggttcactgcaacctctgctcctcggcctcaagcaatcctcctacctcagtgtattgagtagctgggattacaagtgcccaccaccacacccaactaacttttgtatttaagtagagatggggtttcactatgttggccaggctgttctcaaactcctgacctcaaatgatctatctgcctcagcctcccaaagtgctgggattagaggcgtgagccaccacactcagccaacaattcttaggttttaaattgcatgccattctggttagtgtgatgaaatctagtgcagtggctctgagttccattcaggacataaatcatcccattgaccagcatctctatgctgtgtatgctatgctcttgtggtgttataatatacattggttttgtccacagttcataactcccacagcccttgttacagtcttttgttataatgttcggtgttaggcctcagaggtaggcttctgaccttctgccatccttttacctgccccaaggcaggactctaatctttctgattgtgggttctaagaccctcccaagagagaatcctgccctatactctagcgggagagaatgcttaagtcatgaagcttccataaaaacccaagaagactgggttcagggagcttccagttagctgaacaacacttggaggttcttggaggttggcgcactcagggaagccatggaagctccatacctctttccacacaccttgccctgtgtgtctcttcatctgtatcttttgtaatatcctttataataaacctgtaaacgtgtttcctcaagttctgtgagctattgtggcaaattaatgaaatccaaagagggggttgtgagaaccccaacttgaagtcagtcagtcagaagttcagtatacccagacttgggagtggtgtctgggggtatggggggaagtctggaggaccgagaccctaacctgtaggatctgacactaaactgttccaggattcctgacactcagagactatgtgagttaatgtttaagctgttagttttgtggtaacctgttatgcagcaacagataacacattcccttccctgtttgcaaagcacacaatcccacccatcaaaaaacatggaaaaatggtactaaggtttcgatgtgtatgtttatacacacccatgcacacatccctcagacagcttttctgtcatttctgacattgtgcctctttctactgttttggattctatcaatccctggataggatcaaggaataaccccatcccattcacatccaaagttctaagccattagcccacatacatgaatacaggggaagatacaaatgagtctaagttataactagagcaggggtcagcaaacttttttctataaagtgtcaggtagtaaatattttaggctttgctgggtgtatatgggtctctggctctaacaatgttttgaaaatttaaacttagcctaaaagccacagtttgccaatgcttgccctaaagctaagaaagacttgtgtcttagtggcagtcttgccacacattgataattgttctaatttcaatctcataaccgggaaggaaagagtctaaaagggctaaccactgaaatggaatttactttatttatatgatgaatgcttttaaaagacaaaataactcacttatataacatttgtctgtttttttgagagagtctcgctccattgcccaggttggagcgcagcagggtgatctcggctaagcctccaccttccacctcctgggttcaagcgattctcctgcctcagcctcccgagtagctgggattacaggcacacaccaccatgcccagccagtttttctatttttagtagagacggggtttcaccatgttggccaggctggtctggaactcctggcctcaagtgatccgcctgctttggcctcccaaagtgttgagattacagttgtgagccaccataccagcatttgaaagaataaaaatcactatgggattaagtaaactcaattgtatttagaatttatcattcttttccatagatgttatcatgaataattacaattgcaaagtacatataactttgtatgttcctttcttattttgcattatagccaaataaaattgtgtactgcaatagctcctataatcactacttttgataactgaatactgtttgtagtaggtatatatttaataatttgactttcagtttggtttccaagttttgggttttttgtttgtttttgaggcagcatctcttgtcacctagtggtacaatcataactcactgcagacctcctggactcaagccctcccgccccatcctctcaagtagctggtcagactacaggtgtgcaccaccacgtcttaattttttttttttgagacgcagtttcactcgtttcccagactggatggagtgcaatggtgcaatctcagctcactgcaacctccacctcccaggttcaagtgattctcctgcctcagcctccccagtagctgggattacaggtgcccgccactacgcctggctaatttttgtatttttagtagagacgggttttcaccatcttggccaggctcgaactcttgaccacatatgatccacccacctctgcctcccaaagtgctgggattacaaacatgagccaccacgcccagctggtttgaatcctttgttaaagaaaattaaaaaataggttaggcatagtggcacacacttgcaatcccaacactttgggaggccagggcaggaggactgtttaagcccaggagttcgagaccagcctgggcaacatagcagaaccctgtctctaccaaaaaaaaaaaaaaaaaaaaaaaaaaaacctcacaaaaaacaatgctaaagaaagcgaatgagatataatgaataaaaacaaaaatagagaaaacaaaactaaagcaaatggggggttgcttcttggaaaaagtaaatcagaaacattgataaaaccaggacgaattaatgacaggaagaggaaatacactttaatattagaaatgagaaaggaagtgggattccgagtagttaaaaccatatcctatcccaaacagaactacttttgcttcaggaaaggaaggtttctaacaagaaagctgtaagtgcaaccaagtaaaaacttgggttagtaaagaaaatgattgtcttaatagatgttgtaaattataaaactaaataattctctttaaagattctaaaaaatagaaatagaaactttttttttttgagatagagcttcgcttgtttcccaggctggatgcaacctccgcctcccaggtacaagcgattcttctgtctcagcctcccaagtagctcggataacaggcatgcgccaccatgcctggctaacttttttgtatttagtagagagggggtttcaccgtgttaggctggtcacaaactcctgacctcaggtgatccacccgctttggcctcccaaagtgcagagattacaagcatgcgccaccacacctggccccaaaaatggaaatagaaattatttaagcaatatacttattacctttaagggcaaatcatttcttattaaagccaagaacaaagaagcccattaactccatcttaaatattgtttagaagttctggctgtagtgccgggcacggtggctcacgcctgtaatcccagcactttgggaggccgaggcaggtggatcatgaggtcaggagatcgagaccatcctggctaacatggtgaaaccccgtctcttctaaaaaaatataaaaaattagccgggcgtggtggcgggcgcctgtagtcccggctacttgggaggctgaggcaggagaatggcgtgaacccgggaggcagagtttgcagtgagccgagatcaggggccactgcactccagcctagctgacagagcgagactctgtctcaaaaaaaaaaaaagttctggtggtagcaataaggctaaaaatgaacacaagtggcaaaaaggcaaagattatacagtggtactaaataaaaattaaaaactaaaaataggccaggcatggtggctcactcctgtaatcccggcactttgggagaccaacgtgggcggatcacttgaggctaggagttcaagaccagcctggccaacacgatgaaacctcgtctctacgaaaagtacaaaaattagctgggcatggtggcacacgcccatagtaccagctgctaggaagaatcacttgaactcagggggtggacattgcagtgacctgggatcgcgccactatactccagcctgggtcacagagcgagactctgtctcaaaaaacaaaacaaacgtcccattttacttatggtggaaagacaatacagcaacaatacagcaacagcatttttttcacaaaacattttattactataattgatattttacttataatttttggcaacattaataaaataataaatttcacctgaaagaacaagcgagcaaaatagacaaggaaattcacaaagggcaataacaaaatagtaatcttgacatattcaatatatttgtaaacaaaacaaagtgacattgccttaaaaatatatagaggtatcaatagaaaaacagagaaagctcctgaaagaactcactatattaattttcatttggttgcaggcacagaaattgactcaagctagctcaattctaagacagaagcaaagcccttgatgctgatcgctttccagctttttcatgaaaacctaggaaatttaaatactttgaagaggaagaaaagagtggggagagagtaaagtgcctttaagaggaaaagtagaagtttttttttttttttaaagggagatctcattgtcagtggcattttaagagccttgaagctcaatgaaccaaaggaagtgtcaaacaattaagtgaggtagcaagccatgcaggcctaggggaagggcattctaagaaagacaacagcatgtgcaaagtctttggattgggaagaatgtgatttgcttaaggaatagcaaggccagtgtgtcaaaatagtgcgtcattggggaaaacagtggagaagcatgacagagaatgaaaaagagaggaaggaggtaggcaggggccagatcactggaatctacagttggcaattaatgaccatatgtactccttaagagcatgctttaatgaaactgcaaacaacagtgttgataataccaaccaatcactcaacatacaactaaaacacttcatatttttaccacagaaacagaatacgggaggtaagtatgaaaagtctgtagatctatttatacacagtgggagtatctacctgagacaagaaaaactggcacacacacacccacttgcacacacataccctttcttcaactaaagaaaggattcaggctgtaattttagcaaagtgtcttaacccaagcaacgtaactgaaaagacctagtatagtgttcaaggtgcaaatcaatcaaatgagtgtccggcaaataaatacaacagaatctatggatctagagtcagaaaattttctaaaatgtagataatatactcacaacttctttgttatctgtactgccttctactctaagagggatgctaagctcttaattatctcttcccggatttttgtgaaagcttaggaaatttaactagattgaggagggaagaaaggagtggggagagataaggtacctttaaaaagaaatcaaggaaaaagggagagatttctccagacctatgtctacagccaagatggcggattccttgactggtgaagacaggctgctgggcaccttggtcaggggtggaggaacaaaggatggcaccagaacacaagcagggagacaactccgggagtccacagaggcagccaagactgctgatgttcaggaaccaatactcaaaaggtactccagaatactgtgaaacagcccctggggagagcaagggaaaaagattcacccatagtacagattagataggatagatcagatgaaggacattaactctaagtcttaaaacttattgaattagagagacatttcttgcacactggtgtgtgtcaggtaagacccaaacagcattagtgtcaaaaaactgggaaactatacatttaacagaatagctgcaagctgtaatacattcatgtccaaagcaagacataaagttgcaagcttcacatgttcaattagggtaagatatatatgcacagaaaaatataaagccattatgggtttaaattcagtcagtcaccctgggctatttttgtccactgtacctactgttgttgggacagtcctcattccagcttaacagtgggaaaactaaatttagcccagtccaggaactggacagacaccacttgtttggcccttttcagttaaaactatgggtccagtacagttcaaattatagatattagggcttcttccccttgggaaacttgctttacagctgtggctgagaatatggccagttcattctccactaacggctagccagaagggagaggagagggaatgaatcaaattcacctttagatcacagaacaggaagtcagctagtaccaggcaccattctattaattttattgctatttcacctcaaaccaatgatacatgacggctgtttgatgtctgcaggggcccttcaccaaacaaaaccattttactttgaatggtttggcttccttggatgttttcaggtaggtaaagatactctgaagcagtgttccttttgacctggccccaagactagaatgaatgtgtgcctatccttcaactagaacaaagaaccactgctctccctcaactaacctccgccttcttggtctctgctcacgcagcagcttctctttcaattccacatcctggcttttcagaatcttttcaggttattttatgccagcacagcagaggcacttctgggaattcggcagcaagtgggccagggcataacaaagccattccagtctgactagagttaaccatgaaatgctgaatgcatggaaaaagctgtaaagaaaactaagtatttcaaaaattctatgaattctgtatatagaaaaaagagctttcaagcttaggagtaacatgaaataccaaaacaataaataggtgccaggggcagtgactcacacaacccagcacttggggaggctgaggcaggaggctcccctaaggtcaggagttcgagaccaccctgggcgacataacaagattccatcgctacaaaaaattaaaataaaaaactagctgggtgtggtggctgcgcctgtagtcctagctactctccaaaggctgaggcggaggaatgcttgagcctggaagttcaaggttgcagtgagctaggatcacgccactgcactccagcctgggtaacagtgagaccctgtctctaaagtaaaaaaaaaaaaaattaaaattaaaaaaataaattaatacctttctctctcacacacacacacacaaacaccttttatgtgttaagccagatacagttaacatgaaaaccagatgttttaaaataatacctcaaaattcagatcaaataatatatatcctgaatcttgtttaaaaagtcatatataatccactagtttcactatttttggtgctactgaataatgtatggtttgtattttttgttttatgaggttttttaatttggtttgaaatacttgctttagatttactgaaactagaattaatgggacttttttgaaattttgcttttagacctggggagtgatggttcagagtcagatgtgctcacagttatggatgctacatccactgatcctggctgaagaggttccagtgacacttgaatagtaacttttgtttcaggaggtaatccttctagttgcttaggcttcttaaacatttgatgacactgggtcttgtgctccattttctccttgaaagttaaaaactgtagccggcacttggaacactggtgtgcactctttccccagtggcccctataatgacacatgtatggtgttgctgttttgaaaattttgagacaaaagggacaaagcaaattctttgtgttttcatggcacgttctaaaatgtgtttctacatcagcaaagaccgacgatctataatggcaaacctggcacacatagggcatttcgccaggcttatgatggtccttcatgtgttgtaagaggacctgatctgtttcaaatgacaattcacagattttacagacagtagagggctcctgggcagtgtggacattttcgatgtgacactgtagctggaagggagtgggaaactgccggtggcagtgctggcaggtggtgtggttttcccagctgtcgttcctctgcttctcaaattccaaatgatgcttcacgtgattcataaacttaacattttttagaactttcacgcagctgaggcatttaaaggtggtgtgagtcttctgttccggctgcccttctcctttatgctgtccatagtaaaagtcactaagtaacacaatgggattttctttcttgggatcaaaggtcttgttttgacttgttagactcaaaatgtctgtttttgccaattcattttccctatcaagatttgtatttataggcttgaaatggatattgtcctttggaaaagctgctggaaaaggtgctccattctgaacatggcttaatgaggtatgaacattatttgagggtgtactttgctgagtattcattgtatgaaaggtatctgaagggaacgaagctgaagaatttccttctataattccatccctgagtttagcccttttgggatttatgctgtttacttcgaaagtggaaagttgctttgatacacgaggactttcatttatacctcctactgaaagtgctgtacttactggatgatgcaatgaatctgtgaatgtaatcaaaggagaaggtaattctgaagagttattaggcacaacttgtggtgaactatttctataatcaggtttagacaaaggctcaataataataggactatctgttgatctcgattcaagttgggaagctggcaggacggtcactgcttctgatgtaacggtctcatgacttttaggctgcaatttgcgagcagtatcttttctaaggtgatcatacttttttctccttgaccatgaacccggggtgactctgttcaaaatgtttgaaacgactggttttgaatttgaagtcaccccaacaaagattagctcagcatcttcatttacatgttccacaccaacaaagatgagctcagcatcttcgtcatctacttgtttggtttcttgtatgttcttctgtggttcaggctctttctcttcctcacatgattgttccattttctaatttttttattcctgaatggtggggccacaagtcccaatgcttcctttatataaactgccacctaagtacaaacatacatcagtaagtacaggaaaatgcattaccttatttaattttcctccaaaacattgtttttataaaccactattttacccacaaggacactgagactgaaagaggataaataacagcttaaaacctgtgataaaagatcaggttcctatgaatctagaatcataactttgctgtactgattgtgctctattccattttaaaaaaaaaacctaccagcagctaatcactaggcaaaattatatggaaaagacacacatttttatgagggcatcattgtgcagtgtttagaaacatgggctttggagttgaagagtaagctggaatccttagtctgccacacaccagatgcttcctctttagcaagttttttacttttaaatgtattttgctatcttaaaggcaaaaattcttatttcttagacttacagtaatagctggttttttaaaagcaccacctattcaatggcagcttgatttgtagtggaattggaagaaaattacaataaatgaaaatatctcaattgattcatatatagtaatctcataaacattaatatagaaaagaggtattaaatttatagagttagagtacctacacataaccaacaaacagcatagcacaatgtcaattgccaggcagataatctcatcccaactcatggccttaattataatccattcagtaatgcctcctaaattttcccctccagttctgacttacccactgaacttaaacacaacagtgcttcctcctcaatctcttctccacatagcaagcagattgattgtgttaaacaaagtcagactgtatcattgttcagctcaaaaccctccaacggctttctgattaactgagagtaaaagaccaagtattaccaatgcctagaagactacactaccaaccccacatactgctcctgcagttatctcatactactctccactatccacttcactgtagtcacactaacctccttgctatttattttaattttttaaattaaattttatttttttgagatggagtcccgctctatcacccaggtatatatttcagctcactgcaacctccaccttccaggttcaagtgattcttgtgcctcagcctcctgagaagctgggactacaggcatgcaccaccacacccagctaatttttgtattttcagtagagatcgggtttcaccatgttgaccaggctggtcttgaattccttatctcaggtgatccacgtgccttggcctcccaaagtgctaggattacaggggtgaggaactgcacctggccctccctgctatttcttgaacatactaagctcttttccttgctcaaagcccttgttccttccaatatgaatgatcatttgggtatccgcatggctagctcctcactgcccttagggctctattccaagtatccctctcggtgaggttcttaaatattccaaccaacctctaacccacattcctaatctcttttcccttttctttcatccccaaagccctatcaccatttaacatattacgatcctatttatcttgattattttctattgtccatccagtggaacataaaactcaaaagggcaggtattctatcttttgttgactgttgtatgcccagcacaaagaacagtgtctggcacaggacaggtgctcaacaaatacagaatttgttaaatgaatcaataaatatcgactctccttcataagatcctttatttttaaagaagattatgctccattaattccacattttctatgaatttactctgagaactttatccattggaaattccgtaggccaataaaggacttaaagctagctttttacaaatatttgaccacaaccaatagtttaaaaaaaaaaaagtgatatggagtccaattacacaagcacatacacataaataataactacctttactacacaggctgcattctaaaattttctatttcatttttcttgtctttttcttttttttttttttttgagacggagtctagctctgtcgcccaggctggaatacagtggcgcaatctcagctcacggcaacctctgcctcccgggttcaagcaagtctcctgactcagcctccagggtagctgggattacaggcacatgccaccacacccagctaatttttgtattttttagtagagacggagtttcactgtgttggccaggctggtcttgaactcctgaccttgtgattcaccagcctcggcctcccaaagtgctgggattacaagcatgagccatggattacaagcctgagctgtgcccagcctcatttttcttaaactaaccacagacccacaaaatcagttaagcctcatcactaggtcactactagttgtttcaaaaactggtctaatgctagcaaaatgtacgcactagaaaccaaggttcataactcaccaatttctaaaaacatatcaagattcactgtatccccatgtggacccttcaaatcagcataatccaaagcataaaaattaaattgacatctaataaatgccatgcacatttgttttaattttaattaggatatcagtatctaattttggaacatatagacaatatttattcctataaatatgtgtatcaccttggaagtgaatttaaaaaggaatacaatattaagtaagcattgtcaactatatacaaactggtgtatcatgaatagtgatttacaacttaattagtagatatataatgccagaaaaaatataaggcagatatgaatacactgctctctggagtcaactaaaattggtttagtctgtctatatacaacttcaatcgcctaactccaggatgatgtcacctagcccagtgtttcctaagcattactgacatttgggactagataattctttgctgggggctgtcgagagcactgtaggatgtttagcagcatctgtgatctctacccactagaaaccagcagtagtcccccagggtggcaactaaaaatggctccaggaattaccaaatgtcctgtgggaaaactcctgcccaaatccaatcttctcaggatcacttccacatttccagtaactaccttctacataattctaaatgtattttctaacatcctctctaaagaaaatatctggccgggcacggtggctcatgcctgtaatctcagcactttgggaggccaaggcagttggatcacaaggttaggaattggagaccagcctggccaacatagtgaaaccctgtctctactaaaaatacaaaaaattagctgggcctggtggtggacacctgtaatcccagctacttgggaggctgaggcaggagaatcgcttgaatccaggaggcggaggttgcagtaagccaagaccacgtcactgcactccagcccgggtgacagtgcgagactgcatctcaaaaaaaaaaaagaaaatattctaattcacaatcattaatattctccaatatcctaaaaaatcagactataatctgacaacatggccattagatttatctgaagattaattagtttattattgttattattttttctttttcaagacggagtcttgctttgtcacccaggctgaagtgcagtggcatgatctcggctcactgcaacctctgcttcccaggttcaagttattctcctgcctcagcctcccgtgtagctgggattacaggtgcgccaccacgcccagctaatttttgtatttttagtagagacggggtttcaccatgatggccaggatggtcttcatctcctgacctcatggtctgcctgccttggcctcccaaagtgctgggattacaggcgtaagccaccatgcccggccaatctgaagattaatttttaaagcccccagaagtttatgatttactaaagttatatggagggtttgtagacagagttagcactaagatgcctaattcctgaattctggttttgtgctctttctgctaaaactgacttagtgcacacttatttctgatgatattgctgttaactgcttagtctttaagaattaaagtgtctcattggattcattttttcactctctattttgtaaacctgttcaaacctcctctacctcccagaaaatgtcaaagtaccttataagccattttaaataacttttagagcatcactcattctacctctcatgtccattcctattaatggcccccagcccaggccgcaacttctaggtttaggtccactggttacttcatttttgtacacttgtactagaccctaaattgttctgtctcttttctctgtccttcaaattatataacacaacaccacaagatggatcttaaaacacaactgtaattatatcactcttctatccctaagcgttaaatgattcctccaattctagagaatattttaggtatacataatttgtgttatgctatgggctgaactgtgttccccccacccccaaatttgtatactgaagctataacccccaatgtgatggtatatagagatggtggctttgggtaataatcaggttaagatgtattcatgaggatagggccctcatgatgtgattggcgcccttataagaggagatatcacagaccttgcttcctctttctgtcatgtgagaacacagcaagaaggctgtcatccaccagccaggaagagagccttcactaaggaaccaaatcgtccagcatcttgatcttgaacttcccagcctaaaaatgtgagaaatgaattcctgttattaataaaccatcaaacaagtaaagaagaaaaacttaaactgggttctaatgacactgctggacttcctaaccagttgctcttggttagatttttggctgttgtccatactgattaaccctccatccaaccatcaatcaaggtgaaaaagaggaatagagcaaggatcaggaacaaagctaataagttaatgaacaagttcattaagaacaagagtagcattagaccatgagagttttcttctcctctagatgtccagagacccttctctacaaatgtccaccaatggatgaatgaatgcttattttccaatttgccagaatcttgagatactggggtagggaggttagacatgcaaagatatatcagatctaacaggtttgtcctcaaaaatcaattctcacctcccatgatgggagaagccaataggagggcttcaattccaaagaaagctgagagatcagtggatgataacccaccttccagattatttctatgcattcaaacaatggcccttctactagatcattgttttttgttttttttgagatggagtcttgctctgtcacccaggctggaatgcagtggcgcaatctcggcccactgcaatctctgcctcccgggttcaagcagttttcctgcctgaggagctgggattacaggtgcgtgccaccacgcctggctaatttttgtatttttagtagagatggggtttcaccatgttggccaggctggtctcaaactcctgaccttgtgatctgcctgcgtcggcctcccaaagtgctgggattacaggcgtgagccaccgtgcccagcctctagtaaaccattgttattaccacacacgagtttttaaccacacacatactcttctgaggaaaggcttccccaaactattggtccttatgatgagatctggccatatatatttttcttctgaaccccaggattgtggggctgtcacatttcctctaacagtacaccttaggagctcccagacttgaagaaaattggctgtttcccacatttgaacattttccactttttccctcagtctacctttttgaattgatttctgactacttctagataacctttttccattaatgaatattgagtgcttattgtgtgccaggcactgctttaggcacttgagagaaatcggtaaacattaacagacagaaatgaacaacaaaaacaaactatttcaacagaaggaactaacaaacagtccagtggaggaagaaagatagtaagtataataaaaatgcaaattctctggtgaactggaagatgacgttatagaattaggaaaaaaataatagagcaggcttagaagttgaggaggtataagagaattgtaattttacgtagtgtagtcagagtaagtctcatggagaaggtaaatttggacatacacttgaaggggataaaaggtcagagaggtagcaagagtggaaatagtagtaaggatctgtaaattcttcatttttctctcagtttagtctgtggcaactgtcatgtcttttgataaggaacgaccttggtttaatagttactcccctcctagactctcaggctagattttttttttttttaattgagacggagtcttgctcttgttgcccaggctggagtgcagtggcacagtcttgtgcacagtcttggctcactgcaaactctgcctcccaggttcaattgattctcttgcctcagcctaccaagtagctgggattacaggcgcccaccaccatgcctggcgaatttttgtatttttagtagagatggagtttcaccatgttggccaggctggtctcgaacccctgacctcaggttatccacccacctcggcctcccaaaatgctgagattacaggcgtgagccactgcgcctggccttttttttttttttttttttaagatggagtctcgctgtgtcacccaggatggagtgcagtggcacaatctcaactcactgcaacttctcctgagatgcttgtgcctcagcctcctgagcagctgggactataggtgtgcgccaccatgcctggttaattttttgtatttttattagagatggggtttccccatgttgtccacactggtctcgaactcctgacctcaagtgatccacccaccttggcctccaaaagtgccgggattacaggcgtgagccactgcacctggcctctcaggctagtttcaaccctattttacactcctctaccatcctcagcttacttttgaaaaagtatttattaaaaaatatttatgaaaaagttatttttgttttatttagttgccctgggatggaatacaaatgtttgctgtagttttaaggatcctataaaactcccatttactgcaaggatctctgtttaatgggcattcaattctaagatagcaaacgtgtagagttatttgtgggggtgggggacaagtttgagaaagaagcagtggggtgaagaaagtgataggcaagggaagatggtggggataggtaccataggagtcctggtggcctaaaatctaatcacagaagttactcaagtgggactgatgcctgaaaaaaatttgtgtgtggctataacagtgagtgggatctactcttttttttttttttttgagatgggagtctcgctctgtcacccaggctggagtgcagtgccgtgatctcggctcactgcaacctccacctcctgggttcaagcaattctcctgtcttggcctcccaagtagctgggactacaggcacatgctaccacgcccatctaatttttgtatttttagtagcgacggggtttgatcatattggtcatgctgctctcaaactcctaacctcaggtgatagacccgccttaggctcccaaagtactggaattacaggcgtgaggcaccgtgcccagcctgggatctactcttaagcaacagagaaaatcagtcatttttccccttttccttcccttcctcctatgagcagaatcttggtctccatctttaaaaaaaaaaaaaaaaaaaaaaaaaggccaggcacagtggctcacacctgtaatcccagcactttgggaggccgaggtaggcagataacctgaggtcaggagttcgagaccagcctgaccaacatggtgaaactccatctctactaaaaacacaaaaatttgccgggagtggtggtgggcgcctgtaatcccagctacttggtaggctgaggcaagagaatcaattgaacccgggaggcggaggttacaaaggagatttgacagggtggcagttcaaactaaaagtggtctgatagttcagagtcaagtttcttcactaaagctgagtttttaaagggcttgaagaatgatgtaaagaggggttgtggaggaccacaaaaaaagacaactaaaaaaaggcataacaaagtcaacttattaaatgcccagcaacagggtgaagttaaggggaatggtggaataaagacctacaaatagctgctgcttcataaaagcaaagagaacactagcaaaaactacaaaaatcacgtttttcagatcctggaaattaacgaaagcttgtaaaactcaaaagattttattacaaaatggcttggcggttcctcaaaatgttaaacatagacttatgatcccacaaatctaagtatacactcaaagaaataaaggtactcaagtacatgtatacatgtttatagcaacaactcataataatcaaaaggtggaaacaacctaaatgtccatcaatggatgaatggataaacaaaccatggtatatacatacaacagaatgtttattcagccataaaagaaacgacatactgatacatgctacaacagggtaaaccctgaaaatataccatgtaaaagaagtcagtgacaaaagctcatatattgtatgatttcatttacaggaaatatcagaaatagataaatccatagatattaaacaaagatttgtggttgccagaagataggaaagggaaaatggtgagaaactgcttaatgggtaaaggggttttactttggaatgatggaaatgtatcagaactagatagaggcagcacacgtacaatattacaaatgcactaaatatcactaaactgtttattttaaaatgactgatgttatgtgactttcacctcaatgaattattttttaaaaataaagagggtatattactaccaaccacacagaaaaaaagagaattataaaggaatactatgaaaaattatctgtcaacaaattagataacctagatgaaacaaattcctagaaagacaggaactaatgaactgactcaagaacaaacagaaaatatgaatggatccaaaacaagcaatagaattagtaatcaaaaaacttccccaaataaaagcccaaaatcagatagctatgctagtaaattcttaacgtttttaaaagaattaacaccaatccttcattaactcttccaaaaattagaagaggagagaaaactttgcacatctttctatgaggctagttattactcttacaccaaaatcaaaccaagaaatcatatataaaaaaagaaaactacaggccaatatcctttttttttttttttttttttttttttttggagacggggtctcgctctgtcgcccaggctggagtgcagtggcgtgatctcggctcactacaagctccgcctcccaggttcaggccattctcctgcctcagcctcccgagtagctgggactacaggagcccgccatcacgcccagctaatttttttgtattttttagtggagacggggtttcactgttttagccaggatggtctcaatctcctgacctcgtgatctgctcgccttggcctcccaaagtgctgggattacaggcgtgagccactgtgcccagccaatatcccttacagaggcaaaaatcctcaacaaaatgttagcaaacaaaatctaacaacatatataacgattacataccatgaccaagtgggatttatttaaaaaatacaaggatggttcattctatgaaaatcaaccaacaataattttatttttattatttttaattttaattttttttttgagtcggaatttcattcttgttgcccaggctggagtgaaatggcacgatcttggctgaccacaacctccgcctcccgggttcaagcaattctcctgcctctgcctcccaagtaggtgggattacaggcatgcgtcaccacgcccagctaatttgtttgtatttttagtagagacatggtttctccatgctggtcaggctggtctcgaactcccgacctcaggtgatccgcctgccttggcctcccaaagtgctgggattacaggcgtgagccaccatgcccagcctataccattttaataaaggacaaaaactacacctgcctgcagaaaaaacacttgacaaaagctaacatccttttatgatttgaaacaacaaaacgattaggaatagaaggaaactttctccaccagacaaaggcatctgtatgagactcacagctattatagtatcatacttaatggtgacactgaaagtacccctgcccctaagatcaggaacaagacagatatccactttaaccacttcaactcaacaccgtactagaggttctatagccaaggtaattaggcaagaaaaggaagcaaaaagcattcagattggaaagcaagaagtaaaaccataatggagatgacaaatacaaataactcaattttttaaaaggccaaagaacttgaatagacatttctccaaagatgatacacaaaagaccaagtaaatatattcagtgtcattaatcataaaagcaatgcacattaaaaccaccttgagataccacctcacacctagtaggatgactactattaaaaaacaaacattgttggaaagaaattagaatcctcatgcacagtcactggattgtaaaatggtataactactatggaaaacagtacagaaatgcctcataaaattaaaaacagaactactatatgttctagcaatcttacttctgggtatatatctaaaataattgaaagcagggtctcgaagagatactggcacacccatgttcacagaaggactattaaaatagccaaggggtagaagcaacccaaatgtctacccaaaaatgaataaacaaaatattatatatatatatgcacacacacacaatagaatattattcaacctcaaaaaggaagaaaatctgtcacatgctacatgtttgaaccttgaggatattatgccaaataaaataaaccagtcacaaaaagacaaatacttttgtatttgtataattccacctatatgaggtaactaaaatagtcaaattcatagaaacagaaagtagaggccggaagcagtggctcacacctgtaatcccaggactttgggaggctgaggtgggcagatcatctgaggtcaggagttcgagatcagcttggccaacatggcaaaaccctgtctctactaaaaaaaatacaaaaattagccagatgtggtggcaggcacctataaacccagctacttgggaggctgaggcaggagaattgcttgaacccaggaggcggaggttgcagtgagctaagatcacgccactgcactccagcctaggcgacaagagagaaactctgtttcaaaaaaaattagctgggcgtagtggtggcacacacctgtagtcccagctactcgggaagctgaggcagaagaatcccctgaatctgggaggcagaagttgcagtgagtggagatcgcaccactgcactccagcctgggcaacacaccaagactccgtctcaaaaaaaaaaaaaacaaaaaacaaaaaacaaaaaaccaaaaaaacaaaaaacagaaggtagagtaatggttaccaagggctaggggcagaggaaaagggtgagtctgttgtttaatgggcattgtttcagttctgcaagatgaaaaagttctagagatctgtttcacatcaatgcttgaaactactgaactattaatttagaaatggttaaggtggtaaattatatgcgtttttaccacaataaaacaattcattttaaaaacaggccccaatcggcatggtggctcacgtctataatcccagcactctgggaggccaaggtgggagaatcacttacagtcaggagtttgagaccagcctggccaacatagcaaaaccctgtctctactaaaaatacaaaaattagccggcatggtggcacgcgcctgtaatcgcagctactcgagaggctgaggcaggaagaatcacttgaatccaggaggcagaggttacagtgagccgagatcatgccaccacactccagcctgggcgacagagtgagactctgttaaaaaaataaaataaaataaaaaataaaaaataagctagacacagtggctcacgcctgtaatcccaacactttggaaggctgagatgggaggatcgcttgagcccaagagttgaagatcagtccaagcaatgtagtgagaccccttctctacaaaaaatttaaaaacacaggcacagtggctcatacctgtaatcccagtattttgggaggctgaggcaggaggacttagtcagctcaggaattccagaccagcttgtacaacatagtgagaccctacctctacaaaaaattaaaaaattaaccgggcgtggtagagtgtgcccgtgatcacatcactgcactacaaccttggtgccagagcaagactgtctcaagaaaaaaaaaaaatttaaatttagctgggcatcatggcacacgcctgtagtcccagctactcaggggtggaatgaggcagggtggcagctgagatgggaggatcactggagcctgggaggtcgatgttgcagtgggccataattgtgtcactgtactgcagcctgggcaacagagcgagaccctgtctcaaaaacaaacaataaaaaatgggcgaaggatttgaacacttctccaaagatacacaaatggccaagcagcacatgaaatgctgctcaatatagtcattaaggaaatgcaaatcaaaatcacaatgagctattacttcacatccactaggttagttataagcaaaaacaatctcaagcgttgcagaggatgtgcagctatctgaaccctcaaatactgctggtgataatataaacttgtactttggaaaagtttggcaattgctcaaaatttaaatatggcgttaccatatgacccaacaatatcactcctaggtatatacccaagagaattgaaaatataacacatatataagctagctggaatatagccataatgctgctacaaagtgcaaacaaccgaatgtaaattaattgataaatgaataaacgaactgtggtatatccgtacaatgaaatactattcagccataaaaaaactaagtacaaacaagcatacaatacggtgtaccttgaaaatacactaagtgaataacaccagacacaaaaggccgcatattttattattttacttatacaaaatgtccagaataaggcaaattcatacagacagaaataaagtagcagctgccatgggctcgatgaagaagaatgaaaggaatatagcaggtttgaaaaatggcccccaaaatatcaggtcctaatcccttaagcctgtaaatgataccttatttggaaaaaggatctttgcagatgggaaaattatcctggactatacaggtgggccctaaatgccaccacaaatgtccttgtaagagaagcagagggagatttcacacatactctaggaaaaggtgatgtgaagacagaagcaaagattagagtgacatggtcacaagccaaagaacgtcacatccacaaactagaagatgcaaagaatggattctccgctagagtttcccaggggaggacagccctgccaacatcttgatttaggtcttgtgaaacttattttagacttctgacctcccgaactaagggagaataaatttttgttgttttatgccaccaagtttgtgataatttgttatagcagctatggaaaagtaatatagggagtgactgctaatggatacaaggtttctttagagttgatgaaatgtcttggaattagatattgctgatggttgtacaattttgtaagtatataatactaaaaaccattcaatttcacaccgcaaagggtgaattttatggcatatgaactatatttcaaagaaaaacaaatgcctagtaacaggctggtataacccgccatctcccaacaactgctgctaaattttcaaagcaccattaagcagactcaattcgtagcaaggataatggaacaatgcaagctcatctagcgaacaaaaagaattaagctagtatcaggtggtcaatttacaaactgtagtgggagtcatacattcccaaggatggaacagttatatctccttgcagagtgaactcttctccgataccaaggacttggaagaccaaataaattatacgtaggattaccaaatatgctggtatgaccaagacagttatagtttaaacttctatctctgtggaattatggatagtgccactcttcaatctttaataagtccttcagtttagatgataaattacatagtcaacctagttataaggaatctagaggttgtgaaaagctgtgagagcatattctatgcagaccacataggtcctatcatgactccctatgtaacttgggtctctgcgactgggaagctcccagggaaaaaaccccagttaagacttctgcagagcattcacattttgtttcaaacttatacaacactaatgctaaagctcaactctcagaattgtattattcagtattatccaaataactgattaatttacacactgaagggaaagaacaaggaatggacctatacacacttgtagtttacaagtataagaagctaacaaagaataagattaaaataacttgtgccaggccgggcatggtggctcacgcctgtaatcccagcactttgggaggctgaggcaggtggctcacgaggccaggagtttcagaccagcctgaacaacatggtgaaaccccatctctactaaaaatacaaaaacttagctgagcgtggtggcacacgcctgtaatcccagctactcaggaggcaggagaattgcttgaacccgggaggcagaggttgcagtgagctgagattgtgccactgcactccggcctggacaacacagcaagactccgtctgaaaaaaaaaaaaaaaaaaaaacaaacaacttgtgcccacattaactaggtgttaaaagccaaaaggtgaaagtcactattctcttttcacatatcaaattgaccctaaggtaatattgctgcattagaactgagctggtgggagggatgttaagaaattagggagaaattgttaatctacagaaagaccatcatataaggttctgtgtgtagccaaacatacacatttgatgttctgatgtttgctattttagtggaactatagctataaaatgtattcaatcagtagaattaaaacatatcccagtccacaaaaaactaagagagaaattatacaggaatgatcaagaatctgcacagttctcataatctcattactagagagaaaaggagaaagggaagcatcaaggtagtatttgagacgaatttaagaagaccactcattcaataaaagtttggtgggccaacaaggtgccatgtattggtctggtgatatagcagtgatccaaagtctttcacttcagggagctgacattccagaaggagtagtcagaaaataatttttttaacaaaagtaacatggttatataaacactagggagaaaaataaagtaggaaatggaggcaggttgatactcacataacatgaatatggctgtctggggaagaatactccaacaaagggaacagcaaacacaaagcctctgagactggagcacttaacacatgcaaggactgatcaataggctaacacaggtggaccaatgaaaagagtgacaagttagaaatgagataaaaaatgagctgtttgtggcaaaggaaagccaagatcatgtaggccattctaaattcttcagctttggccaggtgtggtggctcacatctgtaatcccaacactttgggaggccgaggcgggtggatcacctgaggtcagaagttcgagaccggcctggccaacatggtgaaaccccatctctactaaaaatacaaaacgtagccaagtgtgctggcatgtgcctgtagtcccagctactcgggaggctgaggcaggagaattgcttgaacccagaagacagaggctgcggtgtgctgagatcatgccactgcactccagcctgggtggcagagcaagactccatctcaaaaaaataaataaaaataaaaataaaaataaaataataataatacaaaaattagctgggtgtggtggcgggcacctgtaatcccagctacttgggaggctgaggaggagaatcacttgaacccaggaagcagaggttgcagtgagccgagactgcgccattgcactccagcctgggtgacagagcgaaactccatctcaaaaaataagtacataaatagacaaaaaataaaaacaaattcttcagcttttaccctgagtgtgatgagagattactggaaggctctgagtgagaagtaatatgatctcactcatttcattaggattgctgtggttactgtgtggagaatagactttagagagtaatagtggaagcagaagacaagaagctactgaaatattataaacaaaagatgatggtagtatcagacaggatggagaaatagagatactaagaagtcggactctagataaaaatctagaaggcccaattcattgatggattgggtttgggatgtgaaggagaggaggaggacacacaagaggtaatgctgagcaggtaaatctatgagatcagagcccaaggaaagttccgaggtaggtacttaaattttgaagtcttcagtatgtagcattatttaaaacacaagactggatgagatcactcagggaaaagaggtctgagatctaagctctggggcattccattgattagaggtcatggagatgagaaggagctggtaaaggaaattaaaaaaaaaacaattattcacagccattcaggtgggaggagaattgagaaagagaagcatcccagaatccaatggggaggagaaaaggaactgtaatatatgctgccaatagatcaaataaaatcacgaaaatcaactaaaactgaccaatggattaagcaaagtggaattcattggtgaccttgacagcagtgggtttaaggaagaacgagaacaggagatagcaaatacggacaactctggagaaattttcctgtaaggacaagcaaatacaaattaaaacaagcagatgggagatgtggcatcaaaaacgagatctttaaggtgaggtgatggtacaatcagtatgtttgctatattaatgatctggagagatagaaaacttaaccctagacaaagagaagtcttgctagaataatatccttaaataaacaagtgcacatgtagaggttctggccttagcaagaagtcaaattattcacccagagtaacaggacaatgctttgagatcctatggaaaagggttaaatggtggataaatggttgcggtggccatcctccaagatggccctaaatgaatcccacttcctggaattcacatagttgtagccctctcccactaacagggttggcctgtgggatcaagcacatacagcaggaagtgatggtatgccacttcagaaattaggtcataaagactctgcccttcatcttgggtacaaggtctcttgaatcatttgctctgaagtaagccagctgctgtgacatgaacagccccatggagaggcccacagagcaaggaactgaggcctcttgccaacagcccagtgagtgagcttagaggcagatgatccaaaccaagtcaattccgcagagactgacaatccagccaaaggtttcactgaaacctcatgagtgaccttgagccagaaacagccagctaagccactcttggattccagaccttcaaaaactatgaggtaataaatttttttttaaactactaagttttgagacaatttgttacacggcaatagataactaatacaatgggtctcactgagctgtaatcacaaattgctgggcacacaattcactataatctcacctactggcatgcaatgacttcagatgacctcccctgtcctgctgcatgcagttacctcatgaaatacagtcgctgagaaagagggtaggataaaaggagtcagctttatataacttaacatccctgatgctcttttttttttttcaagagatgtggtaaaagaatgccactaccaccctctcctttctcaacaaagcaatttagagggttcccgaatgacctacatcaacaattggcctgaactaatcaaacgcatcattcagattccctcagtaaaatattgaataccaaacagctatgcttcagcaaaggaaagggcaagggagcgaaactgaaggacgaaaatacaactttggtcctcatcagggagacttctcttttcttacctcaggtttattacaacgcaacttttaagaacttgagctattccaggcagaaggtcacatccttgaggtaaccagagagaagcattagttacttacatgtcacaagaatattttcgatcccactgcctgacattgccatttaggtgtttatcaatcatctcacacttaaccagataagtgaactgaactcctttcccccagatctgttcctccaatctaccctaccttagcaaaggaaaacgtcccacccgccaactgcccaaatcaaaagcctgcaaatcacccgaggtcctggctctcacgggagggactccattagggtcccaggggctgcattaagagtcccgacagcgacgcagtaaatgagacaagacgctgcggtaggggagagagacccatacattcaaatgccttaaggggtctgggcctacaggtctccagaactggggagggcctggggttacaaagcagttttcagatttttaaatacattgagcgccaaaagagaccccgcgggggcgatgggggaggggagcgcactgggagccaggaaaggccccttctccaggaggcccgggcccagcccgggggtgggggcgtctgcgtgagggagtggaggctgatgtaaaagtggcgcccgctgagattagggaagggggtgtgcgtgaggggatcgtgggacctggttctgccctgcactcccccacagaaagcggctgtattgcaaaggccgctccggcagcgcacggccaagcgcggtgtcgcgacccgcagggctgcggctcgccatgaaatccctcaagtctcccctcagggaacgctgaagccgcgccacgcccccgtccttaccagtccggatcagctgctgttcgcgagctgccggccacgcaccagccccggaggcgctcccggggcacagccggcggcgactacgcctcctcaggcccccggcgccgccgacgcgcacgcctccacacgcgcgcgtccagtggagacctgcgattggctgccaggtgccggcgcgagatcggcgcggctccgagctaggagcatgcgcgcgctctgacgcccctggtggcgacggctggacgcggggttaaattgagaaggaggagggcagcagcaatacccctgaggccttgaaaggatcttgggttccggatcacggttccaggcagtcagggttccagagctgagggggtatccaagcagtcagggttccagagctgaggagcatccaggcagtcagggttccagagctgaggggcacccaggcagtcagggttccagagctgtcgcagccagggcttggggtggggggtaggcttccagtccatcaggggatggtttgcccaccagaaggccagctgttataattctcaggtgtggtccctttgttgactatccatgcttaagggattgtgaggaaacaactgaacctaacatctgtcctcttctagttacatctggggccagttgaatccagcctgccacctgtttttgtacagctggcagcaagctaagaaccgatttcacgtttttttaatggctaaaaagagaatattttgtggcatgtgaaaattatatgaaattcaaaattcagtgtccataaataaagttttattggaacaacaaacatgcccattcctttcggtattatttatgcctgttttcctgcttcaacagcaaagttgattaattgccagagaccatgtatgaaaagcttaaaatatttactgtctggccctttacagaaagtttgcccactcagtttacttgcagctttgattttttttttgaattgaccaattctgccaaaagtctattttagcaatctttttggggggcgggtaaatcgcttttggtttaattaatctataatgttattttcttatctattttatctatttcttccattctgttattttcttccttcgtgacttcataggcttgttctgttacttctcattacaacttttggagaaaaatgcctacctcgtttgcttgtaaacttttttgtttctcttgtatttaatgctataaatttacctttaagtaccagtttaactgtgtctcaccagtccgcttggtaatatgttcattatccttcaattagatatgtcctaattttgctagttgttagaaatgcttgttccctggtgccgcaaagaaatagcacttgaacataaatttaattttctcagcaaggccattttcactttctgcagaaagggtacactcgccagcagttttgccacgagagtaccccaaacaaaggatacagggttatttataacctgacgcatccaccctactgctgtgtccggtttccattggctggaacaggacctcacattctgtgtttgtcccgattggctaacaacttagaactttctaaaagaggcaaaggcagaggagaacaaaggaaggaggatgtaacttgtagaatgctgagaaaggtaaaaacacctccaaataggaagaggaacaggctatgacctaatgcttgcttggaccagtataagcatgcaagggcaaatatttaggctaaattgtgggagctaagaacacaaagtatattaatttctttattacggctagcagatatctaagaatgttagcacaggtctttgaataaattttacttctaagagaagttactatttattcgtaattagacagggaggaaagtctttgaagaggaacctctactttattttttacatagtgattctttctaacacaagggttatatagtatatgttatttatttttgaaatctatgagatttttaaaagattttttaattgtattataatcaaatcacatggcctaaatattactcacccttgcatttgaagatttctgttcagtgaagtgtaccatagtcaaaatgaagagatcatagatgtaaagaagatatttgcagtatctaaaatgtatatatgaggctgatatgtaaagatatttgcattatctaaaatgtatatatgaggctgatatgtaaagaagatatttgcaatatctaaaatgtacgtaagaggcctggcacggtggctcacacctgtaatcccagcatttttggagaccaaggcaggcagatcacttgaggtcaggagttcaagaccagcctggccaacatggtgaaaccccatttttgtacaaaaaatacaaaaattagctgggtgtggtggcacgcgcctgtagtcctagctactcgggaggctgaggcatgagaactgtttgaacctgggaggcagaggttgcagtgagctgagattgcaccactgtactccagccttgggcaacagagcgagactccgtctcaaaaaataataacatgaaaaataaatctatgagaaatgatcttcttttggcttcataataattccaatgtccatcagtaaattagtatcaactaagctccaggctttattcaaatgtcactagtttttcccatcatcctttttgttccagattcccacccaggatactgaattgtacttggtcattttgtgttcttagccttctgtggtctgtgacagtttcttaaacttttcttgcttttcatgaccttgacaattttaagaagtaaaggtcaggtatttttcagagtgtctctcaatttaggtttgatgtttttctcatggttacactggggttatggtttttagaagactatcacagacatgatgtgtctttctcataatttctcatcagcgatccatgctatcaataagacttcctactggcttctccgctgtaaattacttcccccccctttcataccttattctaaatcttgcctacatgcaggaaggccgtgaggtctcattgaaggaaaattatctacacaagttactttgcaattcttctttaaggaagatttgtctcttcttcctttagttttaaattaatcaaaaatagctttttagttttaaattaatcaaaaataaaataaaaaatttagtacctcagtcatacttgccacatttcaacagatcaatagtcacctgtagcatattggacagagcagaagtagagcattttcatcattgcagaaagatctacggacagcactgacttagatcattagtcaacctttcttcttcccaaatatatgcatttagaaatataaattcccatgaaatgctttagttccatcccataaattttgtggctgttttcaatatctttcagttcaacattttccttttttcactgcaatttcttagaggagctatgggttattcagaatgaggaccaggactggggtgagataagcaaggaggctgaggcacattaaggagagacccacgcccagcttcaggtatggcatattgtcaccttaggttccctgcttgcctcaccctagtcccagccctgtttagaaatgtattgcctaatttaggaactttgggttttttttcagtgatctttctgttactgatttgtaagttgattcccgtgtactcagtgggtaactacaaagagccccacagctaacatcacaattaaagtaaactattctacctgagtttgagaccaagaaaagcacacccatgaaagccacttcaattcgcaaagcatttggaatagccaaggcaattttgaacaccaaagttggagaaatgaaactaccacatggaggattatgcaaagctacaataattaagatactgcagcattagcacaaggatagagaacaggacaaatgaaatgaaatagattccagaaacacatatatacaatcatacctgattcacacagtttccacggcaatacagtagggaaggagtggtctttttagtaagtggtgctgattgattttgggtatgtatatgaaaaaattagtcttcatgccttatcacaccattaacaaaaaatcagtttgagatgtctcatcaaaacagtaaagcttctagaacatagaaggaatatctttatgtcgtttgtagacaatttcttaaataagactcatgaaagataaaccataaaaccacgatttagatccaaatatgggacatttccagtgccccagcacccttcccagtcgacagcccagtttttaaaaaggtaggagggggcaaaacttgaatagacatttaataaaaagaaatactcacgtggccgataactatataatctcaaggtccattaatcctcagggaaatgcaaattaaagccacaataaggtaccactacaatttcaagagaagggcacttactaaaaggactgacagtaccaagtgctggatcagtagcagtggaattcgcagtatcggtggtgggaatgtaaatcgtttcaatcactctggaaatgtatttggcagtatctacactagacagctaaatatatgcagttccagcacttctcatagctatatacacccacgagaaatgattacatgcttaccaaaagacacgcacaagctcatagcagctttattcaaaattgccaaagaatcagcctcaaagtccatcaacagtgaaataaatttatacaaaactgccacagtcactcaacaaaattctacccagcaatgaaaaagaatgtgctactgctacacacagcgaaaatgcatctcacttattttatttcattttactttattttgagacagtcatgctctgtcacccaggctggagggcagtggcgcgatctcagctcagtgcaaactccccctcccaggttcaagcgattctcctgcctcagcctcccgagtagctgggactacaggcgcccaccaccacgcttggctaatttttctattttatgcagagaaggggtttcactatgttggccagcctggtctcaaacttctgacgccaagtgatccacccacctcagtctcccaaagtgctgggattacaggcatgagccatcacgcccagccatctcacttattttaaaaagccaaagacaagaatctttgtgtgattccatttatttaaagttcataaacaagaaaaacctctgaggtcagaataagggatgccttgttgggagcatttgactgggaaagggctcaaagactttggagctacttcttgacaatagggagctgatgagatgtcactgtgaaaaacaacctgacagttgatgacattgcttgctagcatctacagccacaatgcacatatggcctagcctcacttctgcctttcggaactcctggaagtcagtcgaacatattttcagctagaatccttgctgcaagggagtctggaatctctagtgttcatagccgtcttctttttagtttttacaggagaagactgagggtcagtgttgctaacaataacggaagccataccacttgatcctggctgaactgaagtttgaataataacttttgtttcacgagggaacccttgcagttgctccggctttttaaatgtttgatggtccttggttttgtgctctatttcctccttcaacgtcaaaaactgtagccggcacttggaacactgaaggaccctccttctgctgtgcctccaacaatgattcatgtatggtattgcagttttgaaaagtttgagacaaaacagacaaagcaaattctttgtgttttcatggcacgttctaaaatgtgtttccacatcagcaaagaccgacgatctgtaatggcaaacctggcacacgtagggcatttcgccaggcttatgatggtccttcatgtgttgtaagaggacctgatctgtttcaaatgacaattcacagattttacagacagcagagggccccatggcgatgtgtacactatcaatgtgacactgtagctggaagggagtgggaaactgccggtggcagtgctggcaggtggtgtggtcttcccagctgtcgttcctctgcttctcaaattccaaatgatgcttcatgtgattcataaacttaatattttttagaactttcacgcagctgaggcatttaaaggtggtgtgagtcttctgttccggctgcccatctcctttatgctgtccatagtaaaagttgctaagtaacacgatgggattttctttcttgggatcaaaggtcttgttttgacttgctagacttgaaatgtctgtcattgccaggccagactcatttgctctctctggatctgtaagattgaaatgtgcctttccattagcatcaggccaaggaaatgttactccattctgaacatggtttgatgagttgcagatcccctgtgagggtgtatttgtgcttattgtagaagacatatctgaagggaccacagctaaagaaggtacccctgggattccatccctgagtttaacccttttggaatctctgctgtttatatctgaagtggaaagtcgctttgaatcaggagaactctcatttctgcctcctccagagaccatagctccaactagacactgagtccctggggggagcgaatctgagtaattgggagaaacaacttgtggtgagctcattttataaccaggttcagatgaagacttcatagtgacaggactatctgtcgatcgcccctcagacagagaaacgggcatgatggcttttgccatagaggtcacatgatttgcaggctgcgacacgtgagcaggatattgacggaagtggcctttctttcttcttgactttgagcctggggtgactctgttcaaaatgtttgaaacgactggttttgaatttgaaatcatcccgacaaagagaacttcagcatctctatgtacatgctccaccccaacatagatcagatctggatcttcatcatcctcctccctttgtttggattctctcaaattcttctttggtgattccactttcttacacaaaaagatatctcccattttcaatttactttttgcttgaagccactggtctcttcaacttccagagctgtctttttacaaattgccacctaagtgcaaccatgtgacaatagtcaatatttatttcgaaagacaaaatcattactttattgtatcctcccttaaaacactgagataaccatcaacatctctattttacacgtcagaaatgaggcttgaaacattttaaatggcataataatttcaaatttacctgtctctcctcccctggtcttctgcagttgtgaggcaaaggaagcaagatttcaggaggtgcagatggaacatctcagagtgcttgcctctaaattttgcactctagatgcctcactcacctcctcctcatcccacaggtactctctcagatgtctaaggtttctaaccaacttgaacaaaacttctctcaaaaacattctgctcctagcctgggcaacatagcaagaccccatctctacaaaaaaatttaaaaattaaaaaaaattagcttggcatggtggtacacacctgtggtcccagctacttgggaggctgagccaagaggaacacttgagcccaggacttcaaagttatgttcatgccactgcactccagcctgggcaaccaaatgagaccccatcacacaaacacacacacacacaaatcacaacacacacacacacacacacacacacacacaccctttgctgttcctgtaatgttccttttctcagtaaactcagttgctcagtctacaaacttcagagtcatcctttgccagactttctctcatacactacagccaatcaattagcaaagctagtctgctctatcttttaaagatatccagaatctgactactctcttccacatctactgccacctccctgatggaaggtaccatgttctctccctggatcactgcagaagttgccagtcttaaaagttttgtcagatctccccatggtggccccaatgcccctgttaaaatatacaggggagcaagtatattttgctcttaagtcttcaatgactttccatttcattcataggaaataccagcaaactttaaatttctccatggaaccttaggtcatcatcgcccttgctaactcctctgttgctctgatgcagccatcctgagctccgtgaatctggaacacaccaggcctttttctttttcagaacttttgttgttcccggacattgcgtgcctctttccccagattaaccccatctgggctcctggtctgcctcagtcccatggttcctcttcagcaaggcttacctgaccacaatatcaaaaatcacaacctccttaactcatatgttcaaaccctcaatgttatttttcaacttagcatttatcactgcctaccacacaatatgtaaaatatatcttgcaagcccaggagtttgagattacagtgagctgtatcatgtcactgcatccagcctgggtgacagaggaaaggaagactctgtgtcttaaaacaacaacaaaaaatgggacaggtgcagtggctcgtacctgtaatcccaacactttgtaaggccaaggcgggaggattgcttgaggtcaggagctcgagaccagcctgggcaacatagcaagacccatctctacaaaaaatttaaaaatataacttgtttcttttctgtgtttacccactaaactgtatgccacatgagggcagggagttgtgtttcatttactcctcagcttatagagcaatgtctgtcatactgtgcatgctaaatctttgttaaataaatagtagctgttattaatatgatcatttaggtgtaccagaggctctaatccattattccagattctctaagcatttaatgaaatccaaatccaaatgatttaatactgttgtacaagggagaaggtaaacctgtgtgtatgtgtgtgtaaattgaaacaaaagttttgtcaaatactctaataccttcaccttaccgcaagggataggctctgataccttctatgccatattttattgattctaaggtataggcttagatttccattttaacatctctaaatcagattgcatctcatcatagcatctcatcaatataaaatacatttcacaatttgtttttgcagtatatatttttatttcatagtggaatcaaaaatgacatatctcagatccttttgtgaggataagcgtgatgcttgggttttcactcatgtgagatgtgcttccctcaaaccttgttatatcagcatgtttaacatctgatgtaaaaaaaaaaaaaaaaaaaggagagtaatgtatcttttataattgatggcatctttttttttttttttttgagatggagtctcgctctgtcgcccaggctggagtgcagtggcgcgatctcggctcactgcaggctccgccccgcggggttcacgccattctcctgcctcagtctcccgcgtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcatgagccactgtgcccggccaattgatggcatcttatagtcagtgaaaaatcctatttctttttgtaagctgacagcccactaaacttgttttgtagttctctaatggatatcacctacattttggcaaacaatggtttaagacagaaattggaaaattggcccttcccctgtttttgtacagtcaggaagccaagaatgtttcttacatttttaaggtattgttttcttactttttttttattaagatttttttaaacttgtacatttttagatttgggggaataaacacgcaaaaggaagcggggcgcggtggctcacgcctgtaatcccagcacttttgggaggccgaggtgggcggatcacttgagctcaggagttcgagaccagcctggccaacatggtgaaaccccttctctactaaaaatacaaaaattagccaggcatggtagcagatgcctgtagtcccagctactagggaggctgaggcaggagaatctcttgaacctgggaggtggaggttgcagtgagcgaagatcgcaccactgtgctccagcctgggtgacagagtgagactgtctcaaaaaaaaaaaaaaaaagaaaaaaggaatattttgtgatgtgaaaattatataacattcaaaatgtcagtgttcactataaagtgttgtggaacacagccataatcatttttttagtgctgttgtccatggctgctttcacacttctatgacacagttgagtacagtagtacccccttatctttggggcatatgttccaagacccccgaagtggatgcttgaaactgcagatggaaccaaattcaatatatactatattttttcatatatgtacatacctatgatcaagcttaatttataaataggcacagtaagaggttaagcataacaaaataattataacaatatactgtaataaaagatatgtgagatagtgcgtggtggctcatgcctgtaacctcagcactttgggaggctgaggtgggtggatcacctgaggtcaggagtttgagaccagcctggccaacatggtgaaacccatctctactaaaaatacaaaaattatctgggcatagtggcgagcacctgtaatctcagccacttgggaggctgaggcaggagaatcacttgaacccgggaggcgtgggttgcagtgagccgagatcgcgccgtggcactccagcctgggcggccagagtgaaactccgtttcaaaaaaataaattaataaattaaattaaaggtatgtgaatgcaatctctcgctgacaaaatatctttatgtactgtagatcttggcaaccttagcatacgattttgttttctttccttattatgttaaaaactttcccattttcacttaaaggaagcaagcactttacagcttctttttggcatatttcaatcgccagcattgctacccttgtactttggggccattattaagtaccataagggttaattgaacacaagcactgagataccaccaggacagtcactctgataactgcgaccgctcctaagtgactaaggtacagagagcgcagccagccaacagcatggggactcaggacaaagggaggattaccatcccagggcagggctgactcaagagcttatcacactactcagaagggctggcgacttaaaatttatgtattgcctatttctggaattttccaattaatattttggaacctcaggtaactgaaagcacagaaaggaaaaccctggataagggaagactactgtagttggagcagagaattgcaatacctaaaatatttgccatctagtctttcacagaacaagtttgccagctctagttttagaggagcaaaatgaaagatagcaaatttctcagctcaccagttcctaaagttgcgagtgcatccagatgattcagtgcagctcagtatgttccactctgggccacaagggaaagcgaagctggagcttccttgtctccacctccgggagaaatttgtccagagaccggcagcactgcttccgcaggcgaacaacgccgcttgctcttcaaagtcctttctgaggccagatcagaaggtcccactccttttaagccccttattgcccaatcatttttccagtcacgtgtctgaagcagtttatcctgattggattttcagttgttgtccagcttgattgccaaaagttttcctccaattgctactcaaaggaaagaatgagggtggggcttcagggctgctttccaggttgattgagctgctgatgggcatcctccctcctctctctcttgttcagagtctaccactttctctgcagtgtgcctgggccctcagctattggggatgagaagggatgcggagtgggaggcagtccacatgtctgttccaacaaagctcagaggtgagcgagttaaaaagcagatgtctttccagtaggagccccaggggacagggtgggtctcacagcccttgaagaccgagctcccgtaggagtttccaggtgtccaaacagggtcctcactgtgagtcttcaacagctttctccaagcagcagcccactcccttcttaatccatttccaggggtcaaaggtctatcctggttccctcccatgccctctcacttccttccctctgtctctccctcctccctcctccttcactaccccctccctggaaccttctcagctgaatttcaggcccaccctttcactctctttacaggctttgcaacacagattagaaagcgggggagggggagcctcaagagtcccttgacaggtaagaaatatttatatttccacccccattccaacgcaatgcaatcaagtctcaaaattaaaacgaaaatcatttgcaaattaaaatgttctaaagtaccatctcctgataaaactttaaaaatacctttctgggccggatgtggtgactcacatctgtaatcccagcacttttgaaggccgaggcagcagatcacatgagcccattagtttgagaccagcctggccaacatgatgaaaacctgtctcttattctttataaagtaaaatacaaaaatttcctgggcgtggccgtgcgtgcctgtaatcccaggtactcgggaggctgaggcagaataatcacttgaacccagtaggcagagcccaaggtggtataaaagtgtgtgacccatggtctttattcttgtctagggactggggaaaggctgcttgagggcattgcaagtagccaagagcatgcccctggaaaggaaggtgaaatgaggcccgctactgaggtacacctgtagtcccagctatcaaaggctgaggtgaaagatctttgagcccaggaaatccagacaaacctcagcaaaatatcaagacctctgtttctacaaaagaaaaaaaaaatttttttaattagccaggcattgtagcacgtgcctgtagtcccagctacccgggaggctgaggtgggaggattgcttgaaccagggagatcgaggttgcagtgaactatgattgcatcacatactttagcctggatggaagagagagaccttgtctcattcattcattcataaataaataagcaagcaaagtgaaatgaagtgcaagacttagacagtaaagttctaacaggggccgggcgtggtggctcacgcctgtaatcccagcgcttaggcagaggcaggcaggtggcttgagcccaggagtttgagattagcctgggcaacctggcaaaaccgtgtctccacaagaaaatacaaaaaattagcctgggtgacagagtgaaaccctgtctcaaaaaaataaaaaaagaaaaaagaaaggaagacagagaaagaaagaagtaaagaaagagaaaaaaaggaaggaaagaaaggaaaggaaatgtgtattctgcagaactgatattcactccttcctcttttccagaagcagaatcctgctaggaagattccaggaagcctaggcagtggtcaggggctggctcaggtataaagcaggcccttcccctgagacagaaggttgtggcaacaatgcttgtgggaggtgagaaaattgagaggagtgtctagaaatagctcggagttgcatcttattttcttttgctcagttttaaaagtcccaaataagaccacatctagctgttctaaccaagctattctaacccactaatctagtaaaaataaaatcacatggtctgaatataaatttgcatcaggatacatgcctttcctatgaaacatttatgtttccttataaaatgtatcctccttttctgcagaaaactaactgtaatgcatccaaaggtcacagaatgtggtgaaacatcctcatcattgatttttaaaaaaatttttatttatttatttatttgttttttgagacatggtctcacattctgttgcccaggctggagtgcagtggaacgatcatgcagtcttgatgtcctggacccgagcgatcctcccacctcagtctcccaagtagccaggacaataggcagatgccaccatgtctaactgatttatttttatttttgagtagagatgaggtctcactatgttgcctgaactggtctcaagctcctgagctcaagcaaacttcccacctcggcctcccaaagttctgggattacaggcgtgaactacccgcaccctgccctccataactgattcttttttttcagacttcactctgttggccaggctggagtacagtggcgtgatctctgctcactgcaacctccgtctcccaggctcaagcagttctcgtgcctcagcctctcaagtagctgggattacaggcatgagccaacacgcccggctaatgtttgtatttttagtagagacagggtttcaccatgttggccaggctggtcttgaactcctgatctcaggtaatctgcccacctcggcctcccaaagtgctaggattaaaggcgtgagccaccacgcccagccatagctgattctttatcagtctgcctttgggaagtttccactgggaaacactctccaggactgtttcggaccagccccactttccaaacaaagaattccagtgatgagattaaagcttgtcacaatatgtttttcaaatgactggtagaagcagaccttaagattaaaaaagaagaagaaaaaatggctgaaatcttgaatcctttattgctttaaggcacagaataggaaatggatggcgcgtcgggaatggatgcaggtcagggacagaccatcactcatgccaccttgctgtgtttatgaaacagagtgctagaagttaaatttgggggatgcacaaagagatgcctaatcagatgaactcagagttggaattgctgtttgtgagacagttacatcaaaggaagaaaagaaggagagaagaaaggtgactatcaggagaattttccagccagaagaaagacacagaggcacaggcatttcatggcctgaaaaaggaagagcacagagacaagtgtggctccagttaaaggaccagcggagatgaaagatgaggtcagtgatttgggtaggggacatagcagttaagatattgttggtcaaggctgggcgtggtggctcacgcctgttaatcccagcactttggcaggccaaggcgggtgaatcacgaggttaggagatcaagagcatcctggctaacacagtgaaactccgtctctactaaaaatacaaaaaaattagccgggcgtggtggcgggcgcctgtagtcccagctacttgggaggctgaggcaggagaatggtgcaaacccaggaggcggagcttgcagtgagccaaggttgcaccatagcactccaacctgggtgacagagtgagacccagcctcaaaatactactactactaataataataataataaaaacaaaacaaactaaaacactcaggagagattagtggtctaaaagcatatttttacaatgtattcagggttattccattgtttcttaaaaactacctttgggagcatctccccaaacttagtttggaagtgttttttctgggttgcaataaacaagcaaacaaaaaactaccttttaattaaaagtaatccttaaatagagctaacaataaaatcaaacacacaaaaaaattatccattttaaaattttttttatatgaagtcttgctctgttgcccacccaggctggagtgcaatggtgccatctcggctcactgcaaccttcaccccccgggttcaagcaattctctcacctctgcctcccaagtagctgggactacagtcacgtgcgagcacacccagctcatttttgtatttttagtagagacagggtttcacaatgttggccaggttggtcttgaactcctgacttcaagtgatcccctgcctcagcctcccgaggtgctgtgattacaggcgtgagacaccgcacccggccaaaattcatccattaattgtaaagtaaatttcccttctgccccagatcacagttacctgtctctattcccaaaataaatggctgtgtagaatttctgatgtgtccttcaatatatattctctgcatctacatacacttaccttcccctacctttttatgtaaatgggtgtttattattcacatactccgtattaaaattgtgatttattaacataattttactgacattttaatttgaatggagataaatttataaaggggattgatgattaagattttatgtttaaatattcggaagcaaacagtaatgcatcttatcttctgagtaggatgtgggttgaaactgcaaaggcaagcatgagatgtttcattaacacaaagccttgagtgctccaaacccaaaagtcaaagcaacttatcaataaatgccaaaggatgctattctgacatatctgtgtgctgtggtttgaatgcagactccaaatctcatgtgtgggaaacttaatttccaatgtgggactattgaaaggtggggcctttaagaggtgattgaatcatgagggctctgccttcatgaatgaattaatccattcgtggattaatgggttgatgggttaatggcttatcatggaaggggagctggtggctttataagaagagaagagagacctgagccaacatgctcagcctccttcatgagatgccctctgcggcatcaggatgctgcagagacccccaaccaggtaagaaggcttttaccaggcatgccccctccactttgggcttcccagcctccataactgtgagaaattcattttctttataaactacccagtttcagatattttgttgtaagcaacagacaacggactaagacactgtgttatctaattatgtgattcttgttttactatttatttatttagccacttgtcagaaaaatttttttttttttgagataaagtctcactctgtcacccagactggagtgcagtgctgctctcatggctcactgctgcctcgaactccctggctcaaacgatcctcccaccttagtttttcaagtagctgggactactacaggtgtgcgccaccatgactggctactacttttttttttttaatattgcccaggctggtctcaaactcctggcctcaaaagatcctcttgcctcagcctcccaaagtgctggcattgtaggtgtgagccaccacacccagcccaccaaaagttttttcagacatgtacctgagtgattaagagtttaggattggctgggcacggtggctcacgcctataatcccagcagtttgggaggccaagacgggcagatcctgaggtcaggagttcaagaccagcctgaacaacatggagaaaccccatctctactaaaaatacaaaatttgccaggtgtggtggcacatgcctgtaatcccagctacttgggaagtctgaggcaggagaatcgcttgaacccgcaagggagaggttgcggtgagccgagatcgtgccattgcactccagcctgggcaacaggcaacaagagtaaaactctgtctcaaaaaaaaaaaaaaaaaaagagtttaggatctatattcgctctgcctgggtccaaatcctggatgttattaactgtatgactttgggcaagtttattaacacctccattttaaaaaaatctgtactaggaatataataataaatgcataccctctcaggatttgattaaatggaataaaatatatagaattcctagaacagtgccaggagtttgaggccagcctgggcaacatagtgagaccccatctgtacaaaaaatacataaaaaatgaggggggaatagcggtgcacacctgtggactcagctacttgataggctgagatgggaggattgcttgagcccgggggccaaagctgcagcagtgcagtgactgcgtcccagtaatcccagcactttgggagggcaaggcaggaggatcccttgaggccaggagttcaagaccagcctgtgcaacataaagagactccatctgtacaacaacaacaaaaattcttacgcacttagtatttgccagatataatgccaatttctagggcacaaaggcaaatggtaactacctccctggattgttgtaaaaataaagcatgcaaaacattttgtgcccccaatgatcccttcctcatggtgtccccacacttttattttgtgctgtcacaatgagcagggcaccaccaggatactgggaaataatgacgtgtgatttccaagaccaggtcacaaaaaacattttgccttgccctcttgaatcacctgctctggtggaaaccagacaactgttatttatgtcatagcattcaagcggccctatggagaggtccatgtggtaaggaactgaggcttcctgccaacagccaagtgaaagagccatcttggaagaggatccgcctcccaagttggccaagccaacattttgagtataacctcataagagtctctgagccagaaccacacagctaagctgcagtaactttgaagtaataatgatttattgttgttaagccactaagttttgggataatttgttatgtagtaatagatagctaatacagttgtgcttattacgtttggtactcgttactatcaccaccacatcagtgcattgtagaaaacaaattctatgtattaaactgttttgtttcccctctggattaagctgggctcacaaggggaaaggtgcccaccagagtttttttcttttttatgtaatcaagtttttaaaattttattctattctactttatttttttaagttccagggtacatgttcaggatatgcaggtttgttatgtaagtaaacatgtgccatgatggtttgctgcaactatcaactcatcacctaagtattaagcccaatatgcattagctctttttcataacgctctacctccctcctaccctcccgtaaaaggccccagtgtgtgttgttcccctccctgtatccatgtgttctcattgttaagctctccacttataagtgagaacatctggtgtctggttttctgttcctgcattagtttgctgaggataatggcttccagcttatggatgtatagtattccatggtgtgtatgtaccagattttcttttttcttttctttttttttttttttttttgagacggagtctcactctgtcgcccagctggagtacagtggcatgatctctgctcactgcaacctccgcctcccgggttcaagcgattctcctgcctcagcctcccgagtagctgggattacaggcgcataccaccacgcctggctagttttttgtgtttttagtagagacggggtttcaccgtattagccaggatggtctcaatctccttacctcaggtgatctgcccgcctcggcctcccaaagtgttgggattacaggcgtgagtcactgcgcctggtcagtaccacattttctttaaccagcctgtcgatggaaatttgggttgattccatgtctttgctactgtgactagtgctgcaatgaacatacacaaaattatctgaatgattgcagtaaacatcatatatttgtttgccagctaccataataaaataccatagattgggtggcttaaccaacagaaatttattttcccacaattctggaggctggaagtccaagatcaaggtgttggcagggttggtttcttctgaggccttggcttgcaagatggccaccttcttgctatatctttacatgatcattcctctgtgcgtgttcgtgtcctaattttttcttcttataaggacaccagtcattttggattagggctctttcatatgacttcattttaatcttaactgcttctttaaaagccctatctggaaataaagtcacattctgaggttactgggggatagaattacaacaaatgaattttgggaggacacaaatcagcccataacacatcattgccagcatcacatgtggagcattcaactggagaaactgccctaatttctcatttgaaggtctaaacatctcttttatcaaaataagccaggttctattaagaaggctgaatgtgcatctggctcgatcaacaggcgtctggctgcttcaaatgcttgatttttttcattctcagagaatgaaatcaatgttgaaatattgagtatattctatacaaaatcttcatgtcacaatgaataagaaaagtagttttttttgagacaggatcttgctctgtagctcaggctgcagtttttggagtgcactggtatgacataactcgctgtagcttccatttcttgggttcaagtaatcctcccacctcagcctcctgagtagctgggactataggcatgtgctaccactccaggttaattattattattattatttttgagacggagtctcgctctgttgcccagcctggagtgcagtggcgccatctctgctcactgcaagctccgtctcccgtgttcacgccattctcctgcctcagcctcccaagtagctgggactatagacgcccaccaccacacctggctaatttttcgtatttttttagtatttttttgtatttttttaatagagatggggtttcaccatgttagccaggatggtctcagtctcctgacctcgtgatccacccgcctcagcctcccaaagtgctgggattacaggcgtgagccaccgaatccagccactccaggctaattattttattgtatttttagtagagatggggtcttgctatgttgcccaggctggaatcaaactcctgggcttaagcaatcctcctgccccagcctcccaaagtgttgggattataggcaccagccactgcacccagtcaagaaaatattttctaatactgaatacagctaaagaatggatggtaaaccattattgtccagtcaggatcactgtcatccaagtgggacactcagtatttgagattctgggtggtgctataatacttgttgccttggtatctgagtgagcacttagtctaagtataataattttctggaggagtatattagggttctccagaaagacagaaccaatagaatggatgaatagatagatggatagatagatagaaagatagattgatagggccgggcgcggtggctcacacgtgtaatcccaccactttgggaggccaaggcaggcagatcacgaggtcaggagatccagaccatcctggctaatgtggtgaaaccccatctctactaaaaatacaaaaaactaaccagacgtggtggcaggcacctgtagtcccagctactcgggagctgaagcaggagaatggcgtgaacccgggaagcagaacttgcagtgagccgagatcacgccactgcactccagcctgcgacagaacgagactccgtctcaaaaaaaaaaaaaaaagaaagatagattgatagatagatatgtgagtatgtgaggggatttgttaggggaactgtctcatgcaattatgaaggctaagaagttccacagcaggccatctgcaagctggagatcctgggatgctgacagcatggctcactctgagtccaaaagcctcagaactagcggtgtaattctcagtccagtgctgaaggcctgagaagctagggagtgagggtgcactgctagtgcaagttgtggagtccaaagaccagagagccttgagttgtgacatctaagtacaggagaggaagagtgtatctcagctccaaaaggtagatcaacacattcacctttcctctgtttttgttattttcagtactggcctttggatggcacccacctacatggagggcagatcttccccacctagtccactcacactcatgcgttaatctcttctggaaacacagacacacccaaagatagtactttaccaggtttttaggtattctttaatccagtcaagatgacacctaaaattaaccatcgcaagggtatattcaatctgaatggccaaaattatctgatagagccttcagatacttgtacttaacagatgtactcttgggattaaatgagtttatgctcaagaaatgatattagccaggcataggggtgcatgccgttgtcctagctaccgtggaggctaggacaggaggagcattgcttgagactgggagcttgaggctgcagtgagctgcgatggttccactgcactccagcctgggtgactgggcaagaccccactgcaaagagagagaggcagagagagagagtagaaatggtatctgttattttacattaaaagttctggaataggggagtgctatggtctgaacgtatccctccaaagttcatgttggaacttatgacccaatgtgatagtattaagaggtggggcttttacgagatgactaggctattagaggcctacccttatgatgaatgaattaatgtccttatcaaaaagattccatttccactatgctgagagcggaaaacaaacaaacaaacaaacacaaatgaggttccacacagcactcatcctttttgcccttccacccttctgccatgtgaggacaaagcagcaagtctccattttggaagcagagagcagccctcaccaaatctgaatctgttggtgccttgatattgaacttcctagcctctagaactgtaagaaatgtttctgttttgttgttgttttttccgagacgaagtctcgctcttgttgcccaggctggagtgcaatggtgtgatcttggctcactgcaacctccgcctcccaggttcaagggactctcctgcctcagcctcctgagtagctgggattacaggcacgtgccaccacgcctggccaatttttgtacttttagcaaaagtggggcctcaccatgttggccaggctggtctcaaactcctgacctcaggcgatctgcccacctcggcctcccaaagcactggaattgcaggcacgaaccaccgctcccagctgagattttctgttctttgtaaattacccagtctcaagttattttgttatagcagcaaaagcaaattaaagaaggtataatatcaggctctcttctgattccctaggctctgctgcacgaattgttatttccagaagttcccataggaagttctcaggaaatgaaatggatatgaggtaacctcatgtcggggagtcagtctatggaggatcataatcatacaacaacatggtccacccttgctataatctattttttttttttttttttgagacggagttgctctgtcacccacgctggaattcaatggcgtgatctacgctcactgcaacctctgcctcccaggttcaagagagtctcctgtctcagcctcctgagtagctgggaccacaggcacacaacaccacacctggctaattttttggatttttggtagagactgggtttcgccatgttgcccaggctggtcttgaactcctgagctcaggcaatttacctaccttgccctcccaaagtgttgggattacagtcgtgagccactgcacccagctgttttctgttttctgacttttatttttgagacagggtctcgctctgttgcccaggctggagtgcaatggtacaatctcggctcactgcaacatctgcctcccgggttcaagtgattctcctgtctcagcctccacagtagctaggattacaggcgcctgccaccacacccagctaatttttgtatttttagtgaagacatggttttgccatgttggccaagctgttctcaaactcttgacttcaggtgatccgcccaccttagcctaccaaagtgctgggattacaggcacgagccactgcgcccggccttgttttctgttttgtttgtttgttttttaagagatagggtcttgctctgtcagctaggctggagtgcagtggcacaatcagctcactgcagccttgaactcctgggcccaagaaatcctcccaccacagccttctgagtagccaggactataggtgagcactggttaaatttttaatttttttttgtagagacagagtcttgctatgtagtataggctggtctcaaattcctagcctcaagtggtcctccagcttcagcctcccaaaatttgggaatttcaggcatgagccactgcatctgaccgtacaaaatgttaataaactggccaggtgtggtggctcatgcctgtaatcccagtactttgggaggctgaggcagggagatcacctgaggtcaggagtttgagaccagcctggccaatgtggtgaaacccccatctctacagaaaatacaaaaattagccaggcgtggtggcccatgcgtgtaatccgagctacttgggaggctgaggcaggagaatcgcttgaacctgggaggcggaggttgcagtgagccgagatcagagcactgcactccagcctgggtgacagagtgagactccgtctcaaaaaaaaaaaaagttaataaaccttttactcctggcctcaagtgttccggctgcctcagcctcccaaaatgctgggattacaagcatgagccatttatttttctttttttgagacgggagctcactctgttacccaggctggagtgtagtagcatgatcacaactcactgcaaccttgaactcttggattcaagtgatcctcatgcctcagcctcctgagtagctgggactataggtgcacactgacatgctcagctcattcaaaaattttttcataagagatggagggggggtcttgctatgctgcccagcctggtcttgaactcctggactcaagcgatcctcttgccttggcttcccagaatgctaggattacaggtgtgagctactgtgcctggcttttgatttttagacagggtcttgctctgttgccgaggctggagtgcattggtgtgatcatagctcactgcagccttgaattcctgagtttaagtgatcctcctgcttcagtctcccaagttgctaggactacaggtgtgtgccaccacgcccagctactttatgaacgttttgattccaaagtctgaaaaaagttttccagattcatctccaggtcaaataatgtccctgctgtcaggcatcctgctttagaagcaagatgtagcatttttcttcctttacttgcagcaggcagctaataactgttatcctgtgctggaccatccatgttctacgcattctaacatgtgctttacataaaaaattagcccaagtgaccctcactgtgacattacacggtacgtattattaatctttttttttttttttttttttttgaggtggggtctcactttgttgccaaggctggagtacaatggctcatgcctgtaatcccagcactttgggaggttgagttgggaagatcccttgaacccaggacttcgagactagcctgggcaacataggaagacccccatctctagaaaaaataaaaacatagccatgcatggtggcatgtgcctgtggtcccagctacttgggaggctgagaaaggaggatcacttgagcctgggaggttgaggctgcagtgagccatgatcatgctactacactccagcctgggtgacagagtgggaccctatctctaaaaagagagagagagagaaagagggagagcttttaaaaaatggcaaaatgtgcccacagctgatgggcctatttttcttttttttttttttattgagacggagtcttgctctgtcacccaggctggagtagtggtgtgatctcggctcactgcaacttctgcttcccgggcttaagcgattcccctgcctcagtctcctgagtagctggaaatacaggcacccgccaccatgcctggctaatttttgtatttttagtagagacagggtttcaccacattggccaggctggtctcgaactcctgacctcaggtgatccgcctgcctcggcgtcccaaagtgctgggattacaggcgtgagccactgcacccagccaatttctatttcttatagagcttacggtaggaggcttgaagatgggaacagaagaaaaaaggttgaagggcccagctgctgtgtgttgcaagacaggaaattgctgacagtctgcaatgccagcagcctcatgggtggttatcaccaggacagaggcctcagaacaggcaggactgggtgtgctggcactcacggctacgtgcagatagagcccgcccctgggccttggtgtgtgaccttcttcccaggtgcttctttgggaagctgtacagtgagggagatgaggcagactaagggcaggacacactagcataggagcggtggcagctaagtaggctgactgcccagggattgcagagttcacctgcacagtatgacatctctcatccttttggatagattgttctataaggtggcctccacctacccccaactcccaaatctgacattcattcatctacttcccctgaagtgctccctagcacttgccatgagtttgttcactcttgggaccccaaatccaaggcatctcactggctgagattcagtttaccacctcattgatggggggactcttatgtcacagaagtaattttctcactgataggacccaagatgtcgtcctatttttaatgtgggtacaaatactaagtaaatatgatcttagtgttttgccaaaaggaattaagatgtttttaatgggtcacaaattcagaaaggggttggacctggtgggacaggttggtgaggcccagaagctccacttcaagtgcagtactggacatccccttccagtacgggaggtctgacttgtgcagtcaagcccaatactggcacagccacaggccagggatggaggcttatgagtccactggaaaacagggaggactgagtccagggtctcaagggtttagtagtgagggctcctgtgaagaacccttcactcagtggtgttcattaccggccccttccttagtatgttccaggccctgaggatgtaccttgcatgctctgaccctttgaacaccaaagaaataagcaaggagataacagatgccccaaagagatgaatggtgtcatgagatctgggggctgggaccttgtccagcctaaaggtgtaagtaccatggatgagcagtgtcttatttaatcagcaactagagatttcctgaggtttaactgggaaagcaggttcatatactacaagacaccaggtgcttcacattgcttctctttattttcaacagtttctttacaacagtctacacagggattaactcctacatgtacttcccaagccagaatctccctttagaaattcagattctatttctaactctataagatgtatctccccaaagatcacattaactcctcaagtcaacatctgcctatccccaacttcccctttttttcctcactgaacatttgtctgaatgttttttcctcactgaacatgttttcctcactcacactgaacatttgtctgaaactgtggctgctttgttgcttcaagatgcatgcacatcctggctttagtgtccaagtatgcagaatgaagcatttgatatgtgcacccagctagttaggcatgaaacaggggcacaggatgggctccgggtcatagaaggttctgtccccacagtgaggacaggggttggcactaagccagaccatgctgggccgccccaactcacacagcaactccctgagcctggcatgcagataggcaagcctctccaggtggagggtaccatggatgtcctcataactctccagggggacaggatacagcacgtgggtcagattgctcagcccgatgaggtgctgcaggagactctgcaaggcagatatggagatggaattcccgtagaagcttaaggttgtaagctgggagcagtggctcagggaaggcaggagggcaaggagctgatcatccgtgatcccacactcatcaaagaccaggtcctggagggtggcagaggctctctccagcagagcttggaggggctcgggacttacatcggtcagcatgaccccacttagactcaggacacttagctgactgacgctgggactctgggacagatgcatcacatccccttccgaaagccggcagttagttattgagagggtttccaaggggttcatcacgtgcctgcaaatagacaaagcagttagtgctggggaatggtggtagtggggtggggagactggagagaggcccatttcaccaaaacccaaagtcttcctgatgatggttaaccgccaggatgccatgctgtaaaggagcattcaaggagtacaagttcaggtttagtcctttctccatcatttgctgtgtaagtgggtcaagtaaacaaagatctcaaacactcccttggctgatctgtgaggcagggtccaacacagacctcttaggtggtgtgagcatgaattgaattgagagcctgatttgatgtctcaagcaaggaaaggcatcagtgaattttagtatttgaagatacaactgaaaatactttctttcaactcgggcttccttctgccactgcctgggccccagtcacctctatctctgtgcctgatgaagctactagggagtattcacagtggacaaactggggcaaggtcagcaacatccaaagggggttcccaggctgcagggctaccttaggtcactgtatcatcagcaaaccacctatcaatttttgcaatttctctgttgttccttctcccacatctccagaatcctgcatttcccacctattaccctaactggaattctaaatcaccctttacagacaggaaatttgaggcaggtttagagggagcagctcatgttgagaagctggtgagcgcacagcttacaatttcaaatctcacctttgatgggctttcccttcttcaatgccctccttgcttacttttgatcatcttaggcatcacttcctaaggaagaatgcctaaagccacccttgccaggccccaacctcccattacagagttttctaacaaggagtcactgttaatagcatctatcctaatgtatacctctaacccttatgagtagtagttatgtgataccatgcttggggacagtggtgaacaagacgtgttaactggtagtgacttgctcactcttgcattattggtggctggcacatacaagatatcctttattgtttactgcaataaggaagggcttgctctggtctgcagagaaatctcaccatccctcacctgagcaactgatccaggcggcctctaaggaaaaataaagagtccacatagagagcctgcaggcactgcagactgaggaactgagaggtgaactgggcgatatactgctcttccttctccggggaaatgtaggaagatgcatggatgtgggagaggaggagtctacgcagattaatcatctggcccaggtaaggagaaaatttcgccaaggtgggtagcttccaggtacaagtcacttccaaatcttcaatagagtccagctgcaccattttcaggatcatcttgatatcctgcatgggcattgcaaaaatcttcagcttcttacagcacaggcgtagtacatttttctttcgcttcactttctcaatgaggtaggagaacaattcatcacaggcaccttccttgaggaacaggtctacgagcacctctactggaatgaagggctgctctgcctctgtgctcaaaccatctacttttcgcttctttgtcatgggctgagctgcttctggctctggaaatgagtacagactggccctgtttccagaccatacagtccagaagtcctgatgagagttcttccgtaaatccagcacttgaagtttccacctcctgtggggaaaaacaggtaattagctgagatgatgctttaagatcaactcaaaataagaccatgagtctcataatgtaggtaagaaccaaacagacatccaccttagatctgcacttttacttcgtacttcaggcatcagctgctccctttcccactaggatcctgggatccttcctggtccccaattcccaccccaccaggaggaagcaggtgcatgttccttcagacacctctgcattttaatcagtgccccatgtccagaagcccattccaagagtgacccctgcagtagccccaaggcctccctgaacttccttgctggcaaccatcagagcctctggcccagccttaggcgctccatgctccctgaccccagctgcatcctgctcaggttcccagggccccacaccaagctgctaggtcacccttacctggggcgaacctcctgggcaaggagcacatcaagtccatcaagcacagctttgaaggtctccaggtgaagatgttgtcccttcatcagcactcccagagggaggcaggtgaagggccaggcctgcaccattgccttcagggtctggctgtgtctcccgtcaaaggctgccatgaagagtggcgggaagagctccctgggcagcaactccagggcggcaatggccagggcctcatccttcagcaggctctgccctgccagctccacaagtctccgtgggcttgtccacacactcatgctgatgtatcggctctgaatggaaccctgaggaaacatacagggaacaaggcatccctttcagcccaagcataagcaactctatcttttcctcacccttctgagggaccaacttagggccaaagtcactgtgctagcaacagcaggggagttctcagtttaccccgattccactctgcactcggtggccacaaagccacagctctgctggcaccaggatgaacatctcatcaagtgtagaggaggggacaggacggccactggcaccatcttgtatctacccactactctatttaattctagtccccctgggaagtgagaactaaggagcctgagggctgaccctgctcattttgggaaaaagtttctgatgatcactcaaaggcaattcaaatgggagtgtcacatagcccaggacagcatccttctctgctccaacaaataagccagatgggaaagatgaggaacacacacacaatgcacaatggatgccattatgtttcactaaaaaattttaaatgagaaactacagaagcagcacaacagtattacatagcaattggaagtacaataaaaaaaaaacattctgagacatgtattttaagtgcgtctcttttacgtatattaagagttactactttgacatggaaatcagcggagcaaacacttcacagtaaaacaaagcctggttcttttctcccaaaacattagttttaaaatggagaaataaaaattgtgtatatttatggtgtacaatatgatgctctgaaatatgtatacattgtagaataggtaccttaagctaattaacatacatatgatctcacatatgtgtggtgagaacacttgaaatatactcttagcaattttcatgtatacaatacattattaactacagttaccatcttgtatactagatatcttgaaaaagcctccaccctccagcacagtggctcatgtctgtaatcccagcattttgggaggccagggtgggagaatggtttgagcccaggagttcaagaccagcctgggcaacacaaggagacctcatctctattaaaaaaaaaaaaaagaaaaaaaagaaagaaaatgtctttaattccaaagcatctgaaaagaaaaagaaaaaaatctatggaatattttttaaccttttagttaaaatggaatattttttaaccttgtagttaaaatggaatattttttaaccttgtagttaaaaaaaagcctaactagtaaatcactgatttaaaaaatcataaatgatgcaaattataattgcttgccacatactatttaaattgtaataaagtaaaattcaaagtagatgtcttttattttccaaaaaaaaaaaaaaagccgtttaagaaattatttttaacatatacaaaatggcagaaatcaaaatgtttgggattcaatataaataataaatgttccaggtaatggttatactaattaccataatttgatcattacatactatatatgcataaactgaaatttcacatgtaccctataaatatgtacaattattgtgtatcaattaagaaatcaatccaataaccaaataaaaatgtttgggattaaggcaaaactacatttagagacaagaacaaagcctgttcctttgtaaggaaagaaaaaggaaaaccatctaagcagcattggccctcatggcccgtggagaccctgaggtgacagtagaaggaggcagtggccatagcctgaggctcccgactcaccagacccagctgtggtgcagaagccatctgcccagacctctgggaagaccacaacattgactccatggcctctgggtccctcctctggcccctctgaagctattacaggcctttctgggcatacctcccctttcaactccacgctgccaacggaagagccaaatctaattacattcctggatctccagccagtgaatcctgatggggttttttacttacttcaggttcaactgattgaatgggatgtctatttacaaaaaggaaagaaaaagtgaacaaaaccacccagagagtataactgttaggggaatttttggccacatcaaaattacccaaatagtccagttaagatagctttatgaagagcatcatgacatcaccccttcccactcccaaacaatccccaagtatcaaattgtcacttataccccatgttccctaacacagcaaatcacatgcctatccaaggaaaaagggaggaacaacagaggggtggctggtcttccagactttgaaagtcaaggctgtcctgaaggaaggtgggtcaaaattacactacaattaggagttagtcagaagtaaggctgggcatttgtaatgggactgagtggattaccacaaagacagataggtttttttgggggcggaattgaaagactttggcctggatggagtagagaaattaaaaaggggaatggctaaggaagatgaaagatagttccagtaaagccaaggtaatcactgaggcagggagggagttcaatcttcctccctccctagagggaaagggtgttttctcccagaaagtcaggatcctcttggcaaacagccttgacaagattaaatctaggaatgtgggctggagaggtgggatagagagtaatattggtgaccaaacctaggacagcaacattttcaagtctgaaagaccttgtggtttcttaggaatcttggagccaggaaagaaataaacaagggctgaaagcacacatccctgcaattaaagaagttgtcagaagaccttctctttatggttaggtgtcctcttccacactggggctgttcacaagcagcaggtcaggcctttaccacaaacataatctccaatggccagccccttcctaagtattactaatgtttccacacttcaagaaaacagctgttctttcttgcccctaagctgctcaggtacagagattctggtcagcgagatgcaatcaggcctatcaattagactcagtttttctctatttccatgctaggcacagtgcacaaatacattttccgtcacaaaaaattgaagttatatttggcatttaaggatctgcttagggatgattcctatcctgggcctgatcacccactggtgcttttgaagttttggaacctctccacccaaagaattctccaggccattctctgcctcatgcactgtgaagtccctacaattcttatattctactggcaagtgtccagctggaatgtcttgcggcctgactttgtttactgtggcctgcgtaaggaggctgtaattcgttgaaggatgttttccattttggttctctctctggagactttctcctacttttcaccctcaacacctaatggcctttgtgaaaaccgggttaaactacaatttgttctacatttcctttaattcccaggcaatcatcttcactcatcagctgcgggagactgagattagtaataaaggtcattgtcaatgtccctaattatcaagcagctactgggcacagcaaaggccgcagcagctctcattcattacctcaaatagccttcacagagaatctaaagttcactgtcattttcatttttagtcttgtaagtccctgactctgtctggggaagaacctgctcagctccaagcaagcaggaattggtagcccttatgtgaggagtttagaaagagtttcatttccctccctatcaaacaatctaagtgttagaaagggctgataagcttcacataaaccatggaaaaacaggaaaactgagtaagtccaacagttaaggaagcttccatgggatccccgcttccaggagatccaagggaggaggaggaaccgcgatcaagtgtgagttgtgtaatctctgagctgtgcaatctccctgtgaggcagtgacactcctctgtccagcttcacactgccagtttgtccagtggcactggaggaagcagcaccaggggcacatttgcacaaaggtgctgtccttcctcccagtataagggagaagtgaaaagactggggcccagcatgactcctagggtccagacatgaattggggagatatttctgcatgtcctgtctactggttcttatggtccttgtgggctgcacaggccagagtggcctctgagctcatcaggtgggtggtctgcaccctcctctctagtcatagaatcccagtggggacccccgaagtatctgcaccaggtccttcaggtgttttttttggagtgcagtggcgcaatcttggctcactgcaacctctgcctcctgggttcaaacgattctcctgcctcagcctcccaagtagctaggattacaagcacacgcccccacacacggctatatttttgtatttttagtagagatggggtttcaccatgttggccaggctggtctcaaactcctgacctcaagtgatctgcctgtctaggcctcccaaagtgttgagattacaagagtgagccaccatgcccagcctctttttcttttttagagacagggtcttactatgtttcccagactggtcttgaactcctgggctcaagtgatccacccatttcagcctcccaaagtgctgggattacaggcttgtggataccaacagcacccgagcacggtcccacagtccaacgcactgtgccgtccttgagcctttagttccagcacaagtctcccggcttcaacccaggttgcatgttctccctgatctccccaggtggcacccaaggatgaggcagtgcaatcttgttgctcacttcccaggaccgacacttacccctaatggcccaagcccatggggcagtgagatcaaagcctcctggagctcatactctctgacaccactggaagtgtgggcttttgcgtctgattaccccggggaaaggttctgaatgtaatcgtggctttggcaataaggtccacaatgcattaagatttttttttttttttggaggaggagtttcactcttgttgcccaggctagagtgcactggcaccatcttggctcactgcaacctccacctcctgggttcaagcgattctcctgctcctgtctcagcctcccaagtagctgggactacagatgtgggccaccacgcccagctaattttttttctatttttagtaaagacaggatttcaccattttggccaggctagtctcgaactcctgacctcaggtgatctgcccacctcggcctcccatggtactgggattgggattacatgcatgagccaccatgcctggcctagggttaatttttatttttggagacggagtctcgctctgtcgccaggctggagtgcagtggcatgatcttggcttactgcaaccttcgcctcctgggttcaagcgattctcctgcctcagccacttgagtagctgggactacaggtgcatgccaccacgcccagctaactttctgtacttttagtagacgcggggtttcacagtgttagccaggaatggtctcaatctcctgacctggtgatccgcccgcctcagcctcccaaagtgctgggattacaggcatgagccaccgtgcccgaccctagggttgactctcatacaaagacagcacgggaagtgaaatgctcttttgtggaaatgaccagaaacaataaaagcggctcctgcctcttcgtctactgtgagggacctcaggatgcagctcccatctggctcgagtgacaaggacagaggggaacagggcttctctgagcacctcagacagctcaggggaccttcttacccacaaacgccttcgttccattttgaagcgacttaggctggcctcaggacctccaacgcttggatttctaggtctcagtcacttgttgccacgcacgtctgagagtaataatcaaaatgctccaaaaagaagaatacatgtataatatttacgaagcaacggcctcctgtgaaaacctccgcaaatactgctgaggaaactgacaactggcgactcaatcccgccctttcagtgcaaatctctggctccaaacctgagcaccagtgtttcctgggctgaaccagggggcaggaggaacaacagaccatgtggttggtcacaagtgacccctgtggtcaaggaccctgactacggtcttgcagcgacatttctgcctctgctcccgccttcctaggacgcctacgccactgcctgggccgtccccaacccccagcaccttcagaggggccgagtcccagagcatccaccgcattacaaatgcgcacccaccctggagagctccaaccacgagcaccgccgcctcggttcaaggcatccttacagccacaactcctcaactggggccaattttccggggcaggcggcccggggtgacccaagtggcgcacattattttctttggtcttcaacccatttccagagagaaaacagggacccgggacaggggtggtgccgggggcacaagcccaaggtcaccctgcggggaagcggaggaatcagggctcgaacttacgtttttcctcagagagttcaccacaccgcgaagttgctggaaggaaagaacgagacaatggctcagctaagcgccctagccgctgcgtggggcggggggggcggcggtgggggccggggggctgggcagcctggtctgaccaatccccgtttctcagtccttccagggcaaaatctcacgagatccagtgaggtcgcccagagagtcgagaggggcttgttttcaaagactgggaggaggaggggcagtgggggaggggcagtggggggaggagcagaggagaagggagcaggaggaggggaaaaggggagaggaagttggagagcagaggaggctgggggtggggagcagatgggggtggggaaggaggggagatgggggtggggaaggggggcgggaggagggttaggaatgggggaaggaagacagggtgggggaggggtgggcatgggggaaggaagacagggtgggggaggggtgggcatggggaaagggagacagggtgggggaggggtgggcatgggggaagggagacagggtgggggaggggtgggcatgcgggaagggagacagggtggggaaccgagaagaaagacagtggggggggatggaggaaggaacacagggtggggtggggggtcgggatgggggaagggaaacaaagagtggtggaggcgtggggattaggaacggagacagagggtgggggaggggtggggtgggggaagggagacagggtgggggaggggtgaggatggcggaaggtagacaaggcgggggaggggtggggatgggggaagggagacagaagggggggaggggtggggatgggggaagggagacagaaggcgggccagggcgggaatgggggaagggaaacagggtgggggtggggatgagagaagacagaggttgggggaggggtggggatgtgtaagaaaaacaaagggttggggagggggagggaaaagaggcagagagtgggggagggggtggggatgtggaaagaaagtcagaaggtggggggtgaggggtggggatgggtgaatacgtgatggctgcggcctttcccaccagacagtagggtgggggcagggtggaaaaagggggtgcggtgggcgaatggggaggcggggggctgactgggagtgtgggacggggtgttctgggatcacggagacgtccaagtctggactctgtcctgggtctgtgcttctggcgacctcccttttcttcagtgggatgcggggtgcaggggccggttccaggtcccctgagctcaagtctcgccccaccccgccccgcaagtctagaaaagatgcccctgcccttggctgggtaatctctggatttacctactgtctgtaaccccccgggctgaagagaccaccccccgggagtcaattaacttactctctggagcgcgcgttcctccctgctcccaggagtcggtttcccaaaactttctgaggcccgcgcatgctcccctcgactccccgtgtttccactctccacagaaatccacgcattcacgcccctcccctcccccgagcctgcagaggactccgccctgctttccctacattcagggctgctccttttgtcgccaatacaaacctgttgacaggtcacgcctgggaagcgggtggggtgtcccggagcggtgctgaggcgctgcaggcccggcttctggctgcgggggagctgtaccctgaagcctcgccggaactcgcgtctggggccagcagggggcactagagtcaacagggactgtatgcaaaacccacttcctcccaggccctctagggggatggtcaggcttctgcagagatggggaggatcctttcctggtaaggggagagggacgggctaggagccaagcggaaggaccccgtgttcaaggcccttcaagggacgggacaggcgaggaatctctttgagtcttttgaattgttttatcagtcaggcctgggaagtactccgcctccacaaactctgttttcctgaaaggggtcgggggggggaccccaacatctcctgccacaggctatgatgggcatggtggctaagagcaacaggccgcgtggtgaggctggctttttgtggctctgccctgccattccccgaggcatccccatgccagtgaacagagctgcgggttcccagctgcacagatgaatgcacgaacaaaacataggtccatacaaaggaagtcattgcattgatccagattcgacctgggattgtcgcataaaacagggctgataaaaaccgtcgtgttttcaccctggaaacagagactcagcctccccctctttgcttgaggcattcagcaaaggtttgtccttgagtggctgtggatgctcaaggacttacgatttctgactttataaagtttagggtgaaaacaaaaaacaaaataaggagaccattgttttaaagtggccgttgtagctaattatctcaagaaagcaaacaggctggtactgaaagttacacaggcgggcggctccctgggagggttgcccagctctccttttctgagacctgagcagggagcagccagaggagcttgaagggatggtgttcagggcatgggaacaggctgcacacatcttcacggagtacggtgcttgtccagtttgagaagggaaagaaacgggagcagagggctgatgagaaggcagcagatggatagtgcgggattgaaaaggggatccatttgaagactggccaccattatttattttcatcatctgattgctgttgctccattgagatcgatgcgtggagaacaagttggggagtggaacaaatggcagggaggggagagaagtgagtgaacatgaccctggtccagcctcataggacagagcgtggtcatgaagtccacagaggaggacaggtagggaggaatcatggcatggccaggttgtagggcaagaggcagagaggagagaggattgtggaggatgcctgcggagtgccgactgtcagtcgaggctggtcctttatttatttattttttttttttgagacggagtctcgctcttgcccaggctggagtgcagtggcgcgatctcggctcactgcaagctccgcctcccgggttcatgccattctctcgcctcagcctcccaagtactgggactacaggtgcccgctaccatgcctggctaatttttttgtttttaatagagacagggtttcacgtgttagccaggatggtcttgatctcctgaactcatgatccgcccacctcggcctcccaaagtgctgggattgcaggcatcagccactgtgcctggccaaggctggtcctttcttttatggcgatgggtgtttgaaagttgcacataccaaaataaactcactatttgttgacccaaagtaaaaccctgagggtatgaaagggaagggctcatgcttacatggctgagataaaagctgtctcaggaagctgggtgtggtggctcacccctgtaatcccagcactttgggaggccaaggttggaggatcccctgaggccaggaattgaagactagcctgagtgatatagcaagaccccatctatatttttaaaaagggttggctgtctcgggacttttcgaaatagccctgcaagacattcctgttttggaatcacaacaatttagataagatgcttttgaaagaacacctgcctaggcacagcgtctccaccaatgaactgatgccaactgtggttttgagtcttcataaccggtgaactgtttgcaagcagcttatttaaatctctttttttgccaatacaaccttccctttgccctcccctcttgagatgcatatatggcttgccatagctgagcatcttaggttataatgctttttctcttttttaatttttttttgtaaatttatatttatttttatatttatttattttttgagacagggtcttgctttgtcacccaggctggagtgtagtgcataatcgtagttcaccactgcctccaactctcgggctcaagcagtcctcccacctcagcctcctgagtagctaagacaacaggcatgcaccaccatgcccagctaatttatgtatttactttattaaaaattttttttttttggtagagagagtctcactgtgtttcccaggctgggcttgaactccaggcctcaagtgttgctcccaactcgacttcccaaagtgctgggattacaggcatgagccaccatgcccagcgtataattttgtattctaattcctgaataaattcaacaaatttggaggtgttttttgtctgatggttccttttggtcgacaactggaatgggagaggaacagtgtgagggcaaacatcaagtgctttgctgagctccgggtgctttttttggataagacacagaaaatacaataagatgtctgtaatgtttgatttttttccaggtttcttgaggtataattgacaaataaaaattgtatggattcaaggtgtacaattcatatacattgatccacatataccttgtttgatgattaatcaaattagttaacacatctttcaccccagcagtcaatgtgtgtgtgctctgttagcaaatttcaattaataatatagcattattaactatagttactatgctgtatattagagtctcaggatttaccatcttataactaaaattttgtagcctttgaccaacatctctcattcctcccacccacagcccctgggaactaccattctactctgcctctatgagttccactttttgtgtttcttttttccctttcctttaattttttttgtatttgttatattaccaaaccatgtcaaaagagttccactttttagattccacatattattagctcgtacagtatttgtctttctgcatctggcttatttcacttaacataatttcctccaggttcattcgtattgttgcaaatggcaagattcccttcttttttatgactgatgatgtctgtctgcaatatttgaaaaaaaaatgcagatcacgtgaatgattgtctaatgtaattctattcatgtaaaattgtgtatgaccataacagtcactcattcattgcttcgagttctttacaatcggatgccatattcctggggctctgctaggcctgaaatggggagtaggagttacaaggttcctgggatatcagtaattcatatttgtgaatgtcttagataagtgggctaacatgtacagaaaatggtcactaaaatgataacactgtttgttataaaatacttttctgtattctcttgaactttttttttttatcatttattagactgcttcagctgccataacaaaatatcacagactggatggattaaacaacaaaaatttatttctcacagttctggaggctgggaagtccaagatcaaggtgtcagcaaggtgggtgtcattctgaggcatcttctcttagcttataggctgaggccattttgcgttgtgctcacgtgacccctttgtgcgcatgtgtggagagagagcatgggtgcttcttcttataaggatgctgaaagttatgagaacccgacccttgtgacttcacttaatcttaattacttccttagaggccccatctccatatacagccacaatggggattagggcttcaacatatgaatttgtggtggggggacgcaaacactcagttcataaacatatgatttttttttccttgatcggcaatgaaaatagaggtatcttcattttggaaagtgagagtcaacctgtgctgaattagagtgatgacaagagatactttaagactgcaatgagggaagcaagggatggggacgcatttgacagtctgttctgctgtgctcctggaagtgagagaggctgagtcgggactaacctttgcacggatgagatagagaactgagagagaaaagtatgtatttttctatgaccacctaaaataaacctggagttgaagggaccagcactctcaacctaaccattctgggaataaaaatcatagagacctcgctgattaatggaaacaatttgcctttcgattttctaagcaggtgaatgcaaggagtttgtgaactttactgctgttttcgtgtttttttaggtgaagacactgacagtaagaaaaggcaaaccacaggtccaagacaaagtggtcaagtcaagaaggaactcaggctgtgtagtcctggtgcaaggctccttgcccccagcgtggggtcacactggctggctgtgctcccacgacacttagtgcatactgggctcctgacttaataacacgtgtttgaaatggcccctgattcccaatctgctgcaggattctgcagatgcgcaacaggccacagtggaaggtcttggagagaattcagagtggcttgcctacgttcccatgaccgtttgtcctaatgggagaatcaccattttggaaaattcttttggaggccaggcgcggtggctcatgcctgtaatttcagcactttgggaggctgaggcaggcagatcacctgaggtcagaagttcgagaccagcctgggcaacatagtgaaaccccatctctactaaaaatacaaaacttagcctggcatggtggtgcacacctgtagtcccagctacccgggaggctgaggcaagagaatcgcttgaacctgggaggcagagattgcagtgagccaagattgcaccactgcactccagtctgggcaacagagtgagactctgtcttaaaaaaaaattcttttggggctagctgtgaatgagctcagagggaaaggcaggagccttcaggtagggagcagcatgattccaccccagattcaggcctcctgggtgtacagagggcaggaggatcctccccaggtatgtgagaggaagggaagatgaggtgtttgggtcagtgaacacactagaaatccaggtgctcactgatggattgtgcttggcatctctgttctgccaatccagcctcaaagcaactttggaagaggatttatgcgcttcacacgcttccagcttgggccagagcatctgcacactcccctgggtataggcctccagggcttggagcaacggaagagctaagaattgtcagtgctcaggaggcagattttcagggaggatcctcttgcatctcaggacatggaaagggctaacagagccttaagtgtcctgtcccagtgctggggtctcagaaggcagctctggggcatctccaccatggtctgacttctgctgcttgaaaccattctccctcacggcacaggcaagagtcctcaaggaagagcacctgggcacctgggttgactcttcctctctccaggtggagagaaccagtagagtttacctggggtcatgctctgagttaatccccctctgcatttctttctcttctcaggggcctgggctcagccttgactcagccttcctcagtgtctgggacttggggtaaacagtcaccatcttctgcactggaagcagcagtgacattgagggttctaaccatatctcttcgtacctacagtgcccaggaactggccccacactcctcatttattatgtccattctcaacccttagggggtcccagcttgattttcagtctctaggtctggcaacacggccttcctggccgtctttggcctctagcctgaagatgggcctgacagtcactgtttgttctgggacaaccatagcatttttacccacatgtgctccaagtccacggggaacagagaccaaatctgccatgagtgaccagtgtcacagggcttcacaccagtcaggcagtcagatggtggtgtttgctttcatttctgctcatcatcccaagggggtggacgcttcaggaatgggaccctatgcaactctcattgctctttataatgatgtgggaaagagaaaccatctcccaggggacttggctttgcaaaaatgaaaataaaagctccctcctccctctgtgcagtgaatggcctctgaatgcagacttggtctccctcttcagtggcaaggttggaggaagaacaacagcttcttattgcactgagacaactcaggggccacctcatttgaagatgtgcatcagtgtgagcccaggtattcctgtactcaatgatcgaggtctctctccttaccttgtctccacctggatctgaccaaagtgactgagatgatccaggttctagttttctcttgctgtgtaacaaatttctgcaaacctagcaccttaaaataacacccatttatgatctcccagttttcctggatcaggagtctgggatcagcttagctgagtcatctgttcagggtcttcccaacctgaaatcagggcattagcttggctgtgttttcatctggaggctcaactgaggaagattctgtttccaaacttactggcagaactcacttccttgctgctatatgactgaagccaaggttttggggggctatttgccgtcagtgcccgaagctcctagagttcctagaggtcacccatagctcttttgccatttaatgtaacctaatgaaaagagagatattccatcacctttgccatatttattggttagaagcaaatcacaggttcttcttgaattcaagtgaagagattgtgcaagggtatgactcatttggggtcaccatagggtacatcctcagtaattgtgtgcagtcaggactaggggaggagattctaattatacagagaagacttgtgccttctattcagaagttaagaagacatcctttactttttaagacactctgtcattttattcattgatttttagtggtgttctagaaagcagattttccaagcgtaaagcacaataatgaaatggcagagctgatgacagttcagatgctattagatgggtgtgcagatctaggtttagagccaagggatggagtagtgtctcttggtctccactgtggagaggccccttgggaaaacccaccacccccatttctcctcactccctgcctggacccatggtctctgcttggtctggcctatgctattaaaaatatacttcaatgatgatacttatgtcttgtgtttctctacactctttgtctatttgcagtggacagcacactgcatgctgatatcaaaaattattccagcaaattcaaaaataagacagtaaaaagaaataaaagacagttttacaatggaagagacagaaatgaatagttgcacttatgtttgatttagctgttaaatctaagagaaccaactgcgaatgagtagagaaagcggtcgttgctgcatactgaccattactagtgtgagatactgggggagctaggatggcctcctcttcctcttccttctcttgcctctcctcttctttcttttttggtaaatatctttcctagatcagcggttctcaaaactttcggtctcatgacctaatcacctcccagaggccctacctccaaataccatcacattaggggttaggtttcaacatatgaattttggggggacacgaatatttagtctagaatgctttttcaagaaaaggaggacagaaagatcatactacagtggcttttaaaaattagatatggacagcttttgtttctggaatatgtcagtgtgctgttgtgcaaagcatcccgggaacaacacctcagaatgtttcctttctgtgcctcagtaagacttgaaggctggtagggtagcctgagtcgtggctttcaatgatattcaggtcctaattcctgggacttgtgaatactgcctgtctttgtccgttttgcattgctgtaaaggaataaccgagtctgggttatttataaagaaaagagttttatttggctcagggttctgcagactgtacaagaagcatggtgcccacatctgtttctggtaaggacctcagaaagctttcaatcttggtggaagggggaggaggcatcacatggcaaaaggcagaacaagagggagaggagaggtgccacattcttttaaacaaccagctctctcatgaatgaactcactgatctccacagggagggcaccaagctattcacgagggatttgcccccatgaccccaaaacttcccaccttctttttctttttcttttttttcttttctttttttttttggagtctcgctctgtcacccaggctggagtgcagtggcgtgatctcagctcactgcaagctccaccttcccggttcacgccattctcccacctccctagtagctgggactacaggcacccgccaccacacccggctaattttgtttttgtatttttagtagagacggggtttcaccgtgttagccaggatcattctttttctttttcttaacctctgggagcacagaacataacataggatttggaggggacaaatatccaagctatatcattactttatatgagaaaaggggttttgcagatgtaattaaggatcttgagggagacattatactggattatgcaatgggccctaaatgtagtcacagatgtcctttcgagagggaggcagggggagatttgaggacagaaaaggagacatgaacagcggtgggatgatgcagctacaagccaagcaatgccagcagtatctagcagctggaagagtcaaggaaacagattctcccctgggacctccagaaggaaccagtcctgctgataattttatttcagttctgtaagccttcttttggattttagattctcagaactgcaagaaaataaattgctgttattctaagcccctaagtttttgacaacttgttgtagcaacaatgggaatctgatatagctaaggtaccatacattttgacatcttctctatatatggtaccattctgatttgtactgtgcaaggcttccttgccctctcactggtaaaccttggtatgcaggaaattatttttgtacattctccagtatattaactttggttataggtgatacattatatctattgcaaattatcattttgtctcctaatttgcatcaaccatgctgcttgtgtctatttatgactgattgtgtaggaaaattcttcaagaaaaaatcaaataggatggtaattcctgcatcttggaatgcctaaaaatcttctggcaataactgattacatagagaaaccatctgtttacttccttcaggaactacctggcaccttctagtgctttcccttgtggaccacaggtgatggaggctgggccctaatccagcacacacctccagtctagcgggcttctggtccagttatttacctacaggtattttattgatgttattcttcctctgatgacacgctgatttcaaaacatgcctaaaaccaaagacacaggatctttgaagtcccttccctcaaatatctgaggcttttccccaattgagcagcagttcacatgcttgtaagttttaaatgtgttaggcattttactggaaatgctttatatgcttcacactccacaggacttcttattcccagctcattgattgaggaaagtgaaatctgccatttgctgatgggccaatgtcaaggccaatgtcccagatcccctgtcaggacaaaagtgtgatgcagccagaagtcagccctcacctgcaaatgctctcctgaacttgcctaccctggagggatctgctcaccaggcagattccaggcgatgcccaaagcactccctaataaaactctgtgtgctcatctccgccttaacttctgtttccaggagacccagcttgtgaccattgtttccaggaagattaccaattgtctctgtttgccctggaccgaaggttttcccaggacatagatctttcagtgctaaaacaggacagtcctgagttatcttaggaccaggaatgtctatgaaaggagacacttgagagatgggattctggagccatggagaccccaatatgggggagttggaggtaggggcgcgagggtagatgcgcatatagcccctaccatggtggagcaatgcagtgtgtaaactttttaccagtggtgaatagggatgatttacctataggaggaaatgaaaaagcaggaccatgagtcagacatttgagagacgtgaagaaaacagaacattaaaggaaccaattccacagctttctctgttggaacagtgtggtagtactgatactaagtgtgattgatgatttgcaacagataaaatgctggaatgattaattagcaatgaaaaactagaagatgtggggcaacaaggctccagctccatcctcttagggtaccagctgggctcaagaattgacataaaacagattcgcaggagacaaaacatacaaatttacttaatacaagtttcacatggcacaggagccctcacaaggaaatgaagacccaaagaagcagttagagtcagttacttatataaggaattggtcaaagaatagtcagttgtgaagaaacgactaaaatatgtggggaaaaaagccccagaatctggtgtatccaaataggactccactctgatgacaggtttcttgggctgagattcctttgagccccatccaacttcttcccagctgctgagaagagaaaatcttttagaggcttcctggaattttcccagtccacactgattttgcttaaaagataaaagttattataataaggtctgttcagcagtatctcagttttgacttctcatccctgaggataagaatgttgcttttccttctagcatagggagggacagggtttttcacatgggacttttgtcttctgcttttaagaaacagaaaacagcagaatgatctttttgcaactggtgttttcaagtgccttttacttaaatagtcaatttgctagaccggtacttttttatttcttttcttttttttttattatactttaagttttagggtacatgtgcacaacatgcaggttagttacatatgtatacatgtgccatgttggtgtgctgcacccatcaactcgtcatttaacaccaggtatatctcctaatgctatccctcccccctccccccacaacaggccccagtgtgtgatgttcccccactgtgtccatgtgttctcattgttcaattcccacctatgagtgagaacatgcggtgtttggtttttcgtccttgtgacagtttgctgagaatgatggtttccagcttcatccatgtccctacaaaggacatgaactcatcaatttttatggctgcatagtgttccatggtgtatatgtgccacattttgttaatccatagactggtacatttttaactccatcagagcgcaagccaaaaagcttcctcctgggctgaaaaaaaaagcttccccctgggctgaaaaaaagcttcatcttgggctggaaaagctttttggcttgcactcttcctctgggcctgagccttccctgccctctcatctgcttggacagagggcagggaagactgaagcccagaacttaatcctaagtgtagcagaccatcgggaccctgacagggtaacagtggggtactgagtcacgggacgaggccatctggattcacgcacctgaaaatcttgatgtccttgaattttccaaacctgcagaagtggccctcccttactcattgaaacccatgtctcccttccttttgcctgaagatgatgcagagacctctgacctgtgagattgtatccaccaccacaagtgtccccagaaatctgccaccacctcctattaagaccaaaggaccaataactagaattgagtcccaaagaaacctggcaaggaatgtgatagacctgctgcagaactaaggagctgcagaactaaggagctccagaaccagccaacacgtgcagtgggccccaggcgagtgtgtatggggctggattctgagggtgtaagatcaaagtgcaaaacctaagattggattggggagggtttatctgctggaagcactctcctgggacgcaggctttaaccccctagcaaagacattgaggcattctgcaagcccgccgcaaggattgcccttaggaggacagagaaagcaatggtccgtaccaagcaaggtcataatgccagatgtgctgtggcagatggtgggagaggaatcaaaaggtcctgggaggccaggtgtggtggcttatgcctgtaatcccggcaccttgggaggccactgtgggagaatggcttgaggctaggagatcaagaccagcctgggcaatatagtgagaccctttctgtacaaaagattaaaaaaaattagtcaggcatggtggcacactcctgtagtcccagctactagggagtctgaggtaggaggattgcttcagcctggggagtttaagactgtagccagctgttccagcctgggcgacagagtgagaccctgaaaaaaagaaagaaagagagagaaagagagagagagagaaagaaagagagagatggagagaaagaaaggaaggaaggaaggggaagggaagggaggaagggaaggaaggagagaaagaaaaaagaaaagaaagaaagagagagggagaaagagagaaaggaaggaagggagagagagagggaaagaaggaaagaaaagaaaagaaagaaagagagagagagagagaagggttctgagagtgcttagctggaaaggcaataccaggtactcatggacatctccccaagtgagagaattctcaggagggcctggggactgcagtctgtaattgattgataagcggtgcactggtgagagaaatccagcatccttgagaaactcagtgggtagttctctagaccaggccagcaggggaagctggtaaggaagttgatagcaatacggatggaaggaccatgcagtgatagtgtcacattgtcagggcttaagcataggagccaggtgtgtggcaaaagatgaagtggcagcaaggcacctgacattgaatgatggagtcagtcagtatagcatggcacctctcggggcaagatgcataagccaccaagaaagggacagcttctaatctttttagcttattttttatttttttgttgagatgggggggtctcactaggttatccagagtagtctcgaactcctggcctcaagtgatcctcctgcctcagcctcccaaattgctgggattacaggtatgagccatagcttccggcctagcttttaatctatattttcagagggaagtaaggaagaagggtcaaaccccattaacaagtttctgaaagagcctaacttgcaatgtctagtcattccagagtaggatatttaccccaaggattaattcactgtagttgctgtgataaatgaccaaaccataaactgagtgactaaaaacaaagacctctaaatgattacacctggtatctttggaggagccattcaatctactatacgctgcttccaagtccttgtagaaaaacatacggaaatcatgcatcatcccatgggtggaagacctcgctccaggttagtgaactgctctgatttgtgactccaaagatggacattggtgacagcaaaaggaggacccagaatctcgtgtattcaaacagaactccactctcatgagaggtccttggatctagacccttgggtcaagcttcctctgagcattgtccaacatcttcccacttgctgagaaggaagattctttatgtgggccctggaatagcctcagtccagcctgatctctctctcttccctcctgaagttttatttcaaacattttgagactctaaaagggtttctttgtctcatttctctcctccagtcctactaccagggttgtcttcaatttatatccaatgtttctctggcctggaactgagacctacctcccaagcagcgacccgacccgtggagtggggtccctggggcaagcgaatggtcctttgcctggagaacctgggccagcagtcatggcaggtgacacattccattctggggcgaggaaccagggagggagcactgcatagatcagaagggtaaacaaggggagggagaaggagcaaacttagatttgggagggaaagagggaagggtgcagaggaagcagaacacggatgactgggcctccttcagttgttcttgtgactagaccctcccatctaagccaccaggggacaggaagggtatgagtttgaggactctaatggccccaaggtactactgtggtttatcctacttgtaggcggtcccaagagctttgttctctccagggactcaaaggggatgaacttgcaagtcttttgtctccactcagtgccttctctgattaggccaataaacatccccaggcctcagtctcaggccactgtaggggctgaggacagtgagaaagatgtgtgagcatccaccctttggagaggttgagtaggaatgagaggtcccctgccttgcctttggtccttgtgaaggaagatgttggatatttcccagcttggctggaatccgttcctcaccctccccattcagagcagggatgagtaagtcctccgctttctccgcaaccacaattgtgtttttcaggaaaggataaagtgggaaagatcagatcccatgcctcttcctcctctaagtcatgggatgactgcagagagtgagcaagagggtaaaaacagtgcactgagtgtgatgtttgctaaaggaacagataattgcatcaaaacctatttctagcagagttgtggtgcttgcctataatcccagctactaaggaggctgaggctggaggattgtgaggccgggagctcaagaccagcatgggtagcatagtgagagctcatctctaaaaaacaaaacaaaaaaccacacttatttctaattgtctaattggtatccactatcagacctttctgggaagttttttttctaacatgcctaaatgtggcttggagactgtttgggtgaggccaatagcttagccttcctacttaagttgtctccttcattcattcaacaagcaggtattattgagtggattgttgggtgcatttgtgtgtcctcagtaggatgcaggcatgcaatacatgaagatatgataattccagtcagaggaatggcctgtgcaaaggccctgaggtagagagaaccttgataattgaaagaacagaaagaaatccagtgggactggggaaagagaggaaggagatgagaggggagttacaggcagccaacagatcatgtgcagacagatcacttgaaagcagaggcaaatggctggatgtttttgttaatgaaaagagaatttatttgaagatcttccatcatttttacatgaagtgattgatgtgttaaatgaatgaaatttaacattcatggtgtatgaaatttatggaagaaaaactgaagcaggcagagcattttatggcctttgggcacaagagagtgaagcttgtcccatgtagagtcatggagagtgactgggagattcaccattagagttggcagattggctcttggattgaatatggggcatgaagcaaagagttgttgactcctggaagtttgactttgtcaatggcgtggctactactttcttttattaagagagagacagatgggagagcaacaggtttgagggaaacacataaagtgctttgtttggactcatggggattttttggagaagacagacaagatacaagtaacaagatgatgatgtctgtaatatttgggtacaaaatgcaattcataaacctgattgtataatatgatcctatttatgtaaaatcatatatatttagttaccttgattcaatttatacatcactaattgtttccagtaatattaaccaaaggtctactatatgccaaataaccttttatggctagagatagaaaaatgaacaaaacttactatgttcatccttatggaagatacataattcatatttgtaaacatcacatttaagtatggcaagaaatctggtgggatggttcctaaaatgaaacaatagtttcataggtttgtgagaatttaggtgatatttctacttaactttcatgtacactaaaaatttttcctataactcaaaaaaattttttggaggcagattagcaagatatttattttggaaaagcaagagtcaatctgaattgaactggagggatgctgagagttctagaacttcatagagagaaagaaaactgagttattgggtgggggttacacctatctttttgtcttttcttttctttctttcttttttttgagacagggtctccctctctcactcaggctgaagtgcagtggtatgatcttggctcactgcaacctctgcctccctagtagctgggaccaccacaggcatgcaccaccatgtccggctaatttttaaaatttttttggtagagacagagttttgccatgttgcccaggctggtctcagactcctggactcaagagatccgcccaccttggcctcccaaagtgctgggattacaggcgtgaaccactgcgttgggccgcttatcactttaatgtctaatgagaggcccctggagctggaacccttagccccagcctgacccctgacccttctcccatgtcctcaaattcaaaaactcacctctggctgtccattcagttgttctcaagtctgactgtgctctttgtccttcatgaactagaactagtctttctttcaaaccattttgatgagctgatcaatgtctcctcataccatttttctcattcagccttcctcctggggttggttttatttaccatctaacaatatttctgtaaccctgagcctctagagctgcctcaggtgcactaacgctgtgactaggctgccctgggacaagctaagaggttctgcgggggagggtctgggcccctggtgtggcagaaggtgcatccatcctggaggaagccagaggaccaagggccaggagcctgggggggattagaagggaccaggaggcctggtcctgagctgggatgggaaggaacgggaaggggcaggagcaggacagggatttccagatccactcagccgcctccctggggcttgggctcctccatctgaggccaccagggggcggcaagggcttggatttggggaagggaattgctgtggtttaaccagggagtgtatgaagctccatgggctgcttcctcctgagacccttctaagggagaagtggggagtggaatgtccaaaatatgttgtgtcccaatatgttcgtttctagaaaggctaataaatagcctcagcccccagcctcagagcactgcatagaaagaggacagaggtatttgagggtcattctgagagaacctagaaggtattgagtgggaataaacagtccccagctctgcctttggtccctgggaaacagagtgcctggatcactccacagtggtcatctgggatctggtccgaggtctcttccttgattctgttccctgagccttttttattctattttggatcagatccatgcacacgtagctcagagttgtgcccaagatttcataaggaatttacagggttttttccccctcaaacttatttctctccacagtctgcccattatttatggttccccagactttcccttttggtcttctggtgaaaaaactgtgactttaataagcctgcggtgctgtgcacttcctgcaactgagtccgtgtccacaccaaacaccaagaggacaaagagtaacaaaggtaaggggattaagtgccactgtcttggaaatcagctccaaagatgagaaaagaaagtccgcacagtctctactgtccctgctgtcaccacgaagaatttcctggaggctggatcatgtagaatggagagaagaacaaacataagaaaaggaaaacgtggacatttcaaatttgccctgagcactaggggtttcctttctcatcttcaagccagaacagtggagcttcttctggaacttttgtggctgcacactggtaccccttccaggtattggtctgccctgagtgcaggccacaggacactgggggaaaatgggaagctctctgctggtttgattttactaaaagtgctagtatctcccctagtctgcctccagtgatttgcttttccaagtaatcaaattgatgctccatggattctgtcccaggttttacagctgggcttggagaaaatgtggtatatgccactgcatccgaaatggaacctgaaaacagtaataatattctaaacgtgaaaattaaatcaatctgaatcacaggcagtggaaaacatcaaaagatgaaagagttttaaaagtgatttgaggaaagaaacagggagaaatattttcacattggttctatgtttactctatttatcttttttaatttaattttaaaaatagagatgaggaggtctcactatgttgcccagccaggctggtctcgaactcctgggctcaagcaattcacccgcctcagcctcccaaggtgatggattacaggcatgagccaccacacccggcccctgtgtttcttatgtgctccttgattaagaagagttgttttttgtttttgtttttgttttttgttttcttgagatggagtttcacttttgttgcccaggctggagtgcaatggtgcaatctcggctcactacaacctctgcctcccaggttcaagcgattctcctgcctcagcctcccaagtagctggattacaggcgtgcaccactacaccagctaattttttgtattcagtagagacggggtttcaccatcttggtcaggctggtctgaaactcttgacttcaggtgatccacctacctcggcctcccaaagtgctgtgattacaggggtgagccaccatgcccggccaaaaagttggtttattgtagcttgtggatacagtgagatggaagaaaacccagaaagcagaaataacacttctttgtaatatgaggaaaaaaataaaagataaagttgaatgaaatatttcatatatatatgtttcatatacatgtttcttatatatgtttcatatacatgtttcatatatatgtttcatatacatttcatatatatgtttcatatacatttcatatatatgtttcatatacatttcatatatatgtttcatatacatttcatatatatgtttcatatatatattgcaacatatatatgcaatattcatatatatagccatatatatgtttcatatatatattgcatatatatgtttcatatatgtttcatacatatgtttcatatatatatagttttttacagagtcttgctctcttgctctgtcacccaggctggagtgcagtggcctaatcttggctcactgcaacctctgcctcccgggttccagtgattctcctgcctcagtctcccgagtagctgggattacaggaacgcaccaccatgcctggctaatttttgtatttttagtaaaagtggagttttgccatgttggccagtctggtcttgaactcctgccctcaagcgatcctcctgcctcagtgtcccaaactgctgggataacaggcgtgagctatcacgctcggtctgaaatctttagataagtatgaagtctatataaaaaaaaaaggctcttactaggctagaaatggcccattttagaagctttcattttccacctcacactcatctctctatagatcctctgcttgggcagtgggtggaccttgtggtcctcagttctcaggctgagaaccagaggctgaaaaggacaagtcacctgctcatgagtgggaagggcaggattgggagcagcggactgtggctccattgctccttgtttcctccacaggcccctcccacgtgtgcccctgaatgacctagaatgactaatgtgctcaagggatttgatgctgcagatgcttcggcatgaagggtgggggtggggatgggacaaggctgcagctgaagagatgggagaccaacaacacacagcaggggtttccatggggtgggcacccccatttcctcacagtttagagagcctggaggtgggtgccaagcagagggcaccatggcgtggcccaggcctggaggttcacagagacacaggcacaacacagcagagacactgagggccaggagctcactcagatgagggacttcagcagatctttctctcttgaggaaattaggtacaaaggaatcaagttcctaccatcagaatagacaacaagttttaatctcctcagctgagccccgctgtcgagggaagcagaagtctctgagcccggcccaggtgagagtggggtgaggagaggagctcagggtgcagatttgcatgaaggccccaccctcctctgaggcagaggggataagacaagtctgggggtaggcccagcgctggggtctcaggaggcagcgctctctcgggacgtctccaccatggcctgggctctgctccttctcaccctcctcactcagggcacaggtgacgcctccagggaaggggccttggggacctctgggctgatctttggtctcctgctcctcagactcacctgggcccagcactgactcaccagagtgtatttctccctctttccagggtcctgggcccagtctgttctgactcagcctcgctcagtgtccaggtctcctggacagtaggttactatcttctgcactggaaccagcagtgacattgggggttatgaccttgtctcctggtgccagtagcacccaggcaaagcccccaaactcatgatttatgatgtcgctaattggccctcaggggcccctggttgcttctctggctccaagtctggcaacacggcctccctgaccatctctgggctccaggctgaggacgaggctgattattactgcagctcatatgcaggcagctacaatttccacagtggtccaagttcatgcgtaatgagaccaaaacctgccctggtctctcaggctctctctcgctatgaaggtgcttccttaccctgtgcagaagagggtttcatgcaacatggccttgagaatttcatccactctcagcccctctcccctccaacaatgaaatgcaaaagaaacatgctctctggttaattgtctagggacaatggcagcttcttcttttcctgtgtgatatggtcctgcatggtgactctttccaacttttcaatggcagggacagagcaataggatccatctgctcagtaccatttctgcagttttctatgaaaccctcacattaaatgcctccatctcccacactgtgctgactggcctgggtctgtgctccagaaataacgtcttactcaactccatatccaccacgctgtagtaaggatggctgtctttgctgggttatttgttcctctgcaggtctcttcccaaagcaacaccaactgagagaagatctgaagatgttgagagagtgagcataaaagtaaagggttttatttatttgctttcttttttttttaactttgtttttatttatttttttgatacagagttttgctcttgttgcccaggctggagtgcaatggtgcaatctcagctcactgcaccctctgcctcccgggttcaagcgattctcctgcctcagcctcctgagtagctgggactacaggcacgcgccaccatgcccagctaatgtagagatggggtttcaccatgttggcctggctggtcttgaactcctggcctcaggtgatctgcccacctcagcctcccgaagtgctggcattacagacatgagctaccatgcctggccttgtttttattttttagagttcctttgtctttgacccgatgtctatctatgggggcttagccagggcacatttgagtgattgttctttgcgagaacattgttctttgcagatcattaaacccctgtcctggaaacagtcctgtacttagactgtctccctgttagcatgggctctttcctaaatgatccacaggaaagcttatttggtggatgggtcttctgttcctcaaggactctatgggtagtttattttcaaggtgagccaatactgtttctagctggaatctcatttaatctcataaccatgagaattaattttttaaacctgcagggtgttctctagccattttttaattttctttgattttgtgagccacttttaaattataatcatcattaaaccttaaaacatataaacttcaattaagcagattatatattttattttattttttgagacagagtctcggtctgttgcccaggctggagtgcagtggcacaatcttggctcgctgcaaactctgactcccgggttcaagtgattttcgtgcctcagcctcccgagtagctggaattacaggcatgtgccatcacgcctagctaatttttgcatttttagtagagacggggtttcaccgtgttggccaggctggtctcgaacttctgacctcgtgatccacccgcctcggtctcccgaagtgctgggattacaggcatgagccatcaagaccagccacatatttttaaaaagtacattggttattatccacatacctttggactgctataacacaataccttaaactggtggcttataaaaacagaaatgtatttcttacactcgtggaggctgggaagtcttaagatcaatgtgctggcagatttggtgtctaatgactgtctgcttcctcatagaggccattttctcactgtgtccttggaactgaggacaaagcagctcctggtaaagttcagatgtctgtttcttgcaggaaaatttctctttacagtgatctgggctactggctccaacacacgcacccagatggatttctgagccggtcattgaccattaccattttaatattatctcaaattataaacattatctcaactattgtttaatataatatagcacataaatgtttaaagcatacatagcgaaacaagggtcttacattcaaaactgtcatttccccaatcacccatctccttgtccaccaagccccagtgccaccacttagctcattgctcctttggcttcactttctggtgctcttgcaagtgtctgtcatgtgttacaaacaacaacaaatagtcctccaagaacgtttacctccatagaatccctatcctgtttcctgagtggacatttccatttttaatctggcaaagatcagtcagccctgattagtgttttaaactcatatccatctctttctagaaaaacacactaggttaagcatctctctgtggatgggggaccctcatgaaggcacacagctctgagctgaggtggcctcaatgtgtacaatggagcaagacaaagaaaagtcccatgttctgtgtgatagacagacaggcactgatgagaggtctccagagctggcgcccttagtctaatcttgactctagtcctcgtctttccgacccttaaacactagaattcctggtctgcattccattaggtcattcttaaatctagtgagctgtatctccttcatgcaatgtttttctttcactattattttcagctttattgacatataattgacaaataaaaattctatatatttatggtatacaacttgatatattaatacatttgttgtacattgatatatttgttgtgaaattactgcaataattgtgtgaaatcacaatcaatctaattcacataaaataaccttacataattatcatcttctttcttttttttttttttttggtgagaacacttacaatctaccaaattagcaaatttaaagtaaataatgcaatattgttaaccatagtcacattgcggtacattagctatctagaacttattcatcttgtatcactgtactcttttataccctttgataaacatctccccatttcccttttccctccccagtcctgacacccaccattttactctctggttctatgagtttgaatattttagattctacatgcaaataagatcatgcagtatttgcctttctgtttctggcttatatcagttaacataatgtcctccagctttatccatgttgttgcaaatgatgggatttcctttattttttaaaacttggcaatatttgtgtgtgtgtatgtgtgtgtatgtatgtatgtatgtgtgtgcatgcaccacattttctttatccattcatttgtcatcagaaatttaggttgtttccatgtgttggctattgtgaataatgttgcaaaagacatgggagaacagatatctattcaagattctgatttcattttgttttgagatatgcccagaattggtattgctggattatatggtagttctatttttaattttttaaggaatccccatacattttctacaatggctgtttagtttacattcctttcaacagtgtacaagagtttcttttgtccacatccttgccaacatttgttatcgtttatctttttgataaattacaggcacgtgccaacacacctggctaattttttatatttttggtagagacggggtttcaccatgttggccaggctggtttagaactcctgacctcaagtgatccactgcctcggcctctcaaagtgccgggattacaggtgtgagccaccatgcctggcctattttttctatttctataaagaatgacatttgtgtattgataggtctagcattgaatctggagatcactttaggtagtatgaacatttaagaatattagttcttccaatttataaacacgagatgtcttgatatttatctgtatcttctttaacattcttcatcactgttttataatttccagtgtaaaactctttcacctccttcgttaagtttattcctaagtactaattccttttgtaaatgtgattgctttcttaattttattttcatatatttactgtctgtgtgtagaaacgtcatcaatttttgtatgttgatttttttatccttcaaatttacttaatttagttttaacagactttttgttattgtggagtctttaggtttttctacacttatgtttatgtcatctgcacacaaagattaggattttaatccttcttttccaatttggatgcgtttcatttctttttcttgtcgaatttctctggttagggattccagtgcaatgttgaattaaaataagtggagagggggcatcttgccttgtgtgggatcttaggggaaaagcttctgtttttttcccattgattatgatgttagttgtgggcttttcacatatggtttttattgtgttgtggtaagtttcttctgtacctatttcattttatttttgtttttttaaatatttattttataatagagattaattttgctatgttgcccaggctggtcttgaactcttgggctcaagcgatcctcctgccttagcctctcaaaatactgggactacaggcatgagccactgtgcccggcctatcactattttgttgagagttcttttcttttcttttccttttttttccattgctttcttttcttttcctttccttttttcctttccttccttttcttttcctttcttttctcctcctcctcctcttcctcttcttttttctttcctcctcctcctccttcttcatcttcatttaaaatcatgaatggatgttgaatttggccacatgccttttgtacatctgtggacataatcatatgtgtgtgtgtgtgtgtgtgtgaatctttcagcctgtggatgcgctataccatccttgcacatgcggaatcatccttttatccagggataaaccccacctgttcctgatgtatgatcttcttaacatactgttgaatttggtttgctagtattttactgagaatttttgcatttaatatctgttaatgtttatcagaggtagactggcttgcagttttttttcttttctggtgttgtctttgctttgttttggtatcagggtgatcccgacctcataaaacaattttggaagtgttcccttttctattttttggaagactttaagaagaattaatattaactcatctttgaatgtttggtagaacattcagctatgaagccatctggtcctgggcttttctttgttgagatatttttgattattgagtcaatctccttctttgttattggtatgttcaggctttgtattttttattgatttgcttttttttttaagttgactgtttctaggaatttatttatgtcttttaatttatctagcttggtgtataatttttcaaaatagtcccttatgatcctatttatttatttgagacagggtctttctctgtcacccaggctagagtggagaggcttgaccacagctcactgcagccacaacctcccaggctcaagtaatcctcccacctcagctttctgagtagctgggactacaggcatgcaccaccatgcctggataatttctttttctttctttctttcctttctttcctttctttcctttctttcctttctttcctttctttcctttctttcctttctttcctttctttcctttcctttctttctttctttctttctttctttctttctttctttctttctttctttctttctttctttctttctttctttctttctttctttctttctttctttctttctttcttttcttcttttttttgtatagatgtgacctcactgtgttgcccaggctggtcttgaattcctgggctccagagatccacctgcctcggtctcccaagtgttgggattacaggtgtgagcctttttatttctgagaaatctgttgtaatagctccttttttcattttggattttatttgagtcttctctcttttttcacagtgtagctaaggatttgtcaacttcgtttaatttttcagaaaaccatctcttagttttgtttttttctattatctgtttgatttatttctgctgtaatctttattatttcatttttttctgctaagtttgggcttagtttgttcctctttttctagttcgttgagttataattttaggttgcttatttgagatctttcttcttttttaatgtttgcttatctccataaacttcccacttagcactgcttttactgcatcctataggtttggtgtgctgtgttttaattttcatttgaagatatttttaaaattccctttggttttcctctttgacccaatgcttgttcaacatgtgatgtttgatttctgcctatttgtgaatttttccatttttttttactgttattaatttccagattcatttcttgttgtaaaaaaagatttttggaatgatttaattctccttacatttcttaagacttgttttgtgaccaaacatgagctctctcctggagaatataccctgtgcatgtaagaagacattttgagaacccaggtggtcttttctcataccatttttctcacccagtgctcatactgaggttagttcattttacatctaacattttctcagcctggagctaagacacctcatgtacctttgacaaagccattctagcacaagcaaaacggtcctgagaacgagtatcttagccacctggtatggcagaggacacattcatcatggaaaaagtctgaggaaaagggtcaagattagcatggatcgagggtctggtcctgagctgggaggagaaaaaggcaggttggagtgggaccaaaccaggtatttctatctctcacttagaattgtgtcttggtacttgagatgaaccatctgaggccaccagggggcagcaggggactaggttggagaagatgattgataaagtttatcctgacctttaagaagcccctgagtcggccgggcgcggtggctcacacctgtaatcccagcactttgggagactgaggagggtggatcataaggtcagaagatcgagaccatcctggccaacgtggtgaaaccccgtctctactaaaaatacaaaaattagctgggcgtggtggcttatgcctgtaatctcagctagtcgcgaacctgaggcaggagaactgcttgaaccagggagttggaggttgcagtgagccgagatggcgccaccgtgttccagcctggtgacagcgcgagactccatctcaaaaaaaaaaaagtccctgaatctcaaaaaaaagaatgtgactttatgattaactatgaacagctgctcattaataaaaagccattaaaaaaaaaaaagaaatcccaagagctacttacccttgaatatctctaaaggtactgggaagcagtgctccaaatctgttgtggcccagtgaattcctttttagaagcaccattaatggtcctagttcaacatgtcaggccccagctttaaaccactgcaggggcaggggatgtagcagtgcttagaacccaccttagctgagaggaccaagatggttgggcaggggatgagggaaatgagaagttccagcactgtctgaagtctctgggaggaggagtgattgaactttcccacccggcctgggagcagcctgtcctcacattcatccctcacagcacaaaggagaagtcctggtttcctcagcctggagctcctgcaatagtgagggttaggatatctctggactggcctgatgtcctgggcactctcatgggttcagtctcaggaaatccatgcctaggctggattaataccctcagctgagcctcacagggaagcagaagtctctgagcccaggcccaggtgagggtggggtgaggagaggagctcaggacacagatttgcatggaggccctgccctcctctgaggcggggggataagacagggctagaggcaggcccggtgctggggtctcaaggcagcgctctcgggacatctccaccatggcctgggctctgctcctcctcaccctcctcactcagggcacaggtgacacctccagggaaatggccttggggacctctgagctaatgcttggtcttctgctcctgctcctcagggtcactggacccagtactgacccagtagagtgtgtttctccctctttccagggtcctgggcccaatctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttacactttccatagtggtccaagttcctagggaactgagaccaaaacctgccctgggctctcaggctctgtctttgctctgaagatgcttcctcaccctgtgccaggggcttcctgcaacagggccttgagaattcacttctctgtcagctcctctccttttccatcaattcccaaaggaaacctcctctcttgtttactctccgggatatgacagcttcttcttcactcgtatgacggatgtcctctctgaattggaaactacttctagctctttaacaggaagtacataccggcagggaaatgcctgcctagtgcagtccccatacttctccggatgatcctcactttattatttatttttatttttgtatgcactaaagtcgtcaatgtaaatccttacgtcgaatgcctccacttcccacattgtgtagcacagcctggattcagttcttcagaaatgacgtcctcttcaatgataaaggaccactgctctgtgaacaccccactctagtgaagatagcccaccttgctgggttattcatgtacatcttttgtggaagcagtaaccactgtgtaaagctccaaagatgttttaaagcaatgaaaacaaagaggaagaagtgtgtgtgtgtgtgtgtgtgtgtgtgtgtgtgtgtgtgtgtgtagggtccatcctgtttgccctaatatctcaggttgccgagctagggagtatttgagtgacagacttggtgccctctcaggatcctcctcctctcacatcactgagtccctgtcctggaaacaccctacaggtggacaatctccccatagtatggaagtttccaaaatggctccacagggaagagttgagctgaacacacccactctttctcatgggcatcaaatatatctaatttttctggggaaatcatcaatttctagctggaatcctgattaatcgacagactgtgagaattaaaaattttaaaaatattcagacatatccagagtccagtatttaaattctctggaattttgtgagccaatctttaaacatagttattattgtagtttagagttcatgaacctgaattaaatagattctagtaaacataaagtgccttagttgtctattgttgcataaaaattactcctaaaattaacatattcttaatgagaacacatatgcattaatctgttttcgcactgctataaagaaataccttatttataaaagaaagaggtttaactggctcacagttccacatggctggggaggcctcaggaaacttacaatcatggtagaaggcaaaggagaagcaagaactttgttcacaaggtggcaggtgagaagagctggggagggtgaacttccaaatacttttttttttgagatggagtctcactctgttgcccaggctagagtgcagtggcgtgctctcggctcactgcagcttctgcctcccaggttcaagtgatcctcctacctcagtctccgagtagctgttattacaggcatgcgtcaccaagaccgactaatttttatatttttagtagagatggggttttaccatgttgaccaggctggtctcgaactcctgacctcaagtgatttgcacacctaggcctcccaaggtgctgggattacaggcgcaagccattgtgcctggccccagacacttttaaaaccatcagctctcatggtaactccctacccatcacgagaacagcaaggggaaaactgcccccatgatccaatcccttccgtccctcaacatatggggattacaagtccctccttcaacacatggggattacaatttgagaagagatttgggtggagacacagagccaaaccatattaatgtatttgtgatcttgtagttttcttgcatcaagaatctgagagctgcttagtttggtggttctgactctgggctcctcatgaaattgcagccaagctgtcaggcggggctgcattcagaggccagagcaggtggccaggcccagcctgagggggcttctactgtccctaacctctttggcagatgtagatgaagtcagggaaaaggggagctccccacagtgggtagcatcccagtgtcagagggaaggcaccatggagcagtgggaccagcacaggaccctgggggtgcactcagacctacctggagggatggcaagaaggggcattcacagcagggacaggataaagggcctctgccccatgtccagagctgtcttggcagctcagtcacattggttatcaggtaaatcggaggtaaaccctatcctgagttttaccactgaaaatgggtacaatttgaactaggagtgttttcagactttttctttccatattgacttcttaataaccgcgatttaattttttttaaccccagcctagtttagctacatagcttccaaatgtcatgctactgtgaaactgagcaattagttacttttatcagagcattttaaatttgaacaggttccttggtctttctatgtgtaattagtcaaagcttaggtatggagtagaggatctttaccaaatgcttttctagactctgttttcattggacttatagcagctgtttcacctgggccatgcaggaataggagagttgttgctccttgacatagcatctgtaacatgcctatcctttctgccactataaaaatagctgtgctttctctccactcgtctctcctgctgtttccctgtttttcctattaaatatgcagtgtttgcaatccatcttgcattctgagaagatgaggattttttttcataaagaatgacctaaaatagctctaaagatcatcagaagtcacaactacatacttactggagtgcaataccaaatgtggcctctgattacagtaacctggagcttgcagtttaagcaattcagtccctgtcacttgtggacagattcgtatgtctgtggatgagaagatgagcaacggtcactcctgtgctcatgcacagatccctccctgcccctgtcctcaaattcagactgaagtgcatggccctggagcattacatgagtgatggtttaagagcacgttggtgatacacacaatattaatggtatcttaatttgcttgttaagcataatttgaaaacatctggacaaatttggacacaatttgaagggcatatttgataatagcttgtgacaaatgattccgttctgggagagatgctatttttggttctctaaatcgccatgaaatgaaaatctcagattataaagaaatagactcaaatcccaagtgtcttttgcttttcattccccatcaactgtgttgcccaagcaccatgtggacactgcttacagggtaggcagccaccagctgaaggcaggttctttagttgtctgagctgtcctggagctgggaacagcagcgtgtgttctgtgcctgttggtccctatgtagcacacacccactgcatattctcgctgactcaccaggagggcttgcagcagccctggcctattttcttctgaagcacctgccaatggtgcattctcccctggtcataatgcaccaggagataaacatggcatttgacacacaggtgctaactggatctaggacttctaagcttaagtagactcagagtgggcaatctaaaaaaaaaaaaaaaaataggttctcaatcggtagcccaggctggagtgcagtggctccatctcctacctcagcctcctgagttgctgggacaacaggtgtgtgccaccatgcccagccaacagagagggcaatatggacttgaaatggacaatttccattacttgaaagtttttgagaaagaactgaggtttgtttaagaggaaatcagccagagactcaaagttaaatctatcaggcccaaagtctctttggggaaaggagactcttggacgtgcacgcagcagcaagtggtatgggatcccttctctgtggggaccttggcccaactgccaatcttttcaactgacccatttgcgttttccataagtgctcgccagccagcagctgtgactgcccctcagtctcaggaagggagaaagaaggaaacaggagcaaagcctctttcaatcttagcaaataaagtgggagctttgacttttttgaacacccagatgacaggaaagaggaggaaaattttcctaaagctgttattttttaatgcctcaggaagaatcacacccggagtctcatccacactttatttggaggtatttgggtctcagagtttgtgctgagttagttaatgatttgggctactgggatggggtgaatgtgttttacaagtgagaaagaaataagctttggagtccacagggtggaggcttattggctaaattgtgtccctcaagattcatgcaatgaagccttaatcacagtgtgtgactaaatttggagacagggtctttatggaggtgattaagtgaaaatgaggtcatgagggtgggttcttatccagtctgactggtgttctccttagaagagaaaatttgcacacacagaaatcagacaccagagatgagcaggcggaggaaagaccatgtgaggtcacagcaaggaggtaacgacctgcaagccaaggagagaggcctcagggaaaatcagtcctaccaacactttcaccctggactttccagcttcagcactgagaaaataagttttgctgttgaggccactagttctttggtatcttgtgatggcagcactggcaaatgaaaacaagagggaccccaaagaccttgggtagggggaacagatggagcagggtgcaggaggcagggcagggaggggctggaaggtcatgctctgaggttcgtttcctggatggaactgggactccactcactactgtctggggaacttggggaaaaaacttcacctcccaatattgattccctaataaaatctgggccctgagcatagggctcctcatcttcctactccatatgatgcaagttttcttgaagttatgcttgtaaaacactcaccaatgcatctggcatatattaagggctcaaaagtaggccaggcatggtggcttatgcctgtaatcccaatactttgggaggccgaggtgggggatcactggagtccaggagttccagaccagccaggccaacatggtgaaactccatctctactaaaaatacaaaaaaaaaaaaaaatagctaggcatggtggtgcccttctgtaatctcagctattcaggaggctgaggcaggggaatagcttgagcctgagaggcggaggttgcggtgagcccagatggtgccattgcactccagcctagatgatagagtgagactccatcacaaaaaggaaaaaaaaaaggttgtcattctgcagcccagatcgtgccattgcactccagcctggacgatagagtgagactccaccacacacacacacaaacgcacacacacacaaaaactaacccccgccccgcaaaaatcgaaggtagccattctgctgtatgatctattgatacatacaggatgacatttgtcctgtgggcaccagggggcactgtgacccctggtttgggacactaatggctccaagtccctggtagtacttgagtcatttcctttctggccccttctattgagtggaatcctgaaacccacctgactcttctactcttgaaaaattacgcagagaatgtcctcagacatagggtcagacaagaacttcgacatacattttaaagaatggagagcagatttacatccgctgcttaacagggaaccaactaacaaagaattaagaataaaggaagtagagttgcatgaagagactcccctttctatgataagaaaggcctgaaggtcccttcccagctgtggactcagaggcagagctctggggcatttccattatggcctggacccctcccctgctcgtcctcactctctgcacaggtgctgcctcccagggctcagcccccagtgggatcaagatcagcctggccctgaccttcaactcaacatagggagtgatgcagggtgtggggttctgggaatgaggccctcatcctcagactcacctctcctgtcctctcttgtgggctccgttatttcctctgggccaactcaggtgcctgcagtgtctgtggccttgggacaaatggccaggatcacctgccagggagacagcatggaaggctcttatgaacactggtaccagcagaagccaggccaggcccccgtgctggtcatctatgatagcagtgaccggccctcaaggatccctgagcgattctctggctccaaatcaggcaacacaaccaccctgaccatcactggggcccaggctgaggatgaggctgattattactatcagttgatagacaaccatgctactcaactcacagtgacacaggcagatggaaaagtgagacacaaaccctttttctgtctgtgtcactcacttcctccggccccagcaggactgtggacacagccatgggcaggtctggctcagttttcctggatctgagaccccagggtgccctgacctccaagccctccagggagactctgaagagagtgggttaggtcaggagaggacttggggctggcaggaccagactgtcctggtattgtccagagtggctgtgtcttggcttaagatgacctgagtgtaaggatagtcagagggagacagccattgagtggtaatggtccctggatttccttctgtatggtgactggacctaaggcagtgctgcttttctgtggcccaaatgccccagatcattctgaacttctcaggtttaactgagaccctcaagccccagctccatgacatcctcatattctgaacagggagggccaccacaatgggcagtgtggtgtccatcaagattcccctttcagggctcacccatccgccatacacccaaagctgccgggaggccctggcttctcacagctgctccccaccggaaaatgccattgattgcaaagaatggcctcccccaaaagtttgcccatgtcagagcgtggctcaggtgcaatgactgcttgatgcctcaatcccaaagtcaggccttaatttaggatggccttgaagtgtgttgcagctgagcactcaattgtaacacattcccactcatgcctcccatacttctttcctgagaatatatccctaaacctcactgcatggaattccccctctcagagtaggagtctggggaattaaaagatttaaaaacaaaccaaaacagtccaaagggaagagtaacaaagaggagagagttgcacagagagaggactctggagtctgcaaatgttcgtgagcaccgatgagcacatatgtgggaggaaacaacctctggaagagaaaagaaccatccaaagacacttgagagaacactccagagcgtgtgtgcacgcacacacacacacactcacaccccacataaagaaaacaacaacactcatcatcatcaaattgctaaaaaacattttagcaattttatgctaaaatgatgatgaagaaatgtggtgaagaaatgtagccttaaaagtagccagagagacgaggtggctcacgcctgtaatccaagcactttgggaggtcgaggcaggtggatcacctgaggtcaggagtttgagaccaggctggccaacatgatgaaaccccgtctgtactaaaaatacaaaaaagttagccggatgtggtggcaagcgtctataatcccagctactcgggaggctgaggcagggagaattgcttgaacctgagaggttgcagtgagctgagatcgcaccactgcattccagcctgggcaacagagcaagactcaatctcaaaaaaaaaaaaaaaaaaaaagtcagaggcaaaagacatgttagatacaggtgaacacaatgacaagagcagaatttttattagaagcaatgcaagcaggaagtagtggagctatatttataaaatatgaaaagaaaaaacttataacccagagcaatctacagcctcactgaaatccctaccaaaataccaatgacatacctcacagaaatagaagaaaaaccccacaattctacaatttgtatggagccacaaaagacccagtatagccaaaatgacactgagcaaaaaacaaaactggaggcatcacattacctaattcaaaatatgctacaaacggccgggcgcggtggctcacgcctgtaatcccagcactttgggaggctgaggcgggcggatcacgaggtcaggagatcgagaccatcttggctaacacggtgaaaccccatctctactaaaaatacaaaaaattagttgggcgtggtggcgggctcctgtggtcccagttactctggaggctgaggcagaagaacggcgtgaacccgggaggcggagctggcagcgagccaagatcgcgccactgcactccagcctgggtgagagagcaagactccgtctcgaagaaaaaataaataaataaaataataggccatatgtgatggctcacacctgtaatcccagcagttaggaggccaaggtgggaggattgcttgagcacaggagtttgagaccaccttgggcaatataatgaaaccctcatctccacaaatttttttttttaaattagccagccttggtggagtgagcctgtggtcccagttacttgggaggctgaagtgggaggatcacttgagcccaggaggtggaggttgcagtgagtcatgatcttaccactgcactctagcctgggcaacagagaaagacactgcttcaaaagcaagcaaacaaccaaaaaatcaagtaatatcattgaaaagggggcaaaggatcagaatagacttttctcaaaagaagataaacaggtggccaacaagcatatgaaaaaatgctcaacgtcactaatcatcaggtgaatgcaaatcaaagccacaacgagacatcatcttaccccagctggaaaggctatcattaaaaagacaaaaaaataacaagtgctggtgaagatgcagacaaaacagaagacaaaaaccacgtgatcatctcaacagtcacatcaaatgttttcatgtagggaaacattactgtttgtgattttccagacttgctagagcatcataaaaagtaagatttgtggtgccgatattggagggggtgttattctgtgcaaaaaacctggatatcccatatccaactgtgaagatacttactgataaatgctaaaaaattgcaatattgtgtgtccaaatgttctgggggtcaggagtggggtctcacacgggaaaggattcagtcaaagagaaaaatagagaggctagaacatagaggaaaacataatatgtctggaaataaggagtccaaactaattggagctgagtgataacaaaagaacaatggcatgaaccatctatttctctctggaaatctcattgatatattgtgctctctccagggctatgcccagctagattataaaattgtctgttcctgaaacgtttcttgcgtatatgacagggcctaacactggaatcaagctcaggttgatgagggcagggcagttaagcacccgaccctggtggcctgtgaaatacttgggggagacaggggtttgttgtctaaagcagaggaagtgagattttccactgtggcttagaccagagcttctgaaattccagtgagcaaacaaatcccctgtggagtctgtttaagatgcagatgcagcctcagcaggtctgcgtggggccccagagtctctatgtccagcagctcccaggtgaggctcatgctgcttgtcctccaagaaccacactttgagtggcttaactcctattcgccctcctcactcaagcacaggtgagactctgccaaggaaggcactgtctgagaagcaaaggtgaccttctgtccttcctcccctggtgttttagtccatgttctattgccataaaggaatatctgaggcagagaaatttataaattttaagaaagatttctttggctgaagcttctgatggccggaagttcaagagtgggcatctgcatctgttgagggcctcaggttgcttccactcatggcagaagatgaaggggagccagtgcgtacagagaccaatgggagagaggaagcaagtcttttcctaacaagaatgcagggatgtaatttaatcatatttataaagtgtttgacatagagcctgacacacccaggtactcctagttggcagcaattattactgtcgtcgcacatgaaaattggacctgggatggaggaaaggcagcgcaaaccctctgtttgggacaagagagacttaaataatttaaaattgaggcataggagataaggagagtatccctgggtgttctcctgccaattctctcagcatctcggaaactgtttcaaggtgatgaagtcaaccagagagggaagcggaggagtttgtagaaccaagggttgcaacttcatccatgaggaggaggtgtagtcaggggattgggaagaggtggctgagctcatctgaagggtgtctaaggttttctggcccccatgtcctggcccatccctccctgcccagggtctcacccctcacctgacagcccagagctggagagtggcctatgattctgattagagaccccaccaaagcccagaggggaagacatgggtgggaggcgtcacagaagacagttttctgcctgtggtgttggggcagtttcctggaaaggaaattcagacactgtaggggagaagaaaacacaggagaggaaggcccctccccaggggattgtggcgttagagaccaaagcatcttcaagaagcccagccctgcaggaggttccctgagcccagagttcctagagctgtctgtattattttgcctggggtgccataaaaagtaacacagactacatgactcaaagaacagaaatttattgtctcactaatcttatggcgatggtagaatctgagatcaaggtgttggcagggttggctccttctgaggctgagggagggtctgtttcatgcctctcccctggcttttggtggtgtagcagtattagctgttccctggcttataggtgaatcaccccaatctctgcctccatgttcatatgacgttttctctctgttcatgtcggtgtccaagttttttctttttataaaaagaccagtcctattggatttggggctcactctattccagtatgacccgatgttaactaatcacatctgcaaccacccttttcctatgtaagttcccattctgaggtcctgatggatagcacttcaccatatgaattccagggggcacaaaattcaaattcccaacaatgggccaggcacggtggctctttgggaggatcccaaatcccagcactttgggaggccaaggtgggcggatcacatgaggtcaagagttcaagatcagcctggccaactggtgaaaccctgtctctagtaaaaatacaaaaattagctgggcgtggtggtgcgtgcctgtagtcccagctactcgggaggctgaggcaggagaatcgcttgaacctgggaggtagaggttgcagtgagccaagatcgttccactgcactctagcctgagcgatagagtgagacttcatctcaaaacaaaaaacgaattcccaacaatgcctcagacatggcttaagctgcccactggggctctgcaggtgggatgtgcaccaccaagctctcaggtggggcattacctgacagcccagaaggactccgggccctctgcaaagtgcctgatctcttgcgcaccttaaaaggtagcttttcaggctgttcttgttcttttcatgctgacgtaggagattttatcctctgctttttaagtagaagcttccttaccctcctcatcatcctgagtagatgcctaggctggtttcagagaaatcaaaccagggtggattatgagttatattagccaccagctgtcaatattctctgaatgcccagcatccatccatgctctctgaccatcaccagagtgagcaaatctctgacatgtggataagagtttcttccatgggctcccagccaggctgtaagtgagaccagaatacccttccttcagtgcatggggctcagtgcagctgcctccctgacagtctccctgggacattaagcttgtcagcttctctcttccaaatgcaggtctggttgtcctaagcccagctcagcgctgctgtggactttgcatcctaaaaacattatcaactctgccttgtgcctcagtggactggcctggaggaaacaatatgaggtgtcctggctctttccacccccagcgtctctctccctcagtggtaccagtacggtcctcatgacggttcatctatacctgccaatctaggcctccacactgccgactgtggatggtcacagaacccaaaatgctaatcagccttaagcagatcatgctaatagtttctgcagatctgggtgcctcatcccagatctaggagttcacaagctaggccagctccagggagataacatgtatcacagagtctggacacgacaaagtggctttgctgtatttttgctgggacacatgatggtgatatcaataagaactggctcaggtccctgcagcttaaggcccattgaacaggaaagcagccaggaggatgtgctgccttttgacctgtacacaaatcagtgccatgtgccgactgtgtgtgaatatctgtgcctgtgtgtatatttgtgtacatgtgtgtatgtatgtgtacgtgtccaagttggtgttgcaaggaagtgttcctactgtcaaatgtttcaaactcaaatcttttctgttttcctaacttacctgcttcttctatctctagtgcctttgttctgcactaagaataaggatgaagattagggtagtaatactagcaggaggagtaaagattcatatgtgtttaatacatatcaagcagtcttccaagtacttcatatttattaattcccttcatctcaacaactctatgagttgttcattatccctccgttttacagttgggaaatctatgatacatagattttgagaaatgggaaaactaatgcagagaaaagaagaataacatgcctgatgtcagaactagaaagtggctgacccaggagtagaatctcaggtcttctggccccagaaaacctgttcttaggcaccatcctgtcgcctgtcattgcatcaatgtggtaaggcattggtgtgtctttaaggctccagaaagttctttctactttgtatttattttgttttgtttttgagacagagtcttactctgtcacccaggctggagtgcagtggcaccatcacaggtcactaaagtctcaaccttctgggctgaagagatcctctcatctcagcctcctgagtagctgggactacaggtgaatactaccatgcccagataattttaaagtttttttgtacagatggggtctcactatgttgcgtaggctgttctcaaactcctgggctcaaccaatcttcctgcctgagcctcccaaagttctgcaattataggcatgagccactgtgcccaacctttactttttaaaagtatcatattgtgactttgagtgcaccagcagtgctctagtgctggtctattagaaatgtaattttaagaatatatatatataatatacaattttttagtggccacatttaaaaggtaaaagaaacaggtggaatttatgttcataatatattgtgtttaaatgatttatccaaaatattatttcagcatgcattcagtattaaaatattgagatatttattttatttttgtactaattctttgaaatctggtgtgttttactcctacagcacatcttacctcagactacccatgtttccagggctcagtagctccctgggactcatggccgccatattggacacagcaagtccagatggataaaggtccatttgggtcacagcccctgcagtacatactgacagctacctgggaagaatggagagttccatgacccaaagggcctcctgagggaggaatggcagctctactttccagccaaagcaggaatattgagggcactaagaaacaagggaatttttacagtgtgtttcacacttcttcccttctcaaagacattaaatataacttcaattttaaaggtgaacctcggccatcaaaggcatgttttctattggtctctttccggtggaatgaatggcaatggtccctgtaaattgtgctccaaggatccctttcagtgggaagattcttgtgataagcccaataacaagtaagaaagcaattttttatacatagatctagaacaaaaagggctcatgatgaagaatattttattgaagcttagtgtattgctatttttcataaattgctgtttttgcctatcccacaagcactgatcacttttatgaaggtacattctccaagggtcgtcttagcatgtcaggacccacaagcaaaggtgttacaagtgacctgcacgagtggccagcaggacacctggaggagcccagtgagatgaggagtggatgcgcatcaggtgggaaggcatggagaagctgtgtgccacacactcaccaaggacaggagcgggcgtatttgtggcctgtggcctaatcttaggtcagttacctctttagactaaatcccaaggagtcagcacatggaggtttcggtccgtgcacatggcacctacagggcttcacatgacgttgctaattacaatgcagcggcacttacaaaggaattagtttcatcacatcctcagcagaactaggtctaaaaaccaatatatatgtataggatatcaggtgagaaatactttcttgccaatcatgtgtattaacgttaaagtggttcagtatctagtgtgacagttgttcaggcttagtggccttgaccacgtcaaaaatggaatcctgatcctaacttgtctagagattagcctggcacaaggagcatgaccaggcatctggatgtccccagtgtcactgcagacacatgctcctttttcatctgccagagggagcattaggatgtcctcacctctgtccccagaactcaggaagggcagtacacctgactaaagagtagagggttgtgaaaagagggacctagggcactggataagcaggaggagaaggagcactgggtgggaggtagagaaaggagggggctgaatggttaggctctgaggtgtgtctcctggatggagtcttggattccactcactaccatctgagaactttgagaaaaccgtgtaacctcctgatgttgggtctcttgtcagtagacatcagtgctttcctgatgtatagggttactgtagaattataatgaatgcctggttgaggtgacatgtctaatacaccctccaaagcatcaggcatatattaagtactcataagcaggcattctgtgtgaactagtcatacatggaagatgacattccccgtgtgggcacagtaggatgctgtggactttggtttggggaccctaataacttcaagtcccctggtagcacccaagtgtaaaaggcaaagggcatgactggtgcttcctgtgaggcctcttctatttggtaaaattcactctccactcatcgcacccacctggcctttattctaaacttggaaaattgctaacatgaaggtctcagcctcagggctcagataagaactcagacacatcaatagagaggatggctgaggtgcttggccgagctcagtgaacaccccagaacaggaactgaggagtgtatgcatgtgttgggggcagcactttctcactcatccagaaagtgtgaggaatctgtacagaactggggacagggcccatttttatacccttctataagcccagcccttgtctgctcactagggagccattcaccaaggccacaggagggaaggaagtagatttgcatgaagagcatccccttcctatgttaagagaggcctggaggccccttcccagctgtggactcagaggcagagctctggggcatctccaccatggcctggacccctcccctgctcaccctcctcactctctgcacaggtgctgcctcctagggctcagcccccacaggaccaagaatcagcctggccctgacattcagctcagcacagggagtaatgcagggtgtggggctctggaaatgagacccttatcttcagactcacctcttctctcttctcttgcaggctccgtggtttcctctgagctgagtcaggagcctgcagtgtctgtggccttgggatagacagccaggatcacctgccagggagacagcatagaagactccgttgtaaactggtacaagcagaagccaagccaggcccctgggctggtcatctaacttaacagtgtccagtcttcagggattcctaagaaattctctggctccagctcagggaacatggccaccctgaccatcactgggattcaggttgaagacaaggctgactattactgtcagtcatgggacagcagtcgtactcattccgcggtgacacaggcagaaggggaagtgagacaaaaaccttttctccatctgtcacactctttcttcagctccaggaaaaaactgtggacaaattcatgagcaggtcttgccctgttcacccagatatgagaccttgaggctgcccttccctccaggtctccaggtaggctatgaaaagggtgaatcaggagtcaatacacacacaattattataattttattcttgtttgaagaagaagtagaggaataattgaacatgtaaagtgaaaacatggaaaaccgaaaaagaggaattattgaacttgtaaagatgaaaactacaatgtctgaaatttagaaaatacactgggtgagtttgacaacagaaaaaagattagctgcaaaaaaaaagattagctgcaaaaaaaaagattagcaaattgtataatacagcagtagaaattgtccaagatgaaacacatatgggaaaaataattatggaaattaatgatagaaaggaacagagtatcagtgagttgtaggacaacttcaaacagcctaaagtatgtgtaattagtgtttgaaatagaaatgggtggaggagaaatagaaaaaagtatttgcataaataatggccaaatatttttcacctttggtgaaaaccataaactgaaatatccaagaagctcaacaaaattcaagtataggagacatgaaggaaacaactccaacataaatcataatcaaattaataaaatccagtgatgaagagtcacctaaataataatgctaagagcagttctcattaaaagcaatgcaagaaagaagacggcggagcaatgtcttgaaaacactaaaagaagaatcctgtcaaccttgaattctttttcttttcttttcattttctttctttctttttcttttcttttcttttctttttttctttattttttttttttgagacagggtcttactctgtcacccaggctggagtgcagtggcacaatctcagttcacaacatccagggcttacatgatcctcccacttcagcctcccaagtagctgggaccacaggcgtgcaacactatgcccaggtaattttgtattttttgtagagatgaggttttaccgtgttgcccgggctgatctcaaacttgtgcacttaagcaatctgcccgcatcagcttcccaaagtgctgggactccaggtgtgaaccactgggcctgccaaccttgaatttttttaataaaaacaaacaaacaaaaactttcaaaaaaggagacaaaataaaccctttccagacatatgccaaattaaagaattggttgctatcagactcttacaattagaaatggtcaaggacatccctagacagaaggaaaatgataccacaatgaaatgtgaatttataccgaaaaatgaaaacatcagatatagtaaccacaaggataaacatagaaacctctgaattgtgttaatgtctaataaagataattaacacttcaaagaaaagctaacgtaaatacattgtgatttgtaatgaaaatgaaagtaaattatgtgacaaagcacaaaagctgaagggatgaacaacatgttataatggtcttatactatatgtgaatatataataacacttgaaggtaaaccttgataagttatatacgtactgtaaacccaagcaatcattaagatcaacttttttttttttttttttttttggagtctggctcagtcgcccaggctggagtgcagtggcacgatcttggctcactgcaagctccgcctcttgggttcacgccattctcctgcctcagcctcccaagtagctgggactacaggcacccaccactacgcccggctaacttttttgtatttttagtagagacagggtttcactgtgttagccaggatggtctcgatcttctgacctcgtgatctgcccgcctcggcctcccaaagataaacccttttaacagaaataattatggctagtaagccatattagagttctccacagaaacaaaatcaataggatatgtatgtgtgtatatatgtataatgtatatatgtgtatatgcatgtgtacatataatgtatatgtgtgtatatacatatctaggtacatatatatggagaagaaattggttcatacaattgtggctgactaggatgaaatctactgggcaggctgaaggctggacatttaggtaagagttgatctcgcagttttgagtctgaattctgcaaggtgggacttcaggaatcctcagtatttgctctgaaaaccttcagctcattaatgatgcccacatgcattgtggagagcagtgtgcttatataaagtctacagatataaatgttaatcacatctgaaaattatcttcgtgccaacttctatactcgtatttgacaaaatcaactaggcactatacctagtcaatctaacacttaaaattaaacatcacttaaaccagcaaggagataaaaagaaataatttttaaaaatcagtcaaaaaaaggaaacagaaaaagggaaggagaagcaatgaacatatggcacaaatagaaaatgaagggcaagttggcatatttcaaccaaattatgttactaatcacattaattgtaaatagtctaaatatcacaattaaaaggcagagattgtcatgttgaaatgaacaagactcaactatacatgctgcctagaaaaaaaaccacttcaaattataaaaccacaaaaatccaagtacaaattaaggacaattccccccactcccaagtctgtttcacaaagcagtacaaagaaggattcacagtaaattttttttttttgaagtcttactgtgtcacccaggctagagtacagtggcaccatcttggctcactgcaacctccaccttccaggttcaagtgattctcctgcctcagcctctggagtagctgggattgcctgccaccatgtctgatgaatttttgtagttttagtagagacagggtttcaccgtgttggccaggctggtctcgaccttctgacctcaagtgatccgctggccttagcctctcaaagtgctgggattacaggtgtgagccaccatgcccagcccacagtgaactcttaacacacagttatagaaatatgcatcacctctcccatcaccctttcctctctctggcttccaaaaccttggttctggtaccagagctgagggaaaacattccacagaaatattaaatcaaggtgaagaagggagattctcaagatgtaagtaaaaggcaaatgagggaatggaagtcgcaatgcccttgcatgcataaggacagctcctgcatgagaatgttgtttgaaacattaccgaggaattggtgtccatgttcatgcaggacataggtctataggatatttttgtcatgcctttgtcgggctctggtatcagagtaattcaggcctcaaataggtagtagggaaatgtttgcttctcctctatattctgaaggagattgtgtatgattggtgtcatttcttccataaaaacttgatagaatttaccagtgaagtcatttgtactaggtgggcttttcttagcaggaagattttaaattgctaattcaatatatttatgtgtcatagatctattcagattttctcctttatgaatcgattttgataatttatgtatttccagatacttatccacttcatttaagtcatccataattttggcatttattgttcgcattattccctataaccattgtaccttttgtaaggtcagtggtgatgtcactctttaagtcatggttttgacaatttgggtcaggagaagatttggaggaggagagaacaaggttgtcttgatgttgtcttggctggagtgtgacttggagaaaaatgacttgaatgaaaatacagtcagagggagatatctgtcaagtggttctggtgcctggatttccacatgtgtggtgacggagcccagcccagtgctctactcatgcccagatgtcctggattattcccctgaaatactcaggtgaagctccagctacaccatggcatcctgatattttaaacagagaagaccagtgtcatgggcactggtgatctgctcctcagggcagactcactaaccgtggcagctgggaatcccaggggcctcacagctctcactaaccgtggcagctgggaatcccagggtcctcacagctctcactaaccgtggcagctgggaatcccagggccctcacagctctcactaaccgtggcagctgggaatcccagggccctcacagctcttttctccctcaaattgctgctggctacagagaactgcctccaccaagggcatgcccctttcacagtgtggctcaggcctaataactgcatgagactgaaataccaaggccctgtctcaggttaggatgaccttgcagggcctcccagatgagtcctcaactggagtcagatttcaggctgcccagttgtgcccccccatacttccttccagagcgaatatctccaaacactactgtatgcaattttccctctcagagtctgattccagggaacacaaaatagaaaacagtctacaaggaagagtacggaagaagagagagcagcacagagacaggactctggaatctgcaaatattcctgagcactgatgatcccatgagtggaaggaaaatacttaaggccaagaaaagaaccacccaaagacatttgagggaacaattgcagggcatgtgcatgcgcgtgtgtgcgcacacacacactcacacacacacacacacaccatcagaatagagtttgttcctacaaccagtgtggaaatgtgtctaatcagaggcatcaggttaactaatcagaatttctctgccctggctgagcaaagtggcttacacttgtaatcccagcaatttgggaggctgaggcaggaggatcacttgaggccaggagttcgagaccagcctgggcaacattgtgaaaccccatctctacagaaaacttaaaaaatatagctaagcatggggacatgcacctgtagtcctagctaatcaggaggttttaagcatgaggactgcttcttgagcccaggagttcaaggctgtattgagccatgatctcgccacacagtttcaaaaaaaagaaaagaaaagagaaaaaaaaatgaataagaaaagctctgccttagtatagggggaactaactatagactaaaatctgctcctatccctcctaggacaccgtaagagcaagttcagaaaggaacatactctcttcaagaaacccttctgaatcaaagaagacaaaaatatgtggagaaatataaaaatatcatgcacctaaaaagcaaaacttcacgatgtctggcatcttattacaatagcaggacaacgtgagtcagaagtaaaaaagttggtcagcgcatcatggccctgaaattgcacaggtaatacactttctagaccagaacaaaaagcagttgttgtaactgtaatccatttgtcctggagggtagagtattgatggaacaagttaaatggagacatgaaagacatttaaaaaacacctacatttaagtcctagaaatgaccacagaaatatatgaaatcaaagtactttgaatgagattgctggtatattacatgctgaaaaagaagagattagtgaatctgatgatatagtaatgagaactattcaaaatgaaatatgcaaaactactgaaaatgacaagaaaagagcatcgttgagttatgggacaactgcatgccaatgcaacctaaaataacgtaatttgtgttactgaaaaaaagaagttggtgggggtaggggagtatatagaaaaactacaaaacaaaataatgactaaaaatgatccaaattttgtgaacatcataagccatccattttcacgaagctcaaccagcccctgacaaaatatattttaaaatataaatacgttaagataacaataccaacacatatcataatcaaattgctaaagcacagtgatgaagagacactcttaaaagcagccagaaagaaaagacatgttagatataatactaagagcagagttctcattagaagcaatgcatgcaagaagacaggtagctacatctttataatattaaaaggaacaactgtcaaccctgcagtctttacccggtgaaatatctctcaaaaatgaaggccaaataaaacctttttcaaataaataaaacttacagaattgataaatcacaagccgtcactaaaagaaatgatgaaagacatccctcatacagaacaaaaattataccagatagaagtgtgaatctgcacaaagaatgaaaagcatcagaaatggtgactacatggataaatattttaatagtgcataatgtagaaataaaagggcttgaacagcactatagaacaactagacttaaccgatgcctgtagaactcttcaagcaacaaaagcagaatgcacattcttcttgcatgcacatggaacattctccagaaaaaccgtataaaacagattgataatttttaaaaagatagaaatcacacaaagtatgttcccaaaacaatgtcattagagaaatccaaaaaattgagggaagaccatgaaaactgcatgaaaaaaattgagatgaatggacaaatcactagaaatacaaattctattagaagtgactcaagaagaaatagaaaacccgattaaaactatagaaagagattaagttaataataataagaaaagccttcccataaggaaaggcccagacacagagggcctcactggtgactattaccaaatgtttaaagaagaattaatataatttatcattaaacttttccaaaatataaaagagataaaatcacttgccaactctttctctgaggccaatattaccctgataccaaaaccagacagagccattacaagaaaagataaatacagagcaatgaccttactggatatagatactaaagtccttaacaaaataccagaaaatgtaatctaacaagatataaaaagaagtacatacaataaccaagtggtgtttatccgaggaatgcaatgatggtttaacatctgtaattgaattaattaatagaaggcatcgtattaatagaagaaaggacgaaccatattgtcatctcaaaatcacttaaaatgttttcatgcaagcagactttctttcttgctgtttttaggccatcatgagaagtggagatggcatggggtagtatttcatgcaaagaatctggatattccatactcaactgtgaggatactttctgataaatgtaaaagattgtaatattacgtttctgtatgttcagagaacacttcctagacaagatatgtgtacagaaccgaaaggacaattaggattttggcaggcattgagtgaggagtggagtcactgcaagtgtcagtcagagaacaagaaagatgttaggaaccatgtatttctacctggccatcctactgggataccatccccttcctaacacatcacccatgtggcttgtaaaaatgtccatacttgaaacattttgtccacataattacaggtctagtgctggaatcaagttccctttgatgacatcaggacagttaaaggatctgcgtgtctaactgcccccaggtgatgctaacattgctgccctctgaggaccacaagcaaagtagctcagctcctgacctcctgctcccagcacaggtgagatgcacctcagctacatctgtgaagcccaggagactttctctccctcctcaggctccctggagtgatgacccaggactcatgcctctgcacatttatcctttccctcagagtttggggccttatcagtcctgttacatcttctcagcatctgaaaccactggagaggtggtcaccatctcctgtgctgacacagcagtgacattgggggttataattctgtctcttggtaacaaaagcaacagggaagagccccatatgactgaggggtgagatcaggaaaaagcctcagagattccagttctaatctcaggccgttctttgtattcttttatgagctagttagtcagctggtcagtcagctgtggccacaagaagaaatggaagagaggttcagaaaacagccctagagaccatagacccagagctctagagacagcaggcccaatgtgctacacagggccacagggaaaggcatcaggttcattagaagacagaagacaggagggcaggggatcccttagaccatgacttttatcagaatttcctcaggaaaagcagggcaagctaaaaaatttatgattggccagcctgaataatgtcagcaggctttgggctactaaggtggtctctagctgcttggtacctggccctgggacgataaaggcagaggaatattgtatcctgggatgcacaaaccagacaggggtggtgaggctctgaacacgttagtttccatatgaaaggcaggcttctggctgagcccattgctctttcaaggaatagagaactggggagacccaggaggggtggtcttttcccagacagaaatgttttttaagatgtcaaaatatcaaaatatatagaaaattatatacagttgacccttgaataacattggtttgaactgcatgggtccattgattttcttctgcccctgtcacccctgagacagcaagatcaacccctcttcttgctcttcctcttcagctactcaacccgaatataaaaaagataaaatcctttatgacgattcagttccatttaatgactagtaaatatattttctcttccttatgatttttaaaataacattttctgttctctggcttacttcattataaaaaatactgtatataatatacataacatacacaatctgtgttaattgactgtctaagctaggcctggctctgaccctgatcctgggagacactttaggcagattactctggaaataagtccctcagtctctgaccatctctctctcctcggcgggttctctgtcctcccatgggagctcagtgcccatggtgcagacagcccctctcagctgctcaggaccaagtagggaagctctgctctgtcttggtacccgcagaacccaggctggtgcccatgctgggactttaatgtggtgacaaaactcctcatgcagtgctgattgattctctgacagtgtctaggaatgtaattcccctgaccaggggacaggttgaggatgagtttcaggggggatgacaacaagacttccaatgacacagccacagggagaattgagatgcacaatctgctgtccccagcctggatcacacgctccccctgcatttaggaaagttgcttagaattaggctgaagaggtcaggattcagttttaacattgacctctctctcattttctcttttactctcttttctccttctctcttcctctctctttctttctctttctctatgatactgaagcccttattcacccccattctcagctatgaaatggacatggaaccctgacatcgtgagtttcctcaaggatcacaggagtggagtaaagatctgagccctgtctccaggtgtcctcaagggtctacatcacaggctcctccatcctgctcttcccttacacaggggctcccctcagatcctgcccatgcctaaatttaggccccatttctttgagacctgtggacacttcatcctgaggttcctgagggtttttctccctgctgacgggagatcccactgatcacatggtctgcttgttgtttctcaatcctggagcacagctgcaagtgtcacctgagacacggccaatcccccatacaggacagcagtgaaggtggaagaatcccagagtgaccgggtaccgtcattcattcaaattccatggggctcttgctgcatcactgggtgtcatcctttgggaacctggacttctaaactataagactcagagttagaaaacagaatcataaattccccatgtaagccactacttccacccctggtcctggactcagatatgttactaatgaggaacacagttcctcatagtggctgctgattgaggacatggtgggcaaactgtggttgatggacacatctgtcttgcatcctgcattggaacacagtcttgctcatgtctttatgagtgacatgtggctgttttcatgctgcaatacaaggcttggttgtggtgacagagatcctatggtctgaaaatctgaaatactatactaaaggtcccatactgtatcatgtcttctacatgaattatctacaatagacaaatccatgcaggcagaaagaagatgagtggttgcccagaattggagaaggtgatgaaagaggagaggctgctcactgggtgcagaattttcttttgggtgatgaaaatgtaggagaactacacacacagctggtggctgcccaacaaagtgaaggtgctaagtgccactgcgttgtacattttgaagtgattaattctaggttatatgaattccacacaatacaaaactatgattttcagaaattgactgttataattgtgttattatatctacaactttatgatggcactaaaggaccatgagcagtcaatgcaaaggatccagacaatatttcaagggctcttccagagtaacaagacatgaaaaggcagctctggttctctcttgcctggcgtattttaccctcggagttttttgtttttttgtgttgttgttgttgttgttgttgttattgttgttgttgttgttacagagtctcgctctgtcgcccaggttggagtgcagtggcgcgatctcggctcactgcaagctctgcctcccgggttcacgccattctcctgcctcagcctcctgagtagctgggactacaggcgcccgccaccgcgcccggctaattttttgtatttttagtagagacggggtttcaccgtgttagccaggatggtctcgatctcctgacctcgtgatccgcccgcctcggcctcccaaagtgctgggattacaggcttgagccaccgcgcccagccaaccctcggagtttttatgagcaccgaagggtgcagggagctggaagctacccaccaggtgcctggctcactcatgtctgggtgcagcagctcccccaacaggcagctggcagaactgaaagggaagagctatatccttctgagcccccacaattgtggtgcaggattgttcccgacactcccatccagtctgcttgctcctgcacacttagaaatgatcattatttctgcccaggacctccctggtcttgctctcccctcttcctccccaggcgaccttgggaactttactcaccctctggcccttccctcctctgtccagtgttttccccacccactgtgatcagctcagatcagcgagtctgtgggacattagggatcagtcacccatgtgaggccctcgacggggtcccaggatggagcagtgtatgtccccacaaggctgcttattgcacaagtaatggaggaacaaaggggtgggtaagccccctcctgggcagcttcagaccctgctaaaataggaaacagcctggggcaggtctgaccccacttgtgtctctcctgcccccaccccagcagcagcgtcctggaggccataccatgtgctaagcagatgccaagatcacgtcattcatcatcacctggaaattcccctaaccacaccttaatacgctgcactcgtgcctcagctaaaagtatcacacactgcattgcaatgagtttggatcccagacccccttgatgtttgtcactgctctttcagatcctcgaaaacacctacccctccctgcaggtcagtgacagactcttcttcctcacacttcctttcactgtttcttccttcctgagagcagctccagagactcctcttcagggaggcgccccaacctctgattacacagcagtctgcctgtcattttctgtgtatgcattctattaatgatctgcagagcacctaaacttcatgcctcttttcctaacatgtttattaattgattttctggtgctaaatactcctacaatcaatcaaaaatgcttctcctctgcttggacactcatgagaaacagtcatgaaccatttgctattttatcctcaaaaagtaagtgtggagttcactgctgttccccacatactcaccaaataatgagaaacccagcaattacccaactttctgctccaccatcatgacacagtaggcttttctttcatttgtgtggacttaagacctcaggatggctgctgcagctccagctattatacccatattcaagagcaaaggtgctgcacgaaaacagtctgtttatttccatcacaagagaaaatgttccctgagaagatctccaaccacctgacccttacagccctggggccagcatgggaccatgtggtcagtccaagccaagagtgaccagggaaaacaaggatctttttgtaaataaatagaggagaaaatacacaggtagaagatggtgcttctactacaaactgtttctattacacagccccaacccccatgtaggaaactcctggggtcagagacagtctttctcgtgctgaattcccaggatggaatattgccggatcagagtgggtctcaataaatactggctgggtggatatgctcctgcctttgtttttggggcaggagccaccactgcctcatgtttttctacacctggagccatgaaacttggtgtctgaggtctgcggcactatatgcagagccttggtaagatgcactggaccacttaccaacccagtgacagtagagggatgtcttaggtgggccctacccattttcctccaataggacgtgctcataatttcatgggtaaccgagccccttatgcctggtattgaggcatataaggccaaataaagaagaggaattcctctcttggaaccagcagtccatggacaagggaatcagggacctgagcagcaggttctgaatccacacctgatctggggcaggacccagaacctatcaaagtcttctgctgttaactatagaatgggctcacaaaatgcagacagaatgatctgtgaactccacctggcctggctagctgagaaccaaggccaagacatagtttaaggtaaagatgttggcccagactttgggaccagcaagtgaaggagaattctgtgggctgaggtgggtctgtagggtcctcccctcccctctctgtgtcccttggggctgagcccttctctggaaactacaaagctactccagtagcagcccctgattctgctgacttgcatcacgggccgctttctccatcaaggggataagagaggcctgggagaaacctacccgccctgggccacaggaagcagcatcagggatgtctcagtcatggactggacctttctcagcctcctcgctcactgcacaggtgctgccgccagagtcccagccacccgcccagccccgggctgtgggaccaggctggccttgattgtgagctcagcagggctctgcctgtggtggaaaggatgctcatgaccttgctgcagggtgaggggctggtaaggttgaaatcttcctgtactcctgtgctcatgggcactctgaggggcacagtcaggctccctttcatcccagaagctctgtcccagccaggcaggtgcaaaggaatcctgaggatcagctcctcagcttcaagccttttctccctcatctcctgcaggtttcatggccacatatgagctgtctcagccaccctcagtgtcagtggccccattacagatggccaggatcacctgctgtggaaatactgttggaggtggatatgtttattggtaccagcagaagtcaggccagacccctgtgccggtcatctataaagacagcaagtggccctcaaggacccctgagtgattctctggctccaacttgtggaacacagccactctgaccattagtggggcccaggccagggacgaggctattactgtagcacctatgatggctgagggagcagcaggcagtggctcacagtgaaacagacagatggggatgtgggacaggaacctctaatataactaggctcaatatctcacatcctctctaagccaggatgtccaacattttggcttctctgggccacattggaagaagaaaaattgtcttgggccacacataaatacattaacactaacaatagctgatgagcttaaaaaattgcaaaaaaatctcataaagttttaagaaagtttacaaatttatgtagggccacgttcaaagccatcctaggctgcatgtggcctgcaggctgcaggctggacaagcttgctctaagcagtgaccatgactttggtctcagttcactcaggtggtttctcatggtagccaaagcagcaggagaaactgtcggatttctatttaaccatgaattttacaattacattcattgtaaatccaaacatcttgtccctttattacctgggccctacagagactagtgcacaggttcatgggataagaaatgtctccagagagcttggtttctgcactagagacagtcgtttccctccctttcaacacagagtgtggcaggaaaggaaccagttctctgagctaaccctgagaacttgggcttgagaaaaagaaagcattttgaaccagtaggattgtgcccacagaatgagatgtgctactctggcccagcccaactcctttcatttcaggagctctgtctgggccaggcaggtgcaatggaatcctagggatcagctcctcagtttcaagccttttcttctctgggtgtctgagaacaggagttgtcttgcacgtgcacatgagaaagaagtgcacacacgactctcaggtgtgagcagcaaagacagaacaaacctttccagaaggggcaaatttcattaagatgacagggccttgttacacaaccccacatgtctggactgggatctcctattggatcttgccataaatgcaaggtttcttctcccatcataaattcctgcattgcagtagacccagctgggttctagggctcaaccagcagggcactcccaccactgtgtggacctgctgcagagccttcctgctctaggacccacagacatgcaacttttctttgtttttgctatttgggttggagcaacatcccaagagtgaataatgcttcttccagaatccatcatgaccatatatacttcttgatgcgaagttaggatgtaataatgtgtcctttttttctatgggaggtgctcagctgttccaaacaagaagaccctaaacatttctgctcatatgaaggatgactccctaggtttgctttcctattctctgaatgcatgggtctccccaaatcttccaatgacctttcactgcatgcacatctcatccaaataccaccacatggtggatgcttgggcatggtagcgggtgcctgtaatcccagctacttgggaggctgagacaggagaatcacttgaacccaggaggcaaaggttgcagtaagccaagattgcaccactgcactccagcctgggtgacagagcaagacttggtctcaaaaaaaaaaaaaaaaaaaaaaagaaagaaaagtttatatttttgttctaatggttatcttaatatcttcattctataattatatgttttatataattataatagctatataagatataatacccctagtatgttgttttttggatattctacttgctcctgatggttaatttatgtgtcaacttggctaagctatggtgtcccgttgtttggtcaaatacttgtcaatatcttgctgggaggttatttcatagatgtgattaacactgacagtcaattgactttaagtaaaacagatcacccaccataatatgggtgggccacctccaatcagttgaaggccttaagaacaaaaactgaggtttcccagagaagcaggaattctgcttcaagactgtaacacacaaaccctgcctgagtttctggcctgctgactgctctacagattttaggttccagacttcgagatcaactcttacctgaatttatagcctgctggtttgccctacagattttaaacttgctagtccccacaattatgtaagccaattcctaaataaatctctctatgtataacctattggtttagcttctctgaaaagctttcacatccagtttcctggatgttaagaattactgaaactagctagtaacttactttttttttttttttttttgagacagagttttggtcttgttgcccaggctggaatgcaatggcacaatctcagctcacctcaacctccacttcctgggtccaagcaattctcttccctcagcctcctgagtagctgggattacaggcatatgccaccatgcttggctaatttttgtatttttagtagagacacggcttctccatgttggtcaggctggtcttgaactcccaacctcaggtgatccgccgccttggcctcacaaagtgcctcacatgagccaccacgcctggctcctagtaaattcttcttttccgtgatgtgtctcttacctctaataatacttttcttcttaaagtctacttcattaaaaatagttatgctgggcatggtggctcatggctgtaatctcggcactttgttggaggtcgaggtgggtggatcactgaagcccaggagttcaagaccagcctgggcaacatggcgagaccctgcctctacaaaaaatacaaaaattagctgggtgtggctaatataattctaagttggcacacttgtagtcccagctacttgggatgctgaggtgggagaatcgcttgagcctagaagggagagattgctgtaagccaagatcacatcattgcactccagcctgggagacagtgaggctctatctccaaaaaaaaaaaaaaaaaaaaaaaaagttatacagctttcttggttagtacatgcatgacatatttttcattattttctacctctctgtatccttatataaaaggcattagttgggttttactttattttcaattattttaatttttattgtccttttaaatgtaactaatgatttatttacgttgaaacccaccaccaatttgttttccatgcctattctatttcttcttatctcctctcacatcttgttttggatttattatttttattatttaatttcctccttctctattagtttcataactgtgcagtcttagagttattttaaaagatgacagtggattattttagagcttacaacatgcatccttcacttatcaaagcctaacatgagctagtactttttgttgtggttgagacagagagagtcttcctctgctgcccaggctggagtgcagtggagcaatcttggttcactgcaacctccacttcttgggttcaagcaattctcctgcttcagtcacctgagtagctgggaccacaggtgtgcaccactatgcccggctaatttttgtattcttttttagtagagacagggtttcaccatgttggccaggctggtcttgaactcctgaccttaagagatctgcttacctcggcgtcctaaagtgttgggattacaggcgtgagccaccacgcccagcctatgagttagtacttctatcctcttcctagtcagtagaagaaccttggaacaggaactaaatttacccccagtgacttatatgctaatatttttgtgtattttaaacatatgtgtgtgcatagatgtatctgtgtgttttttgtgtttttattcttatttatgttgagagtgtagagctatgtaagagtaaagagaattgtgtaatgaagccccgagtatccattcaatttcaacaacaatcttatggccaagctcatttcatgtatactctttcctgcttccctctaccccacattatttcagtgcaaatcccagatatataactgtacccatacatatttcagtatgttttatttattttaaaccccacaagatatcattttctatactactgtaatttcataccaataacattcatttagatttacccacacatctacctcttctgttaccctttatttttatttataaaaatatctttgggaaaaaatatccttcagcacatggtcaaggatctcctgagggctatgtcatggacaaaatatacatatatattccatatatatacacacatatacacacacacatatatacacatacacacacacacacacacacacacacacacacacacatatatattccactttcacttttttgtttgttttttgagaccgagtcttgctctgtggcccaggctggagtgcagtggtgggatctcagctcactgcaacttctacctcctgggttcaggtgattctcccgtctcagcctcctgagtagctgggattacaggtgttagccatcacgtctggctaatttttgtttgtttgtttgtttttgagacggagtatcactctgttgcccaggctggagtgcagtggcatgatctcggctcactgcaacctccatctccctggttcaagcaattcccctgcctcagccttccaaggagctgggattacaggtgcatgccaccatgcctggataatttttttgtatttgtagtagagaccgggtttccctatgatggtcagactagtcttgaacttctgacttcaggcaatccgcccacctcggcctctcaaagtgctgggattataggcatgagccaccgtgactggcctgttttttttttttttgagatggagttttgctctgtcaccctggctggagtgcagtggcaagatcttggctcactgcaacctccacctctcgggttcaagcaattcttgtgcctcagcctcctgagtagctgggattacaggcatccaccaccacatctggctaatttgtgtatttttggtagagatggggtttcaccatgttggccaggctggtctcgaacttctgacctcaggtgatccacctgcctcggccttccaaagtgctgggattacagggaggagccaccatgcccagccattttcacttttgaaggatattgttagtgagcatagaattctaggttggcagatattttctttcctcagtttgaaaacatgattccttgtatctgatttctcctgcttttattgggaagccaattctcaatctaattttgctcatttgaaggcaatggctttttatgttgttgtgttttctgagatggagtcttactctgtcgcccaggctggagtgcagtagtgcaatctcagctcactgcaacctctgcctcctgggttcaagtgattcttctgcctcagcctcccaagtagctgggattacaggtgtccaccatcacacctggctaattgttgtatttttaatagagatgaacttttgccatgttggtcaggctgatcccaaactcctcatttcaggtgatccgcccgcctcagcctcccaaatgctgggattacaggcatgagccagcccccaaccctggcctgaaggcagtatcttttttcctctggctgctttgaaaagttttgtctttgttttgagcagtttacactgatgcattgaggtggctcttcattccatgacttgattcttttttgtccattttagaaaattgtcagctttatctcttcaagtattacgtcttccccatcctctctctactctccttatgagactccaatttcacatgacttatgccttgttaaagtatcccccatgtctcttaatccattcctgtatgttctatctatttttctctttgtacttcaatttgtatagtttgtatcaaactatctcccaattagccgggcgtggtggtgggtgcctgtaatcccagctacttgggaggctgaggcaggagaattgcttgaacccgggatgtggaagttgtagtgagccgagatcatgccactgcactctagcctgggcaacagagtgagaccctgtctcaataaataaataaatacatacatacatacatacatacatacatacatacatacataccagttcactattttttttatgtttgtgtctagtgtgctgttcaaattgagttcctaattccattttttttgagacttttttttttttgagtctctatctgttgcccaggctggagttcagtggtgcaatctcaactcactgtagcctccatctcccaggttcaagggattctcatgcctcagcctctcgagtaactgggattaccaccatgcctaactcatttttgtatttttagtagagatggggttctgccatgttggccaggctggtcttgaactcctggcctcatgtgattggcctacctctgtctcccaaagtgctgggattataggcctaagccaccactcccagcctccatttttttttttttttttttttttgagacggagtctcgctctgtcgcccaggctggagtagagtggtgcgatctcggctcactgcaacctccccctcccagttcaagtgattctcctgcctcagcctcccgagtagctgggactacaggagcatgccaccatgcctggctaatttttgtaattttagtagagatggggtttcaccatattggtcaggctggtcttgaacttctgacctcaggtgatccacccacctcagcctcccatagtgctgggattacaggcatgagtcaccacacctagtgcatccattttttgtagctgccagttttctgatgaaattcttaattatttctttatatccttgatacacatgtaaagaatttattttaaagtacatggtctgatgattttatattctggagatcctatgggcctttttcaaagttgtctgtgctttctcttgagttttgttcctgctgtcttatttccttgtttgcttggttgtttttaatttggcaatggaagttgtgtataaaaattgttacaaataattttttttttttgagatggagtctcgctttgttgcccaagctggagtgcaatgatgtgatctcggctcactgcaacctctgcatcccagggttcaattctcctacctcagcctcccaagtagctgggattgcaggcaggtgccagcacgcctggctaatttttgtatttttagtagagatgggttttcaccatgttggtcaggctggtctcagactcctgacctcgtgatctgcccacctcagcctcccaaagtgctgggattacaggcgtgagccactgcgcccagccagaaataatttttaaaaataatttcgagcccaagcatgatggctcatgcttgtaatcccatcactttgggaggctgaggcaggcagattgcttgagcctaggagttcaagatcagcctgcgcaacatggtgaaaccccatctctacaaaaaataaaaaattagctgggtgtggtggtggtgtgtgcctgtagtcccagctgtttgggacgctgaggtgggaggctcacttgagcctgggtgatcgaggctgcagtgagccatgatcctgagactgtactccagcctgggcaacagagtgagatgctgtctcaaataaataaataaataaaaataaaataatttgaggcctagggctctgaaattctgagatctcctttatgcatttgagtgactgagatgatctgaagctggatccagtgctcctgagggctgctttatttctggttgactgtgactcctagagtaagaaacctgcaccccatgtgtggggtattatggcatcccctccctcagccacatgagtaagtcaacagcactgctctagaccaggtgtggtggctcacgcctatagtcccagctactcgggagactgaggcaggaggattgcttcaggccaggaatttgaaaccagccagagcaatatattattaggttggtacaaaagtaattgcggtttttgcctttaaaagtaatggcaaccctgtttcagcaaagtaaaaagcaaaaaaaaaaaaaaaaaaaggaaggaagaattaaaaaaagaatcagctgggcgtggtggctcacgcctctaatcccagcactttgggaggccaaggcgggcagatcatgagatcaggagatcgagaccatcctggctaacacggtgaaaccccatttctactaaaaatacaaaaaattagccgggcgtggtggcaggcgcctgtagtcccagctactcaggaggtggaggcaggagaatggcatgaacccaggaggtggaggttgcagtgagccgagatcatgccactgcactccagcctgggtgacagagtgagactccgtctcaaaaaaaaaaaaaagaatcactgctctgtctctcagcctcctcttccaggattggccgtcgccttgaggggaatgctggccttgcctgtctccagccctgtacctctctgcctcctatgcctttaagcacatgttttctatttgctgggctgtgaaatctgctcttcatctgatggggtttgctttataggtgactagattcttttctcttggtggttttagatttcgcattttcacattgaccttaaatagtctgattatagtttgccacggcaaagaccctttgcattgcattgtttggggatatttgagcctcctctatctggatgtctaatctcttgttagatgtgagtagttttcattattattttattaatgggctggcatgtgggccttggttccaggcgggctcagaggggcagctgcctgatgtctgggcagcttctctttctgtcttttcttacctggactctgggttgcttgttagctgcttctgccagttctgagttttcaaggggagaggggcccagtgatggctgttctttgaaggaaagggaagaatgtctcctgtttaacatgtttctatgtttccagttacttggttagttagttagagccagggtctctcgctctgttgcgcaggctggagtgcaatggcatgatcgtggctcacagcagcctccaccttccaggctcgagcaatgctcccacctcagcctctcaagcagctgggactgcaggtatgtgccaccatgcttggctgcctttttaaattttttttttttaatacagacaaggtctcactatattgcccaggctggtcttaaactcatgggctcaagtgatcctcctgcctcggcctttcaaagtgctgatatcacaggcagggtttccattttttaaagctcccagcagtggtataaactcctcctttccagagaaagcgcactctgtccgcatccctcatgttgtcctctcctgcctctgcttagggttcactccgggggaaagtgccacttgagagtttcctttttatgtgtggttctgactgaccgctccctgctcacagatgctgcttctcagggtggggtccctgaggcctggagtgtggcctctgacgaccttcagggccaggtgcggaatgagagcctgtggccacatggcccccggtgggagacgtcccgccgccctttgcttctctgtgccactctggctgcacagttcagagccttgggaaacgttaaccagtaggacctagaaggggaggtgagaaggggtcaccccccaggtgtgcctgtggtgagccttcgtgctgagcaggtgcagggagggaggcccaggtgcacacacctgtgaagtaggggcagctggctgggctccttgacctgctccagagcttcttattttctggccacttcacctgcagaaggcccaggtggctgtagccgctagggtcccttgcagtggaaatgatgcctgtcctcagcccctctctaggcctggcgctgtgctcagcaccgtcgtgtgtgtgtatgtatatgtgcacgcatgtgaatgtgtgcagacatcatgaggtgtggtccctgctgttaggcagcttgccttgtggctgaagtgaaccatcacctgaatcaagggatggaaacacaaggccagatgcagtggccttctatggagtcagacggtggctccgtgacctggcttcactccagaactacctggggtttctagctgtgcaaatcccaggtcccactcagattatgagtccagttctctgcaggtggaacccaggaaggtgtatttttaacaagatggtactgctcattcacccagcccagccagtggtcttggcatacccaggaaccgctgacatagagcttgtgctccccataaagtgggaaacagagcgttcctgggtgggggacatgtggcttggtcatgacagtcagggtgttacataccaggacagactgtgttcgggtgacattaaggacaagctcctgcaggctagctgcctggatagtgctggctgggggtagaagttagaggggtcacagaggggcttcctcccggccccctcatcagctgcttgatttagggcttggttctgggtccttctgggcctgattctgaaccatgggactggtgtggcctgcaggctcctcccgccacaagctgttcatggtgcagggggagaacagtgtccacaattccccagacagcagctgtggatgccaggcccccaggagttgttactgaagttgctgctggacagctcgcctttcactgagctccacatagcacccgtggtgatgggagccggatggagagagcctgccagcctgcacatcagctcccaactgggcggggcagagggaggagggggtggggaccccaggcagcagggctctgggagcagtggggccctgggttccaggggtgtctggcaggcccctccttactctacgtctctcagcctctggatggaggtgctggccgcagtcgggctctgcctctgactaagggttggggaagtggcgggtgtgggctgctgccccgtggggcctctgaacagaccccagggcctctgccaatcatgactccttcctttcagctggacccacaggccctgcaggacagagactggcagcgcgccgtcatcgccatgaatggggtacgtgtccgtgggactctcctggcgcccacttcccccagaaggatagggtggcctctgttcatttcaaatcagtcagaggtggctgagcctgaggcagcatctgagagggagcctggttggagaagggagggcccccaagagcagaatcaccatgcacgggaatcgtcattcattggctggaatgcagttgccagccaggccctgagcatccctcctcaaacaaaggtctcatggcaccaccaggacaggtggggcctccactcagggacctgggggctgcccatagaaatggagacccctgatttgtctttaggtaccccagaaaggtttaggccttaaaagcaatgacacacccaaaaaggcccgggtataaatggtaaaatgttaatatttgagattcttggctttttcttacattattctgtctttcctacttaatttttaattgttactaagagaaagctggtcacagtacactataatctcagctactctggaggctgaaccaggagaatcactggagcccaagagtttgattacagcctgggcaacattgcaagatcccatatcttaaaaaaaagtaagcaagcaagagaagcagcggggattttaggaggtgcttctgcagaaaccagtcgtttacatcatcttcaacaatcctggctcttgctgaagtagactaggggcttccccgaggggcggctccacctcatgctgagacctctgcatgccttgggggtggaaatatttgatgagactcccaggggtccttgggaccttgggctatgaggaccagaaggattagaggactgtgccccttctccccactgtagatcgaagtaaagctctcggtcaagttcaacagcaggaagttcagcttgaagaggatgccgtcccgaaaacagacaggggtcttcggagtcaagattgctgtggtcaccaagtgagtggggaggggcttgggctcacgcactgagggtgcctgtcccttcagctgtttctgcagaaaagagcatgtgtgggtctctcctctctgtgcgtggccactgcacggtgaggtcaggccccagggaacacggcgtcttcagctacctcctgtgtttcctgcaaaccagctcaggaatgtccttgccaccttgcttggaagcagtaggctggctccaggaactgcccaagtgcagggttttctgcccttgcttggaattagtcacggtcccagattcctgttgaatggttgtaacccctgcccctttgtcacgagtcagttgccaagagaagcctgtttgttggtttgagagcagttcatgcagacatagaccacttcctctgagaattcatttgcctccctaggatggaatctggctgggcctctgaccttgctggtcacgtgggccggggcctccatcagtcataccctggactcctatctgtgtctaaacaccacgccccacccccactcgcatagcactctgggagggctgtgggcatgagcagcgaggactccatcagcagctcccccagataagccctgctaatgagggggcttgcgaagcagctttgatgtgctggtaaatccaggtgcaaaacagaactcaagttaaggcctccgcacagcactgcgttctaactgtgaaggattcttactctagtgtcctgtgtggaggtattggaattgtccattgctaagactcagaggagaaaagcacttagcatcgcaggacttggagcaccggtgctgaggcaacccttcattcattcgtcggatgtgtgttaaggcccaggcccagggcaggggtcagggattctcctctcacacagcacgtgggtggcaggaccaacaccgggtctgacctcccagacgggggcacaggctgctaaccccaggcctggaatctgtcagatgcccttcccgtgctgacttgacttagacaggcctcctgaccttcccgcaaaggtcatgtgtgattcgcaggggttctggccgcttgaaaggttcctgagaaagtacatgccatgaggacagagcttgcagagggaggacaggcatgcagaaggctctgtgtgcagccccagacctgggtaccttcgtcaccgtcctcaccccacctccgggtgtgcacatagggagcaggtctcctgtgttatggcccaagcagggctgttaggacactgagaacattccctcctcccgcaggagagagaggtccaaggtgccctacatcgtgcgccagtgtgtggaggagatcgagcgccgaggcatggaggaggtgggcatctaccgcatgtctggggtggccacggacatccaggcactgaaggcaggcttcaacgtcagtgagtgtcggcctgcgcaggacgggatggaggtgtgggcagtggtgtccgcgatgagatctcagagtgctccatggcccaggcatgtcacatccttctctgtgtcttttcttcatttactgttttattattttaaaaaaagagaaaacaagagttgtacaaacagcttctatagaagccagtttttacaccatcgtacccactcatgccacttggtggagtggaccaggggcttctgtggggacttggccttcctgccttgggggtggacaggaggtggaagcccaggactcagtgcggtctgtccactgccctgtatgaggatgtggtgggcagagggcactgatgaaattcagcgcaggccggggctgcagcatctccgcctccatctcaccaaccctcacaggctttgaaggacccagactggcctcaaatgccaggggagggcactgagaccccagagggtccctcccagcatcttcaaagcaacaggattttgtgcctgcaggcccttctttgcagcacacaccacccaccctgaccaggacccctagaatgcccagcatccctgggagggccctgtggtagtttcagctccctctgggggcccagaatgaacctggcctgtggtgaggatgtaagcaccaatggccaattgggtccaaaggaagacaccggttcaaacactgaaaccaatcagattctcccacggccttcctgctatcagacgacactggtgcaggggtggttgctatgtacagggcagagccacccaatccccacgcaggcgctgtgtcctgccatgctggcctcctcctggccatcacatcaggccaagcaggggagaggaatgggaatgcccacgcacccctatcaactctgcagacacagaaccatgcacagctcttgggaggagtcagatgagctgctcaaagcccaggagggacccgcacagtggtcagtgtggcagggacggtgctttagccaaggcagggatggcgggtgactcactcaggatcttcaaggaggccgctgcatttccatgctctttccagataacaaggacgtgtcggtgatgatgagcgagatggacgtgaacgccatcgcaggcatgctgaagctgtacttccgtgagctgcccgagccccttttcactgacgagttctaccccaacttcacagagggcatcggtgagcactggaggccttggcctcgtgggagatgtctcccccatgtgcactgctgccctcggaggctgtgaaaagcgaggtgtgggaacctgagttgtaacccctctgccatggtcggcattttaacccaacctcaaaaagcaggggaccagaaccgagcctgtcctggaaggccttgcccatccccagagggctccccatccctattcctcaaggaggccaagtgggtgaaatggtcagcactgccgtgctgtggggtcctaaagtctgctgtcctccttcctgcagaccagggctaaacactggtgcccaggtgctcttgccatgggtcctggtccagccaagcatggtttcaaacatgacctgacccttagtcaacctggaggctgatgtctagagtgggcgctggagcgtgcagcacctgtggcctctgcatcacccttagggcaggtctgcctcccgggcccatgcacagaggacctggtctcccagcctgcaggtgcccctgtggtgtccaggacgacgagggggtctctgcgtacttggtggggctgggaccctcccacttcccacctccttgtgtccctcactccgctgtttcattccatgctgagcctcccctgccttgggctccctggggagggggtggtggcaggagttgcccaagggctgctctgcccatgagcagctgctctagcggctcctcctgctgctgttcgccaggtgctgctgacccctgcgaggtagagaaaaggcgttcaggtggttcacaccccacacaggtgcccctcacagggtcctcactggcggccagcgctgtgggtgtgacgatgatgacaagcctaaactgcgcaaggactcgtgtcccgggcgctccatgtgaccacctcgggagaggtctccggcttgtcgtaacccaggggagtgacccactgcctcctgcagctctttcagacccagttgcaaagaagagctgcatgctcaacctgctgtcgtccctgccggaggccaacctgctcaccttccttttccttctagaccacctggaaaggtagcccagctctcttgtggctgcccaggactccaggtctccaggccgttggggtgcccctctgctcccaccagacccccagcaccaaggaccttttcccccgacccctgtctgcagtaactcactgcttctaaggactagcaccactgccacccctgcccctgcctctcctctttgccacccgcctccctctgcactgtggccttaacaaagagctcagagctttggccgtggccagcagtgcatttggaccgcccccacttccctcccaagcacatcatgaagacctccccatcagcccagagctggccccttgtcccgggccactgagacccagaagtaccaaggctggagtcagcttgcagcacagccagggtcgaggtcactccctccctgaggactctagcatggcacagcccctctgcctctctcctggtggtggcgttgaaacagcaccctctgcttcggtcctctacagggtggcagagaaggaggcagtcaataagatgtccctgcacaaccttggcacggtgtttggccccacgctgctctggccctccgagaaggagagcaagctccctgccaaccccagccagcccatcaccatgactgacagcaggtccttggaggtcatgtcccaggtatgggaagacagcctccagcccatgcaaccccagcctgacagaggtggcctctgcctgccccacccccagtcctgcccatcttcccacttgcattgtatgtggtggtggctgagattcagagagagggacttgcctaggtttgcatggatgggagtgatagggggtgcccaggccacctcctggtcctgctggtgcatcttgctgggggcttaaaaccaccccaagtgttcgggtgtggtggctcatgcctgtaatcccagcactttgggaggccaaggcaggacaaccgaacccaggtgtttgagatcagtctgggcaatgcagcaaaccccatctccagaaaaaatagaaagaaaaattagtcaggcattgtggcacacatctgtaatcctaggtatctgggaggctgacacaggaggattgcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccgtctcactgtaaggggttcatgacaccagcaggggtttctagcacctgaggtggacttgggggcttgggccccaaagacctccccaccagcagctgtgagcccccctctgagccactctcctcttccccactctgcgagggcaggtcgaggtgctgctgtacttcttgcggctggaggccatccctgccctggacagcaagagacagagcatcctgttctccaccgatgtctaaaggtcccagtccatctcctggaggcggacagatggcctggaaacctctggctaatcgggccatctgtagagtgggaatcaagattttctgaggcatccttgggccacccccaggtgtcaggccatctgccaagagacagtggcccaaagcagaaggacaggtggcctgggcagatcccgcccaggtctgaaagccccaggctggcctcagactgtgggttttttatgtggccacccgagggcgccccaagccagttcatcttggagtccaggcctggccctgggagacagggtgaaagcagtggtttttatgaacttaacttatagagtctaaaagatttctactgaatcacttgtcaagaagcgccctctctggggagaagggaacgtgaccggattccctcactgttgtatcttgaataaatgctgctgcttcatcctgtgggggccgtggccctgtccctgtgtgggtggggcctcttccatttccctgacttagaaaccacactccacttagaacagggtttgagaggcttagtcagcactgggtagcgttttgactccattcttggcttgcttctttttctttccagaaggatttttgtgcagaaatgggtcttttgttgccgtgttagtcctccttggaaagcagctcagaaggcccgtgaaatgtcgggggacaggacccccagggagggaatcccaggctacgcaccttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggtagcagcttgctgatgacttgttttaaaactttcatcctaaataaccttttgatgcttgaatatttttaagttttatacatagtttctaatttttttcccagcagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccgacagctgcgggggagcccaggcattctttgtaagccctcctgactacctgactcaaagaaaacagaagcatggaggccgccaagtattttcaagaaataaccccatgaatattccatcacttttttagaaagaggggcttggggcaggcagaggagagaagggagagcaaactgagagccaagtttccagacagtcctgcaggaggagaggatgcagctccccagagggaagcaggatcacatttaaggaagtgtgtggggtccctggatgacaccagcacccagtgcggctctgtctggcaaccgctcccaaggtggcaggagtgggtgtcccctgtgtgtcagtgggcagctcctgctgaacccgcagctcactggggagcctgacagtggggccatgcgcctgacactcctctctgcttgtggacctggcaaggcagggagcagaaaacagagccccttgaaggcttcctgtctgcgtctgtgtgcagtgtggatttagttgtgctttttacttgctgggagagcacagccaccatttacaagcagtgtcaccctcgtgggtggcgaggacagaacaggagcctctgctctctgtacctatctgggcccggtgggctcccttgtcctggcttccatctctgtctcagcgaccattcagccctgcgcaggaacacatgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcagtgcaggcaaaggcctagatgccagtgtgacctcccacaaggcgtggcttccagactccccggccggaagtgatccttttttgccgcgggccctgagtttgaagcagcctggctttctcttggtaagtggctggtgtcttagcagctgcaatctgagctcagccacctacacaccaccgtggccgacactttcattaaaaagtttcctgagacgacttgcgtgcatgttgacttcatgatcagcgccgctgggaagaacccctgagccggtggggtggggctggaagcagcaggtgcagtgatggggctgggtgcccaggaggcctcagtgctcaatcaggccaaggtggccaagcccaggctgcagggaaggccggcctggggggtgtgggtgagcacaggcaggcaccagctgggcagtgttaggatgctggagcagcatccgtaaccccactgagtggggtagtctggttggggcagggaccgctgttgctttggcagagagagatgatccccactggggagaggctgttctgactctgcaggtgggacagggacagatggccaccagggtgacccggctggtcttcctttgctatgctaagccctgggacgtggaggattcctgccacacagcctgggcccggtttcttacctgtggccaccgctctggcacgagcccctcagtcttgggtggtttctgcctggtccgggatttggtgttcctgctgagtccagcctttctgccacctccgcatgggccgtgggtggtgttgtcagctgcctcccaccttggcttcagtagctcacccagctcacaggggagctgccctgggctggagatgggcatgcaccctgggtcctacttgaatgaatgcagcttgaggagagccggccatatacactgggccacaggttaccctcggcaatgcccacatcagccgtcagcctgagcctccccaggagagcaaggctcacacgacaaaggctgcccgtggccaatgaggtggctgagcccagccaggacctttctcggactcccgggatgtggctctgctcgtgagctgcctggtcagctctctcggggtgagaggggcttgtcacacgggcccctgcctgcagtgtgacccttctcagcttctctcagcagccctgcctgcggagtgtcaccgccaccatgatcatttccctgacactgcgagggtgtggggacgtcctgggtagagacagggcccgtggcagcagcaggctcaggggcgccctacactggtgggctggggacctggtggagaccacgccaagggctggacaaggggacgagcctccaccctggcctctccgcaggcctcagcagcccctcccacaggcagaagggttgacactgggttctgccctcactgcaagagctgcaagtgccacgtgctgttctgcccaatctggtgtctgcaggtgaggaaagggctgccgctggcccgtttctgagtgttcagcacctaaggatgacagcactgtctgtccctaccctccgggtcctgtttgaaaatcaaacccatgctcacaggccaatttttttttcttttagagacagggtctcactttgtcacccaagctggagtgcagtggtgcgattatagctcaatgcagcctccaattcccggactcaagggaccttcctgcctcagcctgccaagtagcttggactatagctgtgtgttttcttattattttgtagacatggggtctggctatgttgtccaggctattctcaaaattcccggcctcaagcaatcctcccgcctcggcctctcaaaggttgggattacaggtgtgaggcaaggcacccagctcagccacagagccctattgcatctctcttactaggagcaagagctgactgccccctcatccccattccagagtgttggggctgtgttcagccgaggccgggccactggcatggcccagggagcgggatcattcactgctgccccaaatctgagatcattccaccttgacaagacttcctcatccaatccctttacttgacagctggggaaaccaatgcgcacagagcacccccagctcactcggggtctcagagctgatccatgagcggaggctgagatcctgggatcttgtcccccagcctccctgcaaccttaatcccgttctgctgaaagagatggggccggacctcgaccagcagccctggcctggacatgactgtgctcatgcaggtattgaggccgagatgccccggcatcatatgtttttctattttcttttttttttttttgagacggtgtctcactctgtcacccaagctggagtgcagtggcatgatattggctcactgcaacctctgcctcccggttaaagtgattctcctgcctcagccttccaagtagctgggcctacaggcttgtaccaccacacctgactaatttgtgcatttttactagagacggggtttccccatgttggccaggctcgtgtcgaactcctgacctcaagtgatccacctgccttggcctcccaaagtgccaggattacaggcatgagccatggcgtcacttaaatgtagtgagaggccgggcacagtggctcatgcctgtaatcccagtactttgagaggacgaggctgtcagatcacctaaggtcaggagttcgagaccagcctggccaacatggtgaaaccgtgtctctaaaaaaaaatagaaaaaaatagccctgcatggtggtgagtacctgtagtcccagttactcaggaggctgaggcatgagaatcgcttaaacctcggaggcggaggctgcagtgagctgagatggcgccactgcactccagcctgggtgacagagcaagactttgtctctaaataattaaataaataaatatggctgagcatggtgccttaggcctgtaatcccaacactttgggaggctgaggcaggtggttcatgaggtcaggagcccgagaccagcctggccaagatggtgaaacactgtctctactaaaaatacaaaaattagccagctgtggtggcaggcacctgtaatcccagctacttgggacactgaggcaggagaatcacttgaaactggaagtcagaggttgcagggagccgagattgcaccactgcactctagcctgggcgatggagaaagactccatctcaaataaataaattaataaatacagagcaagattccatcttaaataaataaataaataaacatacacctgtaatcctagcagttcgggaggctaagacaggtcgatcacctgaggtcaggagttcgagaccagcctgaccaatatggcaaaactccatctctactaaaaatacaaaaattagccaggcgttttgatgtgtgcctgtagtcccagctacttgggaggctgagacaggagaattgcttgaacccaagaggtggaggttgcagtgagccgagatctcggctgcacttcagcctgggtgacagagtgagactgtctcaaaaggaataaaaaaaatacaaaataaaaaaaatgtagtaagatggcagagtcgtgccgcggaagcgtgctggtcctatccatgtagtgaaggctgatttcatacagaaatgtcacaagaactttttttctttttctttttttttgagacggagtctcgctctgtcacccaggctggagtgcagtggcgcgatctcagctcactgcaagctctgcctcccgggtttatgccgttctcctgcctcagcctcccaagtagctgggactacaggcctgtgcagcagatgcaggggggccactaggcccaggcagtcttgggacttgtgtgtctcctgctgtgcatccatactgggtgctttagaaacggcaggcagaccagaagcccctgttgcaagtgaggacaaagtgtgggaaggccgtgagggtctgcagtccgagatggcctggtcctcaacctgcagtgcactgttgatgcactggaatgccgcctccttctcccagtccaggtcttcagcagtgacccggtaccccagctctaagggaggtggcagcatcaaaggctcccctcgcctgcgtggcagcaggggaaacttgcatctacggggcctagaggcctgggatatgggggagccacccctgggagcgagtgtctgccctggtgctgtatctgccgtcttttcacactgggtgtgacccgaagagacagcctgaggtccgtcctcactcactgtgtttgaggaactgagggtcagctggcagtgggatgaggctggcccctcttccactttcgttccgggaggcctcccgtagagctgtaggggctcgagatggcatttcatttggggcacgagctggtccgggaggtctgcgatctctggttctgacctctgggcacctgctgcagctgtggctgaggcccagaaatgtgaagggcctccatccactccagtagtgaccccaacgtggggttcaatgcggaggggggaggggctgctgcggcagctgcaggagcagaagtgccacgccttgttcttctcatgcccgcatccatgcttgcagctgggaagggggcaggaatcagcgaggtgacctgggctgagtcctgggaatgggaagaggtggcaggaaggggatctgaggaggagaacagggggcctggtggtctgtgcttcttcccagacatgggagctgtagaggggacctctgcagcagatgctaagggggccagtaggcccaggcagtcttgggacttgtgtgtctcctgctgtgcatccatactgggtgctttagaaacggcaggcagaccagaagcccctgttgcaagtgaggacaaagtgtgggaaggccgtgagggtctgcagtccgagatggccttgtcctcaacttgcagtgcactgttgatgcgctggaatgccgcctccttctcccggtcaaggtcttcaacagtgacccggtaccccagctctaagggaggtggcagcatcaaaggctcccctcgcctgcatggcagcaggggaaacttgtgtgtactgggcctagaggcctcggatgtggaggagtcattcctgagggtgagtgtctgccctggtgctatatctgctgccttttcacactgggtgtgacctgaagagacagcctgaggcctgtcctcactcactgtctttgaggaactgagggtcagctggcagtgggatgaggctggccccctcctccgctttagccccggcaagcctcccgtggagctgtaggagctggagatggcatttcggttggtgcaggagctcgtccaggaggtctgggatgtctggttatatctgatttctgacctctgggcatggaggtctgtctgcagaggcccgggcccgggcacaaagggagagaggcctccattgtcccgcaggggccgaaatgcagacggtgcatccccggtgacctccgggacccttctctgatcaccaggattctcttggactctagggtccttgtcctgctcaggcatccctgccccgctctccttgagggccctcaacactatcttccctggacacaagtctggggacagccgggtgttgtggaccccaaaggggtgactcccggctcctgggccccacagagagtccatgttctcagtgcagtggctgagctggaggacgccctggaactcggagcacacagcactggcttgctgtggtacctgtgcaatcaaattgaaggcaggatcccaggaaggaacgcagcgcttgcaggatcaccgaaaaccttcttagagttgtcttgacaccactgatgtcaagtgtctgggtacttgtaggatggcctgccactcagtgcacgggcaggagcaacggggagatcccacaggcaaagtgaactgggggatgggctgaacgggctccaggcaactgagccctactggcaggtcctcggcctgggcccgaacaggaaggaggggcacagagtgcccaggtaaccgctcctgggagcagtggggaaccgtcggttgcttgaactctcgagagctgggctctgagcgtcctcgtccagccgccaactcggccaacggctaagccagcagtttcttctgttgccgggcaacgcgccttttaaacctgagggagcgggcgcgtgagcacatcacggcgcccgtgacagagccagcttaacggattaataagcgcagccaggtacccgcgcgaggcacttgctggcaatggcgggaggcggacgtggggggtcatgcaataggtactggaaggagagaggcgggcacaaaggtcgcgggaggaacaggtgcccacaatggcggcagatctgcccgtggatcactgaagattcctgctctcctgctgaggtggagattgcagtgagctgagatcgcaccattgcactccagcctgggcaacagagtcagactctctctttttttttttttttttttttttttgagatggagtctccctctgtcgcccaggctggattccagtggcctgatctctgggctcaccgcaagctccgcctaccgggttcacgccattctcctgcctcagcctctggagtagttgggactacaggcgcccgccaccacacccggctaattttttgtatttttagtagagacggggtttcaccgtgttagccaggatgatctccatctcctgacgtcatgatccgccctcccaaagtgctggcattacaggcctcggcctcccaaagtgctgggattacaggcgtgagccaccgcgcccggtgttgaaactcccttgaggcattttcttcggccttcgggtccatcctctgtctcctccttgacctcctcatctcctcctcgccactgccttggggaccttggccaggctcatggcatccagcagccactcaatgtcaatacctccatgttcatctctcagcccgcccttgcccgtgaacccatgcttatttatttattttttttatacgtgcacccatgctcttcaggtctgatgaagtatccaaaatcaagctcctgaccatcctcaaacctgccccttctgcagggtttacctcgctagtcggcgccatccttgattcttctctttctcccacccaggccatcatctcttgcctggttgatacccacagcctcccctttgggctttatccttatccccgtcatagctgccagagggaccctgtgaaaacactccccagcctgctcattcttctgccctaagcctgcatggcacagagcaaaagccagttgttatgggacctaggaggtcctgtgggatgggccccagcctgcatcttcatcctcttctccccaccccactccattcactctctgcctatcgctcaccagcctataccacctgcctcagggcctttgcactgaccatttaggcaacattccaggctcttttcacacgttgcctcctctgagaagccctccctgaccactctgcccatacctcatgcctcttgattccccttacctggcttgtggtttcagcactttccctgtgtgtgtttgtttttcttggcatgagggcaggacctaagtgtctgttccctgttgattccccagttccaggcatgcagtgcaaattctagaaatattttttgcatgaaggaatgagtgattgaatgcagcaagggtctggaggctgaggaccaggcagacagacattcagagttgctggaatgcgacagagacagggagtcagactggtcatgcaagatcctgggcctgcccttgggtcctggggagccacggaaggttgtgggtgccagagggttgtggtcagagccacagtcaggggccttctgagacctgtgtcccctccccaccctccctccccacctcctcaggccagctctggggtctcggcaggtggtccacaacatgacctctgagttcttcgctgcccagctccgggcccagatctctgacgacaccactcacccgatctcctactacaagcccgagttctacacgccggttgatgggggcactgctcacctgtctgtcgtcgcagaggacggcagtgctgtgtccgccaccagcaccatcaacctctagtaggggctgctgggccgcctgggtgggaaagggccaggggcgggtggcccagggactgcccacttatccagtaaggtggctccatcacctcttttcctggtgggaaactgaggcccaaccttggtagcttatcctgggcctctcagtgagtatgtttgagcctcagtgggtggatagggaccaggctgggccaggcaaggtcaggtgctgtctgacctggctgggcggtagctttggctccaaggtccgctccccggtcagcgagatcctgttcaatgatgaaatggatgacttcagctctcccaacatcaccaacgagtttggggtgcccccctcacctgccaatttcatccagccaggtatggggtggaggtctggggatgggggactggggtggagaggggcgggtgtcctgggcaggcagctgacgggcatccctgtcttctcccatcggccacagggaagcagccgctctcgtcaatgtgcccgacgatcatggtgggccaggacggccaggtccggatggtggtgggagctgctgggggcacacagatcaccacagccactgcactgatatgtgtcaccccttttctccctggccgtgcccaccctgcacagcccccaagccatgctgatcacactcccatgccccaggccatcatctacaacctctggttcggctatgacgtgaagcgggccgtggaggagccccggctgcacaaccagcttctgcccaacgtcacgacagtggagagaaacattgaccaggtgggccgggggttggagaaactgagtcacggtgtggggccccagggcatcctgggctggaggcctggatcatcacagagtggacaattgttggtgtcctctctctagtgcctgggccatctggagcccctgtgccatgagggccaagccccctgctccagtgagacccagcaggccccaacctgctcttcctgatgacctggcccgaaatggcaccacctgggctgaggcctgtgaccacacaggtgtggttcaggtggcatctggagccctgctcaggcttcccctctcctcccacccccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggactggcttcccctgtgagcagcagagcagcacaataaatgaggccactgtgccaggctccaggtggcctccctgccctgtctccccactctctgggcctcagtgtattgtgtgtgaaatggagccatctgactggggaggaacagagaggtgggattcggagatcttcacaatgcggacactggaactagcctcagcatcttcagcatggggagagccaggcacatggctgggggccaggggaaggttcacaccaagccctgcccctttccaccctgatccctcggactttggggccaggccctcccttactggggctgggcagtgacactacctaggatcagccaccagggggtgccacgaccctggcactttcttaggcagagggtggccagctgatgctgggaacccgggcgccttctcagacccgtaggcgtccagctcaccctgccgatgacactggaggtgaagctgaggtccgaggaatggggactgggcaacaggctggaggaaaacatctcggtcagagccacgcccctggggggtttccaagagcaagcccagagtgaaacccaagcttgtgatcctctccagagggaggcctggttctcagggaacagcaaacgggaagatgtccccagatcccagggatcagggcttggaccagccggggacgcagcccagagggagtgggtccagaaggaaacagctagacacagcagccttcaccatccgcagcccctccaggcctccctcggggcctgctccctcctctgtgcacagttccaacacctggggcagggttctgggaagggctggtggaggtgggctggtgggaggcggtgatcacagcccagcacctggatatcaccaggggcactggggccaggggccaggtgaggccaggtcggggctatccttcaggagccccgaaaacctggtgattccaaagggcccatagacaaacaggtttttatgcctgtggagtcaagtcccactgggtctgagctctgcagggctgtgtctctggggctctgcaggggtgagatggaggtgggctcaaatggtgtacaagtcactcctcaatccttattttatttatttaatttttttaaaaaaaatttaaaccaatagagatggggactcactatgttgaccaggctggtcttaactcctgacttcaagcagtccccccatctcagtctcccaaaatgctaaaattacaggggtgagccagtgcacccagcctcaatccttattttggcctgagaggaaaggccgtggccccatttgcaggggagaagactgaagctggaggggcaggccttgctctgggttgcacagcagcaagagaagtgggagctggccacgaggcttcctcgactcgacacactggtggggtacaccctggttctccaggtcccatggggctcagcccaggactacctcggggggtgaggtacttaaatcctctccttcattctcatcgccctttcccccatcatttcctgaggaagaacattcagggacctgaaggggtggcctgcccctccacatctgtgggtgtttctcatcaggtgggacaagagactgagaaaagaaagagacacagagacaaagtatagagaaagaaaagtgggcccaggggacctgcgctcagcatacggaggccccacgctggcaccagtctctgagttccctagtatttattgatcattatctctaccatctcagagagggggatgtggcaggacaatatggtaatagtggggagagggtcagcaggaaaacatgtgaacaaatgtctctgtgtcataaacaaggttaagaaaaaggtgctgtgctttgatgtgcatatacataaacatctcaatgcattaaagagcagtattgccaccagcatgtcccacctccagccctaaggcagttttctcctatctcagtagatggaatatacaattgggttttacaccgagacattcctttgcccagggacgatcaggagagagatgccttcctcttatctcaactgcaaagaggccttccttcctcttatactaatcctcctcagcacagaccctttacgggtgtcgggctgggggacggtcaggtctttcccttcccacgaggccatatttcagactgtcacatggagagaaaccttggacaatacctggctttcctaggcagaggtccctgcggccttctgcagtgttttgtgtccctgcttacttgagattagggagtggtgatgactcttaacaagcatgctgccttcaagcatttgtttaacaaagcacatcctgcacagccctgaatccattaaaccttgagtcgacacagtacatgtttctgtgagcacagggttggggctagggttacagattaacggcatctcaaggcaaaagaatttttcttactacacaacaaaatggagcctcttacgtctacttctttctacatagacacagtaacagtctgatatctctttcttttccccacagggaccttcctggctgtgcctcgggtcaggaccagaatgacacccattcatttccctgggcctttgctccggtggtccctgcaccctggcctctgcctgacgaggatggtggggagaggaggggggacgtcccccacactgctgtctccactgttcctgctgcccaggcctctgggcttccaggactacagcgggtgggtgggtgggctggcctgagcccaggaatgcacttcagttcctggttgagcaatgtcactgaggcttgggagtcgggtgggggcgggaggaggcgtccacaggccccccctaccgtgagaggcagccgtgggaacagcctacctctaaacaatcactgcagcccaggctgaccaggggctctggccggacataggggcctggcaggctgtgtgccctgtaaggacacagtctgtctctgtgcctcagtttctctgctgcccagatggaggggcccagactccaggtgtacacatctggagcaggcagtgttcagttggggaggaagcggggaggactgtgggggccatgtgggaaggattccaccccacatcacctgcacccctgctgagcctggtcaacggagcccctcagtgggtcctcactctcctggctgcctcccatttaggcaccctgaggcctggggagaacagagccaggccagtgtccctagagaggctgcgctgccagcacagtagtagcggatttggattcagggaagcagacctgcagccagggtgggaaagagctgcaggcggggtggagcccccacatggcacagcccccctccctggaggtccatgctgcatttccaggacagcaagtcccagggatggatggtgcctggtgccaagggctagaggcatggtctgtctgcattccctacaggggcatcttgtagtcaccagcatttgatgctgtcaagtccccctgtcctctgtgcagactgggaagcccttggtcaccctggggggtggggggacccaggccaggctgcagaagcataaggacttgaacccgggtcctgagtgacaccaccttgggtcctcctccctctgcctctgttcagctccaccttgatgctgactaggctgggccatgcggagagggttaggggatagagatgagagctggggagcagggctccactctgggaggggggcagccttgcgggatccagggcagagttaagcggccccagctccgctttcctagagctgctgagaacccgggaaatggtgtggaggttccggggagccctgcccctacctggcaaccgcagtgcaacaggcaccaagttctcctgcacattgcgacagtgggaccctgggctctggcgggcggtaggtggggcctttggacctaccagcagtgagggagttaacacagcagctgacttctctaggcaaggaaaactcccctcagacgctttgctgcctggcctcctgccagcaacaagcaggagctgaaaactagaagctgaggcatgagtttggtcactccgtagtgtgcacttggtgagggcagcagctggccacagctgccagccgtctgtccattcgcccatctgtccatctggcagcccgctgttcagacctgtctgtctgtccgcccatctgtaagcccatctctgtcccattgtctatctgaccatctttctcttactgtcctctttgtctagctatctggcctgtctgtcgatccatcttcgtgtctgtcttcagcccccacctgtttgtccatctgtccaattacctgtgagtctatctatgcatcttcttgtccattcatctgcccacccatctgtccctccgtctgcccaccggcctcccctctccttctgggccgcagagccacggcccaggactgcagagccatggttggcctggtcctgctggggctggggctggcgctggctgtcattgtgctggctgtggtcctctctcgacaccaggccccatttgacccccggcctttgcccacgccgctgttgctgctgactccaaggtctgctcggatattggacagtgagtgagatgtgggaggaagctgggtggcccttggcagccagcccctcctggagaaggcgtgtgtgtgtaagcgtgtgtgtgtgtgagagattatgtgtgtgtgtgtgggtatgtgagtgtgagtgtggggtgtgggtgtgtgtaaatgtgtgtgatcgtgtttgggtgtgtgtatgtgtgagtgtgtgggtgtgtgggggtatgtgagtgtgagtgtgtggggggtgtgggggggtgtgaatgtgtgtgattgtgttttgctgtgtgagagtgtgtgtgactatgagtgtgtgagtgtgtgttggtgtgtgggtgtgtgtaaatgtgtgtgattgtgtgtgtgagtgtatgtgtgggtgtttgtgggtgtgtgtgagtgtgtgagtgtgagtatgggggtgtgggtgtgtgtgaatgtgtgtgattgtgtgtgggtatgtgtatgtgtgggtgtgtgtgtgcatgtgtgtgtgtgtgcgcgcacgtgcactggcccaggaagcaggagccgtgtgtgtgggcttcagcacctgcaggacttgagcgcaaggagacagcctcagggcccttgcacagaacaggtggcagggtgtgcccgtggggcagatggggacttggggacaatggtggtgtgtgagtccatacctggctccaggattcaggaggcccatttgcatatcccaggtgggaacctgtctggccccggctgaccctgctggccggtgcaggccccttcagtgaggccaattctccaaggctgcggtcttctcccagggtcatgggtgaaggggtttggaggctccctgcgtgggtactggcctgctggggtacacacaatgctgccatagccagtctgcccctacacccagcccggggccacatctcaggtctctcagtcctgaggagcccggtgccccacccctcacatcctctctccctgagtcagggcctgggtctcgtgagctgagtgactgatacttggtgtcctggatgagggcgtggtggagaggggccacagcgggtgtttcctgaccctcttccaggaaggtgctgctgccgctgcagggaggacacatacaggatgccccttcctgccccctgcctcccattgggcccacaaaagccagggcaagcctcccctccctgccagccacctggtctgcttcccagaaattctgtcttgcaggctgttgggaggatcccagtactttgtaaactaaagcaagggaggagtggccgttctctctctttgctcattcattcaccttttcattcattccttcttccctccattcccccatctgtccatccttccctgccctgattgctcatgccaccccccctccagcccctcctgacctggtcctttggtttctcttcagggctttctgtctcctcccacagggctgagaatggcagctcagggacaagtgggggctggggactgcttagtctccccagtggctctcaggggatttgagggtttgacgccagctgccaccccaggctgtgcccctcctctgctcaggaggacatgcagagatgcgacacccacttaaactcgaagttgcaaagatgcaaatgagactggggtctcaggcaccagagaccacccatgggcacgtggcttttgggagtggggacctgctgccacagatctctgaagagtctggacctgctgggtctccccgagtgactgtctgggggtctccatagcatgccctgctgtgtgcgcgacggtcactggttgggtaggggtctctactctaaagctccctctgccggcatcccctcgaactctcccttggtgaagagaggatgtggttttcccccagtgttttatcaaacaactctctccacttcctgttttaagaagctgggagtggaagagagcctggggctggccccagctgctgctgcgaaacaggggtcactggacgctgggaccctggccgggctggctggaggcctcaggaagaggcctgctacagtgtcatcctggccaagattcctccctgcagaggaccctggccacactgccacagggtctgctggggccaccagaagcccatgctcctgcctccatctctcccctttgtgctcacctctcaccaggaggccctcccagagttcagtctcctgcttttctttttttttttttttgagatggtgtctcgctctgtcaccaggctggagtgcagtggtgcgacctcagctcactgcaacctctgcttcgttggttcaaatgattctcctgcctcagcctcctgagtagctgggactacaggtgccagccaccacgcccagctaatttttgtatttttagtagagacggggtttcaccatgttggccaggatggtctctatctcttgattcgcccgccttggcctcccaaagtgctggcattacaggagtgagtcatggcacccggcctcatctcctactctttcagcaccaggttttattcttgggattctgctacagccgcagcccctgggtgcgagctcctaagctttctgcgagtgtggacccagcaccgtgcctagtagacatacaaaaggaacatggtgacagtgaggtctgtcatctccagcataatgactcttttgatccttgtaaaaaaggtgatttttggctgggtgtggtggctcacacctgtaatcccagcactttgggaggctgaggggggtggctcacttgaagtcaggagttggagaccagcctgggcaacatggtgaaaccacgttctcctgggtgtccaggtggtccaagaccccatgactatatcatgacaggaaagagagagttaataaatctgagggcataaaatgtgaacatatactgtttccatcccacatgaaggcacatgtgtctgagcctactctctgggaggaatagagatctcagtttccacatcagggttgcattctatgcacctgcagccatgttattctgctgtagcagatgctacacttggcaccgacattgcagatgggaccatgaccttactggagttgtagaaatctactttcaccttccagaatccatttaatgtttataggagctagtccaagaaattagatggaaataaagtcctgctacaacctgagaatctttaggcctttaaaggtaacactattacatgcaactcccaatgaagggtgaagcatgattattatttaccttttttgatggggtgaaatggggagagagtcggaattcatcacatacataaaaggcaggtcgtataaatgttagtgtttgtgagtcacaaggtctgtcttgcagcgactcagatctgcacttgtggcatgaaagcagccattgactgaacataaatgaagggatatgggtttgtttaatgaaactttatgtacaaacgtaggtagtcactatggtttgctgaccccagcttttccattgccccatggaactttctttgggatgcctttttgcagtgggttctaggtgagaaaaattggctcggatctggatgctgaagttgagactggtgctgtcatgtggctactgccctcgtccatcctgggtgacttctgactgttgtgatgagcagggccctttgtggctgcctagctcctggtgccaagaatgatgaaccctctgcattgccctctgcaaagcagaccacaggacagccaccctgaattgctcgttctcactgtgtccaccttgcctaagatggttgggcacattcactggctggttaattccagatagtgttatctcattaatgccaggcagtaccttctagaagaggctcctaccatctgcactagactatggagcttctccggggtgctagtgctctgtcacctgaatatgcttcagggatttgctaaacagaatgtccttcaggccctcccatagaacacagggaaacattttgttttcccttgtgtgactgcaaaagggaaaacaaaaataagcctgggaaagggtgatttaggactttgatgatgtcgaggctgggaactcccatcagagtttctatatatgatggggaggggccaattttttgaaagtcagcattgactggccattggacacaggtggccctacattgactctctcttgcccaggacctctcctcaaaaagtctcaggtgattcagccccacagcagcaggggcacgacaccttctgtcctgaaggctgataaccggtgatgtggacagctgccattcactctggggaagatgctgcctaattccacacccaccgcctgcatgtctagtgagagcctgcctattcctatggggacaccccaaaattagctccaccaagaagcctcctccacctccattctccacagaagacactcatcttatatgcttggctacaggtcctgtttgctctgctattatccctatcacctgtccctgtctgttcaattgtctcacatgagcagagagacgatgtctcattcagccttatttcccatgggtattaataaatattcattgagtcaattaaaaattcatgtaataacctatcaatgcatgtctctgtgtgaggtaaagaaagcatcctgattgtaaatataactctcatgttaaaagctgggagcagtggctcatacctgtaataccagcactttgggaggctgaggagggtgaattacctgaagtcaggagtttgagaccagcctgatcaatatggtgaaaccccatctctactaaaaatacaaaaattagcagggcatggtggcgtgtgcttgtaatcccagctactcgggaggctgaaacaggagaatcacttgaacctgggaggcgaaggttgcagtgaaccgagatcatgccactgcactcctgcctgggtaacagagcaagactccgtctcaaaacaaacaaacaaaagcattcttacagattatcttggcttttattcctttattctaccaataagttgttagcctctcttatgtgccatttgttacaaaaaatcagctgtcatttttatggagactgagaagtcccctgatctgtccattgtaagctgaagacccagtagggccggttttatggattagtccaagccccaaggcttgagaaccaggggagccactggtctaagactcagtccaagggaaggagaggatcaaggtcccactcatgcagtcacacacaaaggaggaattctccctgctggtgccttttgttgtatccacgccttcagtagatttgatgatgccaaccacacagaggagggcaaagtactaacttagtccaggcattcaaacatgaatctcatctggaaacaccctcatagacacactcagaaatagtgttcaatctgggcacctcatggcctagtccatttgacccataaaacttaccattactatcattaaaatggcatacgttatgtatattttgttaccataaaaaatttacattctgaaaataaagtacagtgtcttagctcatttgtgctgctacaacagaatacttgaggttgagtgatttacaaagaacagacagttatttctcacagttgtggaggctgggcagtccaagatcctggtgagggcttttatactgcattctcatgtggcaaaggcagaagggctggagaaagctaaaggctgcatgaagcctctttcctaagggccttaatcctctcaagagtgaggagctgtcatgccctaattgcctcttaaaggccatctcttttaacactaccacactggcaacatctgaattttggagaggacacattcaaactatagtagcaagtttaatttggaaataattctactcaaaaaagcattagaattgagtaatgaaaccctgtatatcccctccctggatgcaacaatggggtacgttgagtccaatccagggagcattctcgcttcctctctctactccatcttaaaaaattaacaataattttctgtccactccataatcccatttcaccaattgcccaaaatacctacagtagttatttaattatgtttactaacagaatcctcaagattccaacccttatatttgatttttacttctctctgatcgatctggcatttatcgacgaagattccatcaaaccctgggcttatgaaaaattttgcaaaaattccacagataggaaagtgttcattgtgtgcagcagaaaaatgttcatcatgcagagtggaaacatgtttatgtgtggcaagcaatggtaaagtgagtcctgcattttaaaatgaaaggacagtagatggaaattagaggtcacactgtgaaataatgaattctgttaaaggcaacaacataggttagtataaaaggcagcattatggtatttttggttagtaacttctctttggaaacctatcacaagcagagagactgaatccataattaaaaccttccagccaaagaaagtccaggaccagatggcctccatgttttttatatcagccatttaaagaattagcatcaattcttatcaaactctgaaaaactagaagaggaagaaactattcctaacgagcccaacatgaccctgaccgaagtcagttaaagaccctacaagatgtgacaactaaagaccaatatacctcgtgaatataggtgcaaacatcctcaaaatgtgtgccagcaacatgaatccaacagcatattcaaaagattatgtcatataactaagtgagattaatatcaggaatgtaaggagggttcaatataagaaaatgaatcaatggaatatacaacattaatagctcaagagagaaaatacatattccaaataacatagaacaacaaaatccaacaccttctctaaatgaaaaaaaaaaagcacccagaaaactagaagtagaaggaaacaacctctgtgtgataaaaggcgtttgtaaaaatcccacaacaaacttcatactcaataatggaagaccgaaagctatccctctgacatctccggatgcctaaccttatttaagtgagttcagcaaagttgcaagatgcaagatcaccatgcaaaactcattcatatttttttttggggggggatggaatcttgctctgttgcccaggctggagtgcagtggctcaatttcggctcacctcaagctccgcctcccgggttcacaccattctcctgcctcagcctcccgaatagctggaactacaggcgcctgccaccaagcccagctaattttttgtattttttagtagagacggggtttcaccgtgttagccaggatggtctcaatctcctgacgtcatgatccacctgcctcggcctcccaaagtgctgggattacaggcagagccaccatgcccagcaactcattcatattttatatgcaccagcaatgaacatctgaaaaagaagttttaaaagtaactctatttacaagaccaccaaaaagaatacaaataaatttatccaagaagatgaacttcttgtacactgaaaatgtcaagacatttctgaatgaaatgtgcagagatgcctcaggtggctcctgcatattccgcccctggtgaagcatgtttgcattttcttgggaactgagcacctcctgcttggtcgtaaggcagacaggccacacagagaagaataattcctccctttgggccagcagttcagggatcaagaaatcctagacctgaggagtaatttctgaatctacacctagaccaaggtggtgtctgagcctccagcagtcagtgaagagcaaccagcagtggtcaacagagagtcacatggcaaagccgcctggagctgggctggacctgcatgtcagggagatgctgacatgcagggagggtcagtgaccatgacctaacactggggggaaaaatgtccttctttttctagagtatcatcgttaacattgatgtacaaactcttttgccccatgtctcttacatctggctcttttagaatttgcttatttcacagcaacaagttcaagtcttatactacattgcatcccagcccacccaattatgctaaaactctggatctgtcaaacactttcagagcagcagatttgtacctggccctaaacgcatagtggggacactgaggcacagctcctagggccttcccctgaagctccaccaagggcaaaaacttatacaagcttcatggatattaaaaacctccatgttcacttagcaagggagaaattttattcaagttctgcagctcaggagctgtgctcaagagcaagacccagaacttctcaaagcctggttttggcacctgtagaatggagcccaaaaacgcagacagacttacctcggagctctatagggccaggacagcccaggagtaaagccagtttgagacacaatttggggtgaagatgtcggcccagaatagaaccaggagaggaagaagaaacccgtgtgctgagagtgggtctgctgggaccactcctctccttcctgggccctttggggctgagcccttctctaaaaaccacagagctactccagcagcagcccctgactctgctgatttgcatcatggccgctttatccagcaaggggataagagaggcctgggaggaacctgctcagcctgggtcttgggaagcagcatcgggggtgcctcagccatggcctggacccctttcctcctcggcctcctccctcactgcacaggtgctgcccccagggtctcactcacttgcccagccccaggcctctgggtccagcctggccctaacactgagctcagtagggccctacctgtggtgggcaggatgctcatgaacctgccgcagggcagggggctggtggggcagaaatccccccacactgtgctcctgttctcttggtgccctaagggcacttttattcctggggctcaggtcagttcaggcaagtggcaagatattctttggttaatccccagagtttcaggccttttcgctcctcttttctctccttgcaggctctgtggcctcatatgtgctgacacagccaccctcagtgtcagtggccccaggacagacacccaggatcacctgtaggggaaataatattggaattaaacctgcttaatggtaccagcagaaaccaggccaggcccttgtgcaggtcatctatggggatagcagatggccttcagggatctctaagtgattctccagctccaactcggggaacatggtcaccctgaccatcagtggagcccaggctggggacgaggctttcctctcaggtgtggggcagtggcactgcacacagtgacagaggcagacaaggaagtaagacacagaccccttccccatctgtgctgctgtcgtcctccagcccggcaacactgtggacaaagccatgagcatgcatgacccagttcacctggatctgagacccccagtctttacttccttcagccctccaggcaggctgtgcagagggggcatccagaatggatttagggctgaggtgaccaggatgtattggggttttgtggactccactgtgattcagggaaattagatcttccaagcagaccaaggtcaatatcctcagttatctctggatttccataggtggtgataggccagtccttggccgaaatgtcctgaatcagtccccagaactgcccagctgaggctcctgtcattctctacagaaaaactagtggagtggacactgtgggatcctcccagatcccctcttatgagctcacccacacagcactcctgggagcttctggcagctcagagctgttcggtgcagaaatctgcctcccccaggtttatgtctcttctcagggaggtttggtttcatgactgcctgtggccaaggtctcaagactcttcctcagtataacaggacctgaaaatcctccaagatccatagctccttgtagggctgactgaagcctcaatatgtgtcagggcctccttctgcctggtgttgcctccatcactttcttaatcatctgtgtatgatattctccatctcagagtctgtttccagggaacccaaactaagatcaccagccatccccaacacgggccatgagggagctgaagaggccactgtacactagaaagcatcagtttactcttaaattaccactgcgagtctgcaaatgcccagcgagacctgagtggttttttttttcatttgtgtgaaatgaaaagggagactgacatgccagatgctctgggttctgagggagagttggagtcagatcctcctgcaggaatccaggggcagcaggagcagcctcgccccatgcagggaccacagatgcacccagagggtgagctgcaggatggacactgcccacctccaatctgtatatcctgtgcaaaaaaatcattgttttcaccccttcttcagcctatcaaagttgtcacttaaaaagccactacatctcatcctgtgaacaggaaacccatccacatctccatcagccacataatctccacataaagattcttcaaaaaatagtaataatagctgtgaaaaagtatctaaaatattgcatgacaatcatacttagattacatatgaaaatggcactatttttgatatgctaggtaaataaaatatattatttgaagtcatttaccttcttctctttatatgtctaatgtggtgactagactagcctagtgggattcccattaggctcatcatactgtgattgaacagtgctggtctgcacctcttcaggttaacaggggctgtggagtgacctggtgcaggaaatatcatctccatccataggatatcagtgtgaacccagggagaggcactggtgcaagagagatgagaacaggggtgtggagtaggggactgagccttcactttgagccgaagaagtttcctttcctatcctcaatcctgaacaagagggatttctggacttctttttgttttcaagtttgtgccccttcagatttggggctgtctggaatcctgccaggggacaccgagaaaaaataggagtctcacactgactgttgtatttcatctgctggggccatcccaaaccactgcgtacaatttcctttcctggtgctcaaatagctgctccacgcacttgttgtggtttcagagatgaatctgggtgggaagacaggacagtgtatgttataatatttaaatggaacccaaatccattaatatttattttaatatggaacattaaaagagttttgtaataggcaatgggaaaaggtaaaaaagataaaagctttttgagaaaaaaaacaaaaacaaacttatagaatgtctatgtgtcttcagtgttgcagggttgagagagatcagctttatggtgccccatggatgtgctgagatggggaaaatcaagaaagaaggaagtatgtaccactgtgactcaacaaataaatcaaagtaaaatggacttaaatctttcaataagtcattcacaataaatatcactctggtgcacacagaaatgcctgttagcaaactttcccttccccctggccatgtctccatggatcacctgtgtgcagagtggctccggtcagtgctctgtgttccctccacagggctccccacaacatgtgccctgtgtggatgtgggtgcatcgcctggggtggctgatgtgctccagggattcgatgctgcagatgcctcagcaccaagggtgggggtgggaatgggacaaggctgcagctggggagaccaaggatcaaccacacacagcaggggtttccacggggtgagcagcctcatttcctgacagtagagcgagcctaaaggtaggtgccaggcagtggtatctgtggggtggcccaggcctggagggtcacagagacacaggcaccacacagcagagacactgagggccaggagctcactcaggtgagggacttcagcagatctttctctcctggtacaaagagatcaagttcctaccatcagaatagacaaacaaggactttaatctcctcagctgagccccactgtccagggaagaagtctctgagcccaggcccaggtgagagtgggatgaggagaggagccaggacacagattttcatggatgccccgccctcctctgaggcagagcggataagacagggctgggggcatacccagtgcttgagtctcaggaggcagcgctctcgggacgtctccaccatggcctgggctctgctcctcctcaccctcctcactcagggcacaggtgatgcctccaggaaaggggcctcagggacctctgggctgattcttagtctcctgctcctcaggctcacctgggcccagcactgactcactagagtgtgttttttcctttttccgggctctcgggctcagtctgccctgactcagcctcactcagtacccgggtctcctggacagtcggtcaccatctcctgcactggaaccagcagtgacgttgggcattataactatgtctcctggtgccagcagcacccaggcacatgatttatgaagtcagttataggctctctggagtctctgatcacttctctggctcccagctctggcaacatggcctccatgaccatctctgggctccaggctgaggacgaggctgattattactgcagttcatatacaagcagcaacattttccacagtggacataagattgattctcaggctccaagtctggccagtgagcttctttgagactccctgggatcccagcagtgacactgatcactattgctgtcccacacatcccaagtgatgaggaagtaagaccaaaaccctcctgagattcctgacttgtgtcctgacaccagggctgttgggattcctgtctttccttcaagattgttcaaataagcagtgacagtcacttccatgtgagatatgagaagaagaataattccatatgaaccaaatccacgaagcctacactgaagcctgccaagttctctgcagtccagcgcgatgaagggagcattttcgtgggaacttttgggaatatgaggggagccaggctcagctatgggttccagagacaaagctcctggatgtttctccccggccttggtccatcacctgctacctctcctcactctttccacagacactgccccaggctaagcccccacaggaccctaagcctattcctgaccctgagctcagcccaggtgatgcttcaggagatgggatcctgagaatgagccccaacatctctttaacctaaggtgtggggtcatgagacacctgttagccataagacacctgtcccccacctgctcaggagacagtggagcaggcaacagtgcagagagaaccagcaggagccaggccaggccctgcatccaaagcaggccccagtccccacagattctccagctctagcctgtggtacagcccccactttctgcaggctgaaatgggcttctcaggatgggcaggccatgatgggggatggcagtgtgtccacaggacacagccctgctgcctgcctgaccctcatgccccctccttccccaccctggttaatctccaccagaaagggcccaggttcagaactcaggacacctggatcagctcctggacttgcccccactgctctctgttctcctgagccacttagtctcttttggcctcagtgttacctgctgtgaagtgaggaggcttatactgaactgaggaagctcttttcttcattcaaaattaaaagacagaaaaacaatgaaagtcatgtaaattaaagcctgctgaggggatgtcatttaatgggcttcagtgggtttcagacgtggaacttcttgtcttttctctgcagggattccaagacaggggctcaaaagagcttgctttctgtatggtgggaacagcggtccctagctgagaataagcaggagattcccagcttcatcaggaaggcagactaggctagtgtagaaatcctctccgtacaaactctgagaggtgttgaataaaataaagataaacataatttcatgttttcatggtgccgatgatggtgatgttagctcacaactaagctgcagtgcctggaacatcaggaaatcacagtgaatcacagctgctcttattgggtgggaggtgcaccagtttgatgcctaagtacatagaaagcctgggtccctgtaggatggcacatgcatctctctggactttgaaagctttgcagaagagcttcagttgactcactctaattagtccggactgaacaaaaccactagaggagggcatttcaaccctgagacacttctatagccccaacttcctaccctgcgtgtgcgaactctctgtgctgggctgggcagggcagattgggtcaccctgcacagaatggggctggactgtctggtcctcaacttctgaggtgacaggtgctgtggaggcacgtggaagaaaaaagctcctgggctgagtctcctccaccagctgggggcagcagagctgcagccaggagcagtcaggattaaggctggggctgcccagctggggcaaagagaaggccagcctggcgttcaacaggtgtccaagaatcagtcttcagactgaaagtgagtgcagttcatcctatcccctcaggctgcagtgaccattctctgagggtcagactcatacagtgtcaccccaggacactgacagaagcccggcacagtgaaggcctcacctgggaaatgcagctggaggaggctgggaccaggtgtcaactggggcagcttactcaggaaggggatttctttggagacatcccaaggttgaggtgctctaggagggggcacagcgtgaggtgacggggctcccagggcccgggttcttcacccaggatggctgtctgagcctcctgccactctcagggccttgtccctctcagtccagcagcaacctggggagctgagccctctgtcctgggcacttccagatacaccatacctcacttccttctgcctcaccttccagctccaggcggactctgactcagggggaaactcctgtgctcaggggagtctcgggtgggtggggtgaagcatttgggatcctgatcccttcatggggcatccccagcatccttaaggagacactcttcagagggacagggcttctcacctgcctcagctctgaccatggggctgtccacactcagtgacaggacactgaccagggatctgactggagtgaccaggaacctggctggggcaaccagggaccacccaccctctggagctcacatgctgtgcagagaccatgaccctgggaccccttcagagaccatggggcctgaagttagattttcagtccagtgtggttttctcctgctttttgcaagtttacataaaacattgatgagaaaaacatacataaataacagacgagctgagggtgccaattgctaatctcttgtggcaatgaggggtgatgtagcaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctgggccacctgctgctgagtcaggtgtcagcaagatctctccgcagagcccagctcagcccatggccaacctcctggaaggtccacagctctgctgagcctggcccaggacagaccccaggtcagcgaggtttgggacagtggtcatgagattaattcccagaaaggtgactgtgatcacagggcttgaaggctgcagctgattttctaatctgagaccctgcttcttcctcctgttgcctgtgctgccctcacagctggtttgagtgacatctctccaggaggaatcgcagaggatgtaaatttgcataaacgccaaacactgactgcccccaaaagctggagagggaataagagaggcctggggagcccagctgtgctgtaggctcaggaggcagagctctgaatgtctcaccatggcctggatccctctcctgctccccctcctcattctctgcacaggtgctgcccctaggctcagtctccacagaccccaagttgagcctgacctgaatcctgagcaaagccctgccactgcctctgggggggattcctggcaatgcgtcctttgtcctcaagccccctctcctgtcttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaatctcacagtgacacaggcagatggagaaatgagacacaaaccccttgccatctgtgtcaccttcttcctccagccccaggaggactgtggacaaagccacgaacaggtctggcccagtacacccagatcagagactctgaggcctccttccttccagatctctacggaggccctacagaaggtggatcaataataaattcggggttggcaggtccagtaggtcctggtgttttctgggctggagtgtgacttggggaaaaatgacttgaatggaagtacagtcagtgggagacatctattgagtggtgatggtcccagtatttccttgtgtggtgactgaacctagggcagtgccactactctgtggcccaaatgccctgggttattcctctgagttccccgtgtattattgagatgctccagcccccactctcatggtatcctgatctgaagaatcatggccagtgcccattgcagtgtctccatctaggtgccattttcaggactcatgcatccagcatccaaacaaggctgtgtgggagaccgtgacttgtcacagctgttccccactggaaaatgccactgagctgcagagaactgctctcccagtgatgttcccccttcacagtgtggttcaggtgcaatgcctgcctggtccctagattttaatgccatgttttcatttaaaataaccacgaagtgtctcttgctgagcgctccggtgtaacacattcccagtcatgcctctcacaattttctttctgacaaaatttcctgaaaccctattgcaatgaattctccctctcagagtaggattgcagggagttcacaaattaacaaacaaaccaaatactgtctagaagaaagaggatcaaagaggagagagctgcacagggagcgcactctggagtctgcagatattcatgagcaccgatgagcatgtgcatgggaggaaaccttctgtgatagagaaaataaccattcaaagacatttgaggaaacactccatagagctcacacacacatccatgtgcacacacatgcacaatcagaatagtgcctgttcctccgctccatgaagaaaggcccgagttaaagtgggtgagatttaccagtgagaagagctttgcctcagtactggggaaaacattgccctagacaaaaggcatctctggtgttaactaagaaagtgtacggcccctgtgctgatgcccatgtcaaagaccatcacacgtattttaaccaactagcccagagttgtcaccaagagtttgatcttacaataattctgcaatgaacatccctattcagactccttggagttcacctatgaagattaccatagaataaatctctagaagttgaattgttaggtcaaaaagaagtacgtttgtaattttcactgattattctcagattcctattcacgggggggttgtaccaatttacagtgccagccataaatctttgacgtgagtatgctgttgaaagtttgggtttttgccaacatggtagattaaaattttgttgtcttgtaacagtgttattttggatttctcctattctgcttgaggttgaacattttctcaaacatttcagggctcttatattttaggatttagtgagcttttttctaaaatggccaggtaaggagggttttagcccctgtgggccaagagtcaactttgaccatattatgagggaacttataactccagttacaatgtaaccatttaaagctataaaaaccactctcagctctgggaccacacaaaacaggtggcaggccaggggtggccacaggatgtggtttaatggtccctgttttgtagggtcatttgaagtttaaaaatttcaccagcatatattttaggtggagatctttttgtgggtaatactgtatttcaccgcctatagtggcctgagatttctctctagataagaacacacttttcttattttttggatggattttgggtctatctgtgatagccctgtgtcataaactcataacttttgtgtccgtccttttactgtgatttttgggagtgtgacagtatatcaggaatacactatccagggtggaaaatcagagagagggggaggagcaagtgggcaaggaagcttgtaccaaagctggaatatccactgcagcaggctcagagaaaagggtcctaatatcagcatttgactgaagccaaaaccacaagagaccatagaggttctgaggatgacaaataaaaacatagtttaagttttaatgcattcattatttttataatccacaaaaattctaaaactcagaatttaacaatgggataaggaaaagagtttgagatgttaaacgataaagaccccaaggaaagttgccaggaaaagaacaggacctttttggtggaactatgtttatgctgtaaattaccctcttctatatgtctatatatatatttaggtataagagaacatctcatggaacacccttcttcaccacagtcaaagatcaccctcacccaaggagggaaccgaaagggaacgtcaatatgagacagaaaacataatgcacttttgtataaacattaggagagtctctatttgcatatcaaatgtggatgcttaatgttaacattggaaatagtaggttaatatgcatgtgaggtgagttttcttttgactatttctgtctgtgatttatctttcttaatagggacatttctgcccttagaacaacttaacttgtgatattttttgttctattatctgtatcagctctgttttttttttttcaaacagtggcaaagatatcccatgactaatgattaataaattcaattaatgggtatttaaattatttcaagagtggacagttgtgacttccccacatctaactcacagatgtcgctgatgctgactcactcttctcttccaatcatagcaaataaagtgggagctttgacttttctgaagacccagatgacaacaggagagaggaggtgaaaccccctaaagctgttatcctttaaaccctcaggaggaatcatcctggagaaacacccacacttgagttggattatacctaaatgagagtttggtcttagagttggtgctgagttagttcaggatttgggttgttgggatggagtgaatgcgctttacaagtgaaaaatacatgagtttttgggtccataggttggagagttcttggctgaattgtgtcccccagagttcatacaatgaagctctaatgcacggtgtgtgactgaatttggagagaatctttaaagaggtgattcagtgaaaatgaagtcatgagggtgggttcttatcgaatctgactggtgttctcgtgagaagagaaaatttgcacacacaaaaatgagacactcgagatgagcgtgcagaggaaagaccgtgtgaggactcagcaaggaggtagcgacccgcaagccaaggagagaggcctcagtgaaaaccaaacctataaacactttcatcttgactccccagcttcagaactgtgagaaaataagtgtctgctctttaggccagcaggtctttggtatctcattaaggtagcactagcaaatgaaaacaaaagggaccccaaagaccttggatgcgggaggaggaggagatggagcagggtgcaggaggtggggcagggaggggctggaagttcaggctctgaggtcatctcctgggtggaatcctgactccactcactgctgtctggggacttggggaaaaacaattaaccgcccaatattaattccatagtaaagatcgggccttgagcacaggattcctcatcttccttttttatatgatgaaagtcttcttgaggtcatgcttgtaaaacactcagcaatgtatctggcatacactatggtctcagaagtggttattatgaattttctagtgatatgtagaggatgacattggtcctgtgggcagagggggcactgtggaccttggtttgaggactctgaaagacaccaagtccgctggtagtgctcaagagcgaagagcatcacagatgcttcctcccaggccccttctattgggtaaaatttactctccactcctgacacccatctggtccttcttctgaccttagcacattatcagtttgaagacttaaggctcagggctcagatgggagctaggacaggcacactggggaatgaggagtagatttgcattcactgctcatcagagagcccacccaacaaggatacaagaataaaagaagtagatttgcatgaagagcctctccttcccatgataagagaggcctgaaggtccctccccagccatgggctcagagacagagctatgtggcatctccaccgtggcctggacccctcccttgctcaccctcctccgtctctgtgctgcctcccagggctcagcccccaaaggaccagagatcagactggccctgagcttcagctcagcacagggagtgatgcagagtgtggggctctgggaatgaccctcatcctcataattaactctcctgtcctctcttgtaggctctgtggcctcctccatgctgactcaggagccagtagggtctgtggccctgggacagtcagccagggtaacctgccagggagaaaacctaagaagccatggtacaaactggcaccagcagaagccaggctaggctcctgtgcaggtcatacatcgacaaaataaccagccctcagggctcccagaccaattctctggctccaagtcaggaacacagccaccctgaccatcactggggctcaggttgaacatgaagctgactattaccatcactcatgggacagcagtgctactcacctcacaatgacacagacagattgggaagtgagatctaaagaccttcactgtctgtgtcaccctcttcctccagccatagcaggactgtggagacagccatgagcagggctggcctgggtcacctgcatcgaagtcctccaagctgcccttccccccagctctccaggtagtctctgcagagaatgagtcaggataggatttggggctggcagaaccaggctgtcctgctgttatttggaatggatgtaccttggctcaagatgacctgagccatcttactggaaggacttactggaaggacggtaagagggagacagctcctgagtgctcatggtcactgaatttcctcctgtgtgttgactgaacccaatgcagtgcctctactctgtggcccaaataccctggattatttttctgaactgcccgtgtttaactgagaccctcaagccccagctttgtgcatcctgatgttctgaacatggaagcctttcacagtgtgcactgtgacatccctcagattcccgtttcaggacttatgcacccaccatcctcccagggctgcagggaggccctggcttctcacagctctccccaccagaaactgccatgcagtacagagaatagctttgctcaaagaattgcccatttcagagtatgtttcgggggcaatgactccctgatgccttaatctgaaagtcatgctttaatttaagaccctgaatatcaaattgaagtgccttctagctgaacactcaattgtaaaacattcccagtcacacactccacacttctttcctgagaatatatcctgaaaccctattgcatggaatcctccctctcagagtaggattccagggaacttaaaaattaaaaaaaaaaacaacacaccagtctagagggaaaaatattgaagaggagagagttagggagttgcacaaggaaagaactctgaagtctgcaaatatgcatgcactgaagagcacttgtgtgtaaagaaactccctctgaaagagaaagacccttgagggaacactccaaagagtgtgcatgcgtgcgcacacacacacacacacacacacactccagtcacagaggaaaggcctgagttacagagcatgaggtggactcatcagaagagcttcggctcagtattggggaaaatgtcggacagacatagggctactccactgtcaactaagaaagtgtagaagcaaactgggaaaagttaagacagtttccaagtaactttactgaatccaaaaataaaagaccaaaatagagaagaaaatgcaaaaggattataaactcaacaaagaaaaattcacaatgattggcattctgtcaatatttcttgcaagcaaaaaagaaaatatatgctttaacacagagaaaaatgaatcaatccaaagtggccaaaaattgcacacatgatagaccttgtaggcacgaattttggagcaattctttttttttttttttttttttttgatggagtctcactctgttgccaggctggagtacagtggcgcgatctcagctcactgcaacctccgccacccgagttcaagcgattctcctgcctcagcctcctgagtggctggaactacaggcatgtgccaccacacccagctattttttttttttaatttttagtagagacggggtttcaccgtattggccaggatggtctcgatctcttgacctcatgatccacccgccttggcctctcaaagtggtgagattacgggcgtgagccaccgcgccagccttggagcaattcttataactcttttctccttcctcatgagaatggaggatctattgaatgtgttaagtggagaaatggaaagcataaagcaagatgcaagttaaacttttagaaatggcccctaaatatctgcattgaaaaaatacactggatgagactcattgcagattagaagctgtgaaggaatagatgagtgaacttgaagatatggcaatggaagttatgcaagatgaagcacaaaaaaagtgaagagagcatcagtgagtttcaggacatcttcaagctgacttactggttataattaaagacatgaagggagataacattggtggggggagaggaaaggtagaaaagccatttaaaggaatcatggccacaatttcccaaatttggtgaaagctagaaacccactactccaaaaagcttaacaagtcacatacacacacacacacacaaacacacacacacaaataacacaccaccaacactcaccataatgaaattgctaaaaacctattataaagacatacttttaaaagtagccataaagacatggtatgtacagatgaacaacatcataaaaagaacagatttctttttctttttaaaattttcttaaacatctgtgggtacagagtaggtgtatatgtttgtgggatacatgagatattttgatacaggcattgccatgtgaaatagtcacatcatggagagttgggtttccatcccctcaagcatttatcctttgtgttacaaactactcaattacactatttcaggtattttaaattgtacaattaagttgctgacatgttatcaaatagtattgatgtaactctgacatgctatcaaatagtaggtcttattcattctttctattttatttacccattaagcatcccctaataagagcagatttcttcttagaagtcatgcaagcaggaggcagtggagctatatttataaaatattaaaagaaaaaacttactaccaaaacccatccacagactcaatgcaatccctatcaaaatacaaacgacattcacagtagtagaaaaaaactctatagttggtatggaaccacaaaatcccctgaatagccaaagcaataccaagcaaaaagcccaggctgaatatgtcacattatctgaatcaaaatatactacaaactacagtaaccaaaacaagatcgatggtattggcttaaaatcagacactgagactaatataatggaatagaataccccaaaataaattcatatatttacagccaactgatttgcagcaaaaatgccaaaaacatacgttgagaaaatgacatacttttcaataaatggcgctgagaaaaactggatattcataggcagaaccttgaaactagacttttatctctctccctatacaataatcaactcaaaatttattaaaactccgaaatataagacccaaaactataaaactactagaagggaacgtagagaacacaggggaagttcttcaggacgttggtctagacaaaaattccatagctaagacttcaaaagcacagggaacaacacgaactagacatatgggacttcattaaactgaaaatcttctgaaaagcaaaggaaacgatcaacagagtgaagacaacttctagaatgagagaaaatatttgcaaactattcaactcaaaagggcctaagatccagcataagaaaataagacaaggagctgaaataactcatcagcataaaaaacaaataatacaattaaaaagtggataaatgatatgaatagacttttcacagtcaaagacatacaaatggccaacaggtatatgacaaaatgctcaatatcactaatcatcaggggtacgcaaatccaaacctccatgagatatcatctcatcccagttggatggctatcatcaagaagacaaaaaaataacaaacactggtgaggatgtagagaaaatagaagacaaaaccacatggtcatctcaacagtcacatcaaatgttttcatgcgaggaaacattaccatttgttgtttttctagtcttgctagagcatcataaaaagataagatttgtggtgccactattggagaaaatgttattacatgcaaagactctggctatcccacaccaaactacatgaacacttactgttaaatgctaaaagaggccaggcacggtagctcacactcgtaatcccagcactttgggagaccgaggcaggcggatcacaaggtcaagagatccagaccatcctggtgaaaccccatctctacaaaaatacaaaaattacttgtatttttgcacggtggcacacacctgtagtcccagctactcgggaggctgaggcaggagaattgcttgaacccgggaggtggaggttgcagtgagccaagatcacgccactgtactccagcctggcgacagagtgagactcaggcaaaaaaaaaaaaaaaaacctaaaagattacaattctgcatttccaaatgttctggtggtcagagaccacttccttgacaagtggtgagtacggggatctgatgggataggtggcatttaggcaggtattgggtgaagaatagtgatatacacaagaaactttcaaagagaaaaacacacggaagttggaacacagaagagaacataatatgtctgagaaataaggaaagtccagactcactggagctgagtgagaacaagaaaaatggcataagccatgtatttctctctggatatctcatcaaaatattgtctcctccccaacacaccacccatgtgaattataaaaatgcccgtttttaatttttgtttgcatgtcgtgacagagtcaagcacgtgaatcaagctgagtttgatgagtccagggctgttaagctccagacccaggtggcctcagaaggacttggtggaacaagggcttgttgtcaaaagcagaggaagtgagattttccattgtggcttagaccagagattcttaaattccagtggacacacaaggccccttaaggatctggttaagatgcagatgcagcctcagcagttctggatgtggccccaaattctctgtgtccggcaactcccaggtgaggctgctgctgctggtcctcccaggaccacactttgagtggctgaactcttattcacccacctcactcaagccacgggtgagactcacacaaggagggcaccttctagaagcacaggtcacttctcactcctccccttgtgtcttagatcctttcctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggcgagccagtgtgtgctgaggtcaatgaggggaaggaagcaagagagaaagggaagataccagtctcatttaaataagcagctcttctggaaacagaggaaattcactcaccccaagtgagggcattaatctattcatgagagatccactcctatcaccctaaaagctcccattaattcccacccccaacactggggattcaatttcagcataagatttgcaagggatgaagatcaaagccatagcaccctgaggcttggccacacacttgctcatctccacatttgtcccttccttcaggaccgggatcctgactgctctgactcagtctccgtctacctcatggacacctggcagtcggtcatcatcggttttgctgaatcagcagcaacattgggggtaacaattgtgtctcctggttccaccagagacagagtagagacccacacagctgaagtgtggggtcaaatattaaaactaagagacataagattgattctcaggctccaagtctgacaagtgagcttctttgagactccctgggatcccagcagtgacactgatcactgttgctgttccacacatcccaagtgatgaggaagtaagaccaaaaccctcctgagattcctgacttgtgtcctgacaccaggtctgttcttccctcccctagaataaaacatctcttaagcacaaggctgaagaaatgtggcctcctcctttctcccacagctggtcaaagtggatacctgagagaattggctcactgaggcctcttgggaacaaaggctgggttcctgcctgtgatctgtgtactgagacacattccggacctgcccaggaaaggcaagtatagatgatgtttagttgtcacagagtccaagtagggacaattcagcggtgtcttcttgggacccctgcctctggctattttcatctactttataatgggccagggccattatttccaacttgtcatatcctttttctcctttcctcaccaggtaaggaggtggaggacagttgatgagggctggcttatgagttaccccaggatgcaaatgactttgaagtcaagcccatgtggggtcaagctcagtctataaccagggtcttttgagctctggaggagccaggcatcccagccatcaaagaggtcttgcatttgctaataaatcctcttcttccaacccacagcttatcttggctgcctaccctcatctctgtcaggaagcaatccttcgttgtttaacaccaaattattcttacttggtcagtttaaaagtcccttcctcagaaaggtcatctgtggcctgaagacaaagtgagaaggctttgctgcattttcatttggaaccttacattgccccttctgcaatgttctaaccacacatggcacatatttacaggacagcgtgataattcacttttgaaaatacagaatgtgctcatggaacaggacaatgtcatacttttggggcctgatgagcatgtccttttcacaggaccccccagagctgcccatgcatccagaaggtaccattctactctatgcaaaacgatggggcatttctatattgcagtttcttagggttccttagaaagaggccacccccaacacagagctgcacaccttgtgaccacttactgtcaattcctcaatgctgtctccaagtctcaccatgcacaagggaggaacacagagaccctggattcctagagacttgcatttcttggatgaacaaatctggggtttggttggtggcagagagctcagggctcatgtgtgagcatcacctgatgcttcctccagggtcagagtccagcccctaccctggaaggatgaaagatattgtccacagaagtggtataaaggtaacagcatcgaggacggagctgcctcttgaaatgggctattgctttgcacaacgctggagacctaaattatgttgactataatggaagagtagtccctgcggatggcctctaattgggtggaagaaagcagagggtctgcgtctgagagagcagcaatgggcagattcagcacaggcatgggcagagcagcaatcaagggtacctgagcagcaatggccccgggagaggcctggcacctgccggaagtgacgttggagacagagaaacatctaagacttaaggcttctctttctgtgcaatcccccaccccacagtttatgtgtcacagatattggcacctccttactgtaaggggtcatatgaataatacagtcctcaggggcatgggttcgaggggcagccaggtttatcctcgaagcccacttctgttacctgcagctgtgtggctgtaagcaaggcatttaatctctcagaaaaccatcctaatgagaggttaagaacctctgagaaaaaaacttagacaagaattgacagtaattcttcactattgaggctgcagggatgtaacttaatcatgtttgtaaagtgcataacacagaccctgacatgccccagctgctcctgagttggcagcaattattcctgacatcactcatgagaattggacctggaatggggatggagggaaggcagtgcagagggtttcagagggttaggaaaagagagactttaatgatttaaaatgaaggcctaggagtggagacaagcgtcctgggacattctcctgccaactctcacaatgtctcagagactgttccaaggtgaagtctactagagagctaagggaggagtttgcagaatcaaggtttgcaatgtcatgcatgagggggcagagagtcagcgggagggaagacagctgagctcatctgaagggtatttatggttttctggccctagagtccttggccatccctctatgaccagggcctcagataagcagagagcttatctgcttctctcctccaacgatagttcctggttatcctgagcccaggtcagtgcagctgtggcccattctctcctctttgtgctcagtggactgacctggaggaaacagtaggaggttcccctgctctctgtccccagggtcctttcctttcagtggcaccagcccagccctagtgtccatccatctgtgcctgcccagtcaggcctccatgctgccccctgtaatggccacaggtcaaaaactgattgtcagtcttgagcagattgtcctgactctttctgcaaaactgagcctctcacccagcaccaggacgtcacaagcaaggccagctgtaggaaggcaagtaggggagtaacgtgcatcacagagtctggacaagacaaagtagttctgctgggacacatcctggtgatgtttctcaggatggttcaggtccctgcaattgcaggcccagagaacaggactgaaggctggaagatgtgctccctttctcctgtacacaaaacagtgccatgtgtgcatgtgagtaaatgcatatgcctgtgtgcttgtgtgtgtgcacctgtgtaaatgcatatgcctgtatgtgagagagtgtgtgtgtaaatgcatatgatgtgtgtgagtgtgtgcatgtgtgtaaatgcatatgcctgtgtgtgtgcatgtgtgtaaatgcatatgctgtgtatgagtgtgtgtgcatgtgtgtaaacgcatatgcctgtgtgtgtgcatgtgcatgtgtgtaaatgcatacactgtgtgtgagtgtgtgtgcatgtgtgtaaatgcatatgcctgtgtgctggtgtgtgtgcatgtgtgtaaatccatatgcctgtgtgtgagtgtgtgtgcctgtgtgtaaatgcatatactgtgtgttggtgtgtgcatgtgtgtaaatgcatatgcctgtgtgtgtgtgtatgcatgcgtgtaaatgcatatgactgcgtgtgagtgtgtgtgcatgtgtgcaaatacatatgcctgtgtgctggtgagtatgcatgtgtgtaaatgcatatgcctgtgtgtgcatgtgtgtaaatgcatataccttgtgtgtgtgcacatgtgtaaatgcatatgcctgtgtgtgagagagtgtgtgtaaatgtgtgtgctgtgtgagtgtgtgcatgtgtgtaaatgcatatgcctgtgtgctggtgtgtgcacatgtgtgtaaatgcatatgctgtgtgctggtgtgtgtccatgtgtgtaaatgcatatgcctgtgtgtgagtgtgtgcatgtatgtaaatgcatatgctgtgtgtgtgtgtgcatgtgtgtaatgtatatgcctgtgtgtgtgcatgtgtttaaatgcatatgctatgtgtgtgtgcatgtgtgtgtgagtgtgtgtgcacgtgcatgtgtgtgtgcatgtgtgtaaatgcatatgctgtgtgactgtgtgtgcatgtgtgtaatgcatatacctgtgtgtgagtgcatgtgcatgtgtgcacatgtgcatgttagtgttgccagggagtgcttcaagtatcgaatgtcccaaattcacaacttttctattttcctcacttacctcctccctgacacatgcttctcagttaagtgagttcatatgcgcaaggcctacaaacaggcaaggcatgggccatagtcagtgctgagtcagtgtcatcaaatattgttatgcttatatagaaccttgtccagggtgggccaaatgtatgcccctgtcttgtcctgacagagcagcagaaagggagactgagacaaaacaatggccagggccctggcaacacggagacaccttcccactcctgtgagcttcacagacaaccctgggtatgggattcctgtcattcctttaagattgttcaaataaacagtgacaatcactctcatatgatatatgagaagaagaagaattccatataaaccaaacccatgacgcccacactgaagcctgccaagttctctccagtcgagcccaatggagggagcattttcatggggacttttgagagtatggagaagacctgaggaaaccaggctcagctgtgggctccagaggcaaagctctgggatgtctccccatggcctagacccttcgcctgccacctcttctcactctttgcacagatgcttcccccaggctaagcccccacaggaccctaatcctagtcctgaccctgagctcagcccaggtgatgcttcaggagatgggaccctgagaataagccctaaagtctcctcaacctgcaggctctgtagtctcttaaagactcaggtacctccagtagagttggccatgagacatctgtccctccaactgctcaggagcaggcaacagtgcagagagaaacagcagcccaggccaggccctacactcaaagcagcccccaatccccacagatcctccagcgctaacctggggtacaggccccacctctgcaggctgaggtgggctcctcagcatggctaggccatgacgggggatggcagtgtgtccatgggacacagccctgctgcctgcctggccctcatgccccgtccctccccaccctggttaagctctgccccaaagggcccaggttcataactcaggacacctggatcggctcttggacttgcccccactgttctctgttctcctgagccacttagtttcttttggccacagtgttacctgctgcgaagtgaggaggcttatactgaactgaagaagcacttttcttcattcaaaattaaaagatagaaaaacaatggaagtcatgcgaatggggggatgtcatttaatgggcttcagtgggcttcagacatggaatttcttgtctttcctctgcagagattccaagaaaaggactcgaaaagagcttgctttctatatggtgggaacagcagctgccagctaagaataagcaggagagtcccagtttcatcaggaaaacagactaggctagtatggaaatcctccctgcagaaactctgagaagtgtggaatgaaataaacataaacatgaaattaatctgccaacgatggtgatgttagctcacaactaagctgcagtgccagaaacatgcggtgattgcagtgaatcatagctgctcttactgggtgggaggtgcaccagtttgcttcctaagtgcatagaaagcctggcacgcacgtctctctggactttgaaagcttggcagaagagcttcagttgacttactctaattagtcctgacggaacaaaaccactagagtagggcatttcaaccctgagacacttctgtagcaattgctcctgccccacatccctgcactgcatgtgtgacctctctgtggtgggctgggcagggcagattgggccacactggcacagaatggggctggactctctggtcctcaacttctgaggtgacaggtgctgtggggtcacctggaaggaaaaagctcctgggctgagtctcctccaccagttgggggcagcagagctgcagccagcagcagtgaggagagaggctggggctgcccagccggggaaaagaggaaggcctgcctaaggttcaacaggtgtccaagaatcagtcttcagactgaaagtgaagacagttcatcctatcccctcaggctgcagtgaccacgctctgagggtcagactcatatagtgttactccaggacactgacagaagcctggcacagtgaaggcctcacctgggaaatgctgctggaggaggctgggcccaggtgtcagcttgggcagcttcctcaggaaggggattccctggaagaagtcccgaggtcaaggtgctctaggaggggcacagtgtgaggtgacggggttcccagggcctgggttcttcacccaggatggcggcctgagcctcctgccactctcagggccttgtcctgccctgtccagcagtgtcctggggagctgagccctctgtcgtgggcacttccagatacaccctgcctaccctccctctgcctttccttccagctccaggcagactctgactcaagggcagctcctgtgcttaggggagtctcaggtgggtggcgtgaagtatttggggccctggtccctgcatggggcatcaccagcctcattgaggagacactctccagagggatggggattctcacctgcctcaggccacagccctgaccccggacctgtccatgctcagtgacaggacaataaccaggaacctggctggagtaaccagggaccacccatcctctggagctcacatgctgtgcagagaccatgaccctgggaccctgggaccctgggaccctgggaccctggaaccgtgacagaatccatggggcctaaagttagattctcagtccactatggttttctgctgctttttgcaagtttacataaaacattgatgagaaaaacataaataaataacagacgagctgagggtgccaattgcttatctcttgtggcaatgagggaatggtatagaaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctggtccacctgctgctgagtcaggtgtcagcatgatctctcggcagggcccagctcagccccatggccaaactcctggaaggtccacagctctgctgagcctggcccaggacagaccccaggtcaacgaggtttgggacagtggtcatgaagtcaattcccaagaaggtgactgcgatcacagggcttcaaggctgcagctgattttctaaccagagatcctgcttcttcttcttcctcttgtcgcctgtgctgcccccacagctggtttgggtgacatctctccaagaggagtcccagaggaagtaaatttgcataaacaccaaacactgactaccctaaaaagcctgagagagaataagagaggcctggggagcctagctgtgctgtgggtccaggaggcagaactctgggtgtctcaccatggcctggatccctctacttctccccctcttcactctctgcacaggtgctgtccccaggccctgctccaggccctgctccagtcttattccccacagatcccaagttgagcctgccctgaatcccgagcaaagcccagacgcagcctctgggtgcgactcctgggaatgggtcctttgtcttcaagccccctctcttgttcttccttgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtacttatcccacagtgacacaagcagacagggaagtgagacataaacccctccccctctatttcatcctcttcctcctgccccaggaggactgtggacaaagccatgagtaggcttggccaaattcacccaaatctgaacccccaggctgcccttccctccagccctccaggcaggcactgcagagtagtcagtctggagtggatttgtgcctggcaggccaggctgtcctgtgtttctttgcctggggtttgagttgtcgatggagggtctgactggaaagacagacacagggagacatccatgcaggcatgtccaaagggacatggggaactctcaggtctcagttgaatgcagtcattgttgtatcctctgggaaagcattcctctagtgcatctaagacctccagacccacagagcctgagatcaggaggagagaatgttaaatttttgctaatggaccactgaagacatttttgagtggagccactacaatttactccttgattctggactcatggatcctgactgtgggagaaacagcaccatctattgggcactgatgcacagaacatgccctatcctggaagacattgtccagccctacacatacttgccacttgcctggtgcagtaatggtgtctccaagcagtcattaaaccattcatataagccatatgtctcagaatgtttgggacaagagtaagaatcttgattgccagaagaaaaggcccatagccctttatttgcagtgaaatgaattccttggtcagaacctcctgtggaataccatcatgatgggtgcgtcattctgtaatccagagacaacagttttggcagaagcattgctgtcaatgaaagcaaatcctctgtagaataaatgtcaattctagtaagaaaaaagagctattcctgccatgatggaagagtgcaaacgaaattaatattaagcaggcccctggctgttttccacagagaaagtcatcctatagggatctctgtgttagtctctgctgttggcagatggtcactcagcagtggctacagccaggccagctccagttagtggaaatcgacattgatgagcccatggacagcctccatccctgccaccatgggcgcttttttttatggagcccactgggcattgacaagagtggttgagggaggctgcctgatgtccacagaacaagtcaccctactcacctgattagcaaaatcacttcattttcacagaagacttggtgagtattgacatatggaaaaaattctcttactttctgcccaccggaggaggtctattcacacatctctccccctgacgtatttgtgatcaatattctcattgtgtctctctcaagtccctgaacatccttgagcatctttcaagaccctgagtcacaacctgtgaattaggaacctctgcccatctcttggcaggtgacatgagccaattgcactgcttaaaattctactttaatgagaatgttcctccaacactgctgttcagggattctcagaggccaggtggagtactagcactgtccacaccagtagtggctgcatgtcctgcagaaaactctgtaaccccagcctaagtgcctcctcctaggcagctgatctcagggagcccctcaggacgtcaaggctgtagggtgagaggaagacatggtgcagggctccggtcatgtctatttggccaactcttcatgaaacttacttgggcctcgtgacctagtccctcaagtcacaaatacatccctgccatgtgattgaggagctgctggaaatggccaaccgggactgtggttcagaccaaacctagcatactggcaacttgggtcgcatggtgagctgtgtggccacaatcacacagagcctctgctgaggcccaggagcgttcgcagtctttctcaaatggagctttctgctcattcaaaaaaataagtagagggaggctgggaccccaggaccacttagaccacgcacatgatcttgtctgattattctgaatccttgcatgctcagctatgcattatggtaaccaagccacagtgtctttggcaataaaatgccactacttggcccccacctaacctgggatcccctcaaccacatcttgctacccaaaacaggtttcacctccactgagagaaatttatttttatattgagaagatgaaagattaattatttcaattgtgaaaattttataggacagtaatgtgaaaatattttaaaagacactttacgaagagtgaaagaccttccattaaaccactcaatatatgacactgtaattggcctacccaaaccctaagttcagctccgggttgggaccttctgggaatggacccttcatcctcacgccctcctctcctctcctctcctctcctctcctctcctctcctctcctctcctctcctctcctctcctctcctctcctctcctctcctcttctgtcagccctgtgcctcctatgtgcagagacagctggtctcagtgttggtggccctgggactgacaatcatgagcacatactctggagataaccttgagataaacatgcattaaggaaccagcagaatccaggccagtccatggtgctggtcatctagtataacagcaactgaccctcagggacatctgcccaattcttaggcttcaactcagggaacatggccaccatgaccattaatggagcccaagcccgggaagagactgactattgctgaactgcagataataacagtgggagcagctggcagggactcatagtaacacagagagacagggactagccacagaactgtcccatctcggcctggctctcattctcagctgccctgtgagcagctgaaggtcaggcctcagggtcaggcgtcctctctggtcttaacctggcccctgcagggctggtgattctgagcagcttctccatcctctcagggcctgcatgtgtccagtgagaagtgagtggacagggggaagctggttggagctgcaggaacctctgtcaggtttgtggtgtacatgaaaggtttaggaatccacacaacatcacatggccccagatgtaatcacacatcacacaggggaggaaagagctgtcgcagagggtacagtcctgtggaatttctcttttccttgggtataagcagcttagtggaagctccagaggctgtgtctcctctggtttccagatgagttcagttgacctccgcattctaaaggggtgcctgaggcctgaggaggactggagacccagccccttttggccccagggccctttctgtgctgacatttcacagaaactgaagaggaagaacagacactacctttcatcccacctggggactgtctttggggcacgctgaactcccatggcccccaaagtcccatcaccttccccaggtaggtcagacctgactggatgtccctctagtgccctgatagtgtggattttatctttgggctctgggctgctttctgaggagctcactaagaacccttgatgccaagtccaggacctgcccctctgctccatgtcccaggggctgcaagcatgacgggaaggtcctgctgggtgaggatggtgcccttttccagaagagatgtctgattccagtctctagggccaggtttgttgggctttttttctcacttggaaggtctcagtctctttattaccttctttaaaagtacaattggtttaatcgtgaaatcatgtgcatgcactaaagtttacagactatggtcatcagcacatatgtacactctttctggatgggacaactgtggacacggccatactggggtctctgtctctctcattatcacaagggaggataccaacagctctctcctatgcagaccgtagtcatgtttcccaattgcacaagaatgtctcttacagttgtttaatttccttcccagccaggacgcttaagtttcccatgctgatacttggttgctatttctctctgatccaacatttttcaaacagtattgcttgcaacccaaggcttatgaaacactttaccaaaagttccacaagaaaagctcaagtttctcatgcaccgttggaccaggttcattgcgtgcagtaggaccttgctcaagtgatgagtccatttgatgttttcaccatcaaggtgaagggtattatgacttttgggcactgagttgatagaaggaagacagcagctgatgatggccctgcccaccgatgtgtgtgtgtgggcaggacctatcgatggatttagaagttgagggaactgtttattctgcagatggaatttccagcactgaatctccaccaaccagacactagcactcagcaggtgctctgtaagaagaagcccttcactgccaatcacggccattacacaggtgaaggagaggatgatttttaacagccattgaccctcacagtaaactgaggtcaaaactctggtacacaaagtgactttgagagaacaggctgaggaagcaggttaattagtagcagaaggctttgccgagagcaggaacaaaacagggttggtgaggaactagtgatgccatggtgtggaaggaacaaggcctgtaccaggagcaggaaggggcatgggaaagaccacactgccacatgtgatgagtcagcacatggaaggcacagcaaatgttgcacaaaggtttttgtgtaataacctggcaaacagctgcttctctatcaagattgatgagtcaaaaaatgttactgatgcattgctgtcacatgtgaaggtgtgtgaagaatggtgacattcaaggaaacctgttctctgcagacacctacccaccagtacagcagacaccccagctatgccaagggctttgtcttcctctggggtaagagcctgggaacaacaagttggcccctgaaaggggtgccccatcatgcgctcttcatggctgagttaagtggggagctcccagagaactttccagtaaatggtcaatctgtttgttctgggtgcattgagcatgacccaggatcaatggaagtgacagaagcttaatttccccaaggctgcaaggcgggcactgggaggacggctgaagcagtttagccaccaccccctagtggctccagccccaggtaagcagggacagttgaagggcctgcctgagcccacctgtgtctaattagttccagcatcagcagctgcatcctgtagaccaccaaggagtgtgtgtgcccagcccctcacagatcacctgagcataaacaggaaattctccttcttacacctgactgcaccacacatctgccccttgctcttcatttacaagacgctatcacatcagacacggactgatctgagtcccgggttccctcaggtttctgctgtcctctcagatccccacacacaaaagactcttcaccacagggcgttgagccagctcttcccctaacactgcctcttacaggttactcttctccaatatgatgcgggtttgatttcagtgtttctacatatatacttttgtattttattgggtaagctgagccccttgtacctgatcttgagtcaggcaggggccacacagagaagaggtgttcctcccctgggaccagcagtcctcggatcagggcatcagggacctgaacagcaggttctgaatccacacctagacccaggaagtccctgagcccccagcccacagtgtggagcggccaccagggggaagcagagagttacctggcaaagccacctggcgatggggcgggcctgggtgacagggagacgctgacatgcagcaggagccagtgaccatgatctcacacctggaatgaaagggtctttattttcatagagtattgtccttgtgtacttgacactcatgtagaaattctagaataggattttaccttcagctcttgcagatgctgcctctttctctgccacagctccaggcacttgacttctcacagtgccctctcctcacacacccagttgtgctaaaatggtgtccctgccatgtgcagtgtcctccctgaggtcacaggtgtcccctttatctcccctttgctctgggagcccctgtcctgcagacacagtggcttctcctttcctggctgctcctccactttcattgtccctggtctttccggactctctcctggggaagctgccaaatcatggctcttgatttcctggtgagtcacaaaatagttgctcattaacctttagttgacttaagttcttaatcattgatacattttccccaacaactgacgacaacttagttataataaacattcacttctgggggtcttggagtttgcagccccctctcattctctcatggagcaaacatttccttcgcctcctcatctgtctctgatcctgacagcatcctggagatactgaggcacagcagctatgacctacccaggagcttgcagccaaggcagaaacttccatcacctcatggatcttccagcactctgtgtgcacttgacaaataagaaattccattgtcctctaccactcaggagctgtgccctgcggtgggacctgcacctttccaaggtgtgtgttatcatctgcacagtggagatgaagagggaacctgcattgggttctggaaagtaccatctaaaaatatatttagacctgcaacagaaatctcctctctaacataaaatatttatgatcaggacacactgagaggcctagaccaaaattaagcactgccctcctgagccaggatagaatggaggaggggactggggaccccagataattccacagttaccagcatgactctatgatcacctcctggaccagatcaaagatcatcccatatgaaggacttcatattccttaggaaatacaaagtcacctctgagctctgctgtgaccaagtgagcccaggaatgaggctgagcacagtgtgatgtggagatgtctgcagagaatatggaatcaattgataaaggagatcctgtgggcaaagggtgggagggcaaggccacccctaacctctttgggtcccttggggctgagtccttctggaaaccacaaagctcctccagcagcagcccctgactctgctgattggcatcacgggctgttctctccaacaaggggttaagagagacctgggaggagcctgcccagcctcagacttgagaagcagcattggaggcacttcagccatggcctggcccctcttttccttggtctcctgactcactgcccaggtgctgcccccagggtctcacccacctgcccagccccaggcctccaggttcagcctggccatcagtctgagctcagcagggccctgtgtgtggtgggcaggatgctcgtgaccctgctgcagggggaggggctggttgggctgaaatgcccccactctgtgctcctgtgctcatgggtgccctgagagctcttttattcctggggctcactccagccctggcaagtagcaagatatcctggggttgagcctctcagtttcaaattttttatctcccctttccttcttgcaggctctgtcacctcctgtgagctgacacagccaccctcagtgtcagtagctccaggacagatgactaggatcacctgtggggaaaacagtattggaagtaaaagtgcttaatggtaccagcagaagccaggacaggcccctgtgtgggtcatctatggggatagcaggcggccttcagggatctctgagattctctggctcaaactcagggaacaggaccaccctggccatcaacagggcccaggctggggaccaggctattactgtaagatgtgggacattaggactcctcatcccacagtgacagaggtagatggggaagtgagacacaaaccccttccccatacgtgtcactcttgtcctccagcccaggaagactgtggacaaagccatgagcatgggtttcccaattcacctggatctgagaccccccaggctgccctttccacaggccctccaggcaggctctgcagaggggacatcaagactgaatttagggcagaggtgaccaggatatattgaggtttgggggactcagttgtgatttggggaaatggggccagaatggaaggtcaggccaaggtcaacatccttagttggtctctggatttccatagggggtgaaggccagtccttgggctgaatatcctgagtcagtttccagaactgcccagctcaggctcccatggcatcctgccattctctgaaaagggccctggcatgccaggtgctctgggttctgagggagagttggaatcagatcctcctgcaggaatccagggtcaggagaagcagcctcacctgacacagggaccacagatgcacccccacagggtgagctgcaggatggatgctgctcatctccaatcctcacatcctatgcaaaaaatcattcttttcacccctccttcagtgtatcaaagttgacacttaaaaagccttaagagcccactcttgtcaacagaaaacccattcacatctccatcagccacacaatctccacagaatgattcttcaaaaaacgataacagtagacatgaaaaggtatctaaaatgttacataaataattgaacttagattacatatgaaaatgatactatttttggtatgctaggtaaataaaatatattatttggactcctttactttcttctctttgtatttctaatgtggtgactagacattgggattccaatgaggctcacatcatattgtgattgaacagtgctggtctgcacctcttcaggtaacaggggctgtggagtgacctggtgcaggaagccccatctccaatcataggacatcagtgtgaacccagggagaggcactggtgcaagagaaatgagaacaggagtgtggaccatctgcttgtacaggggactgagccctcactttgagccaaataaactttttttctattttcaattctgaagaagaagactttcctggacttctttccgttttcagatttgtgccccttcaggtttggcctgtctggatcccagccaggggacaccgaggaaatccaggagtctcacactgactctgttgtatttcatctgctggggtcatcccaaactgctgcgtatcgtttcctttcctggtgctcaaatagctgctccatgcacttgtcacggtttcatagctcagtctaggtgggaagacaggatagtgtatgttataatatttaaatggaacctgaatccattcattgtttttgtttttttgtgtttttgtttgtttttgttttgtttcgtttttgagagagagagagagtcttgctctgtcgcccaggctggagtgcaatggtatgatctcggctcactgcaacctctacctcccaggttcaagcgattctcctgcctcagcctcctgggcagctgggattacaggcccccgccaccacatccagctagtttttgtattttagtagagatgaagtttcaccattttggtcaggctggtctcaaactcttgacctcaggtgacccacctgtcttagcctcctaaagtgctgggattataaaggtgagccaccacgcccgacccaatagtttttttaaaatatgaaatgttaaaagagttttgtcataggcattgggaaaggtgaaaatagattaaaaacattttaagaaaaaaaccaaaaatgtacttgtagactgtctgtgtgtcttcagtgttgcagggttcagagaggtcagttttatggttcactaaggaggggctaagatggaggaaaccaagaaagccaaaaacacacatctctgccactcaaaacataaatcaaagtaaaatggaaaaaatctttcaataaatcattcccaataaatatcactctggtgcacatagaaaggcctgttagcaaactttccctttcccctgctggctcatatccccatggatcacctgtgtgcagagtggactctgtggtccccatttctcaggctgagaaccagagactgggaaggacaagtcacctgctcatgagtgggaagggcaggattgggagcagctggcttgggttcaggactgtggccctggtcggtgctctgtgtccctccagagggtccctcccacatgtgccccgtgtggatgtgggtgcactgcctggggtggctgatgtgctccagggattcgatggtgcagatgcttcagcacaaaacgtggaggtggggatgggatgaggctgcagctggggagaccagagaccagcgccacccagcagaggtttccacggggtgggcagccccatttcctgacagtagagacaggctggaggtgggtgccaagcagagggcgctgtggggtatgcccaggcctagagagtcacagagacacaggcactacacagcagaggcactgagggccaggagctcactcaggtgagagacttcagcagatccttctctcctgagcaaatcaggtacaaaaaaaattaagttcctgccatcagcatgcacaaacaagaacattcatctcttcagctgagccctgctgtccagggaagcaaaagtctctgagcccaggcccacgtgagggtggggtgaggagaggagcccaggatgctgattttcatggaggccccgccctcctctgaggcaaaggggataagacagggctggggcagggccagtgctggggtcacaagaggcagcgctctcgggacgtctccaccatggcctgggctctgctgctcctcactctcctcactcaggacacaggtgacgcctccagggaaggggtcttggggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttccacagtggtccaagttcatggggaactgagaccaaaacctgcccagggccttcagacttcctccttgctctgaagatgcttcctcacccggtgcaagaggcttgctgcagcgcggccttgagaattcttctctctcagctccttccctttccaccatgaattccaacaggaaacctgccctgtggtttcccatccaggacagggacagcttcctgatgcttgtgtgctgtggtccctgaatgtgcaactcttcccagctcttcaaatgcagggacagtgacaaggagctgcctgattggtgcagtcactgcttttttcagggatgtcttcaccctacatgtatcatcatcccctacactgtgggtagaattttagcaactacattctaatggttatcgccacaactttgatcttagaaataacagtgcagtgaacatccctatgcaggctcctttgagttcctgtgtgaatacgaccataggattcatttctaaaagtgaaattgcgggtcagaaagatgtgtgtttgtgattttcacccaatgttgtcagattcccctccagagggattgtaccaattttcaatgccagctggaagtacttgttcagagtacattgttgaatgtggaaatttttgccaacgtatcagagtgaaaaatggtaccttgttacagttttatttttcagtctcccgttctgcttaaggttgggccttttcacaaatagttcagtactcttcatttttcatgatttggtaaactttataaaaaatatccagataagaagaattttagtctttgtggccagacacggtggctcatgcctgtaatcccagcattttggaagactaagacgggtgaatcgcttgatcccaggagtttgggattagcctgggccacacagtgaaccctcatctcaattaaattaaagaaaataaaaataatttttaaaaaaatcctttgtggtccaaggatcaactttggggatattacctatggacttatatcaccatttacaatgcaaacatttaaaatgataacaactactgtcagctgcagaactaatttgactccatcaaaaaaaaaaaagctaaaagattataattctgcatttccacatgttctggtggtcagagaccacttccttgacaagcagtgagtacggggatctgaagggtagttagcatttaggcaggtattgggtgaagaatagggatatacacaagaaactttcaaagagaaaaacacatggaagttggaacacagaagagaacataatatgtctgagaaataaggaaagtccagactcactggagctgagtgagaacaagaaaaatggcataagccatgtatttctctctggatatctcattaaaatattgtctcctccccaacacaccacccatgtgaattataaaaatgcccgttttaaatttttgtttgcatgtcgtgacagagtcaagcacgtgaatcaagctgagtttgatgagtccagggctgttaagccccagacccaggtggcctcagaaggacttggtggaacgagggcttgttgtcaaaagcagaggaagtgagattttccattgtggctgagaccagtttcttaaattccagtggacacacaaggccccttaaggatcggttaagatgcagatgcagcctcagcagttctggatgtggccccaaattctctgtgtctggcaactcccaggtgaggctgctgctgctggtcctcccaggaccacactttgagtggctgaactcttattcacccacctcactcaagccacgggtgagactcacacaaggagagcatattctagaagcacaggtcacttctcactcctccccttgtgtcttagatccttttctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggggagccagtgtgtgcagatgtcaatgggggagaggaagcaagagagaagacaaagatgccaggctctttttaataaccagctctttcggaaacaggggaattcactcaccccaagtgagggcattaatctattcatgagagatccactcccatcaccctaaaagctcccattagttcccacctccaatactggggatccaatttcaacataagatttggaggtgacaaagatcaaagccatagcaccctgaggtttggccacacacttgctcatctccacatttgtccctcccctcaggactagggtcctgactgctctgacttagtctccctccaccttatgggcacctggcagtcggtcatcatcagctttgctgaatcagcagcaacattgagggtaaaaattgtgtctcctggttccaccagaaataaagtagagccccacacagctgaggtgtggggtcaaaaattaaaactaagagacataagactcattctcaggctccaagtctggccagtgagcttctttgagactccctgggatcccagcagtgacactgatcactattgctgtcccacacatcccaagtgatgaggaagtaagaccaaaaccctcctgagattcctggcttgtgtcctgacactggggctgttgggattcctgtctttccttcaagattgttcaaataagcaccgacaatcacttccatgtgagatatgaggagagaataattccacatgaaccaaatccacgaagcctacactgaagcctgccaagttctctgcagtccagcacgatgaagggagcattttcatgggaacttttgggaatatgaggggagccaggctcagctatgggttccagagacaaagctcctggatgtttccccctggccttggtccatcacctgctacctctcctcactctttccacagatgctgccccaggttaagcccccacaggactctaagcctattcctgaccctgagctcagcccaagtgatgcttcaggagatgggatcctgagaatgagcgccaacgtctctttaacctgaggtgtgaggtcatgagacacctgttggccataagacacctgtcccccacctgctcaggagacagtggagcaggcaacagtgcagagagaaccagcaggagccaggccaggccctgcatccaaagcaggccccaatcccacagattctccagctccagcctggggtacagccccaactttctgtaggctgaaatgggcttctcaggatgggcaggccatgatgggggatggcagtgtgtccacaggacacagccctgctgcctgcctggccctcatgcccactccttccccaccctggttaatctccacccaaaagggcccaggctcagaactcaggacacctggatcagctcctggacttgcccccactgctttctgttcccctgagccacttagtctcttttggcctcagtgttacctgctgtgaagtgaggaggcttatactgaactgaggaagctcttttcttcattcaaaattaaaagacagaaacaataaagtcatgtgaattaaagccttctaaggggatgtcatttaatgggctccaatgggcttcagacatggaacttcttgtctttcctctgcagagattccaagaaagggactcaaaagggcttgctttctgtatgatgggaacagtgatctccagctgagtataagcaggagagtcctagtttcatcagcaagacagacaaggctagggtagaaatcctcctggcacaagctctgagaggtgtggaatgaaataaagataaacatgaaattaatgtgcctatgatggtgatgttagctcacaactaagctgcagaaccagaaacctggtgattgcagtgaatcatagctgctcttactgggtgggaggtgcaccagtttgcttcctaagtgcatagaaagcctgggtccctgtaggatggcatgcacatctctctggactttgaaagtgttgcagaagagcttcagttgactcactctaattagacctgactgaacaaaaccattagaggagggcatttcaaccctgagacacttctatagcaattgcacctgccccaccccactgaactgcgtgtgttacctctctgtgctgggctgggcagggcagattgggtcacactggcacagaatggggctggactctctggtcctcaacttctgaggtgacaggtgctgtggggtcacctggaagaagaaagctcctgggctgagtctcctccaccagttgggggcagcagagctgcagccaggagcagtgaggagagaggctggggctgcccagctggggcgaagaggaaggccagcctggggttcaacaggtgtccaagagtcagtcttcagactgaaaatgaagacagttcatcctatcccctcgggctgcagtgaccacgttctgagggtcagattcatacagtgtcacccaaggacaccgacagaagcccggcacagtgaaggcctcacctgggaaatgcaactagaagaggctgggcccaggtgtcagcttgggcagcttccttaggaaggggattccctgggagaagtcctgaggccgaggtgctctaggaggggcacaatgtgaggtgacagggctcccagggcccaggttcttcacccaggatggcggcctgagcctcctgccactctcagggccttgtccctccctgtccagcagtgtcctggggagctgagccctctatcgtgggcacttccagatacacccgacccctcctgcctctgcctttccttccagctccaggtggactctgactcaggacgcagctcctgtgctcaggggagattcaggtgggtggcgtgaagcattttggggccctggtccctgcatgaggcatcaccagcctccttcaggagatgctgtccagaggaacagggcttctcacctgcctcaggccacagctctcaccacggggctgtcctttgatcagtggcaggatctgcatggctggagggactactgaccacatgctctctggagctcatgtcttgtgtggagaccatgacctggggaccctcagaaagaccaagcagcctaaagttagattttcagtccagtgtgattctctggttcttttcgcaagtttacgtaaaacgttgatgagaaaaagtgaataaataaaggaagagttgaggatggcaattgctggtctactgtggggctgggggataccatggaaagagcagcaccacatgtcaaatgagactagagattgggatgcatccgaaatatgtgtggttgctcaaatgacaaaactcttccaactgcaatgattcataagtgtcctacagacacagtacatcatgtacataacattaccaggatggggccaagtgactcgggggtatcaggagcagggatgaaagaggagaaagatgatgcatctttggtgtacttgctgctgagtcaggcgtcatcagtgatttctcaacagggcccagctcagccccaggccaggctcctggaaggtccatagtcctgctcaatgcagcccaggacaggccacatgacacagaggtttgagacagggaccatgttgtcaatccccaggacggtgactgtgatcacaggccttggaggccaaggctgattttctgactggagaagcagacgaaggaagctggggattcaccccttcattttaagtttctcatgctgcccccagagctggcttgagggatatcccgccatgaggagtcccagagaagtaaatttgcataaacaccaaggatgcactgccccagtgggcctgagaggaaataagagaggcctgggaagcccagctgtgctgtgggctcaggaggcagagctgtgggtgtctcaccatggcatgggccacactcctgctcccactcctcaacctctacacaggtgctgcccccagaccctgccccaggctcagccctcctaagcccctggtcttaccctgaaccctgagctcagcccaggcatagcctcagggcgatactactggaatgggtttgttatcttcaagccccctctcttgtcctctcttgcaggctctgttgcctcctatgagctgacacagctaccctcggtgtcagtgtccccaggacagacagccaggatcacctgctctggagatgtactgggggaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctggggatgaggacaatccctcagtgacacaggcagatggggaagtgagacacaaactcctttttcatctgtgttgtgttcttcctccagcaccaggaagactgtggaccaagcaatgagcaggtctggccaagttctactggatctgagacctccaggccatccttttttccagctgtccaggttggctctgcagagggtggagcaggagtggatttaaggctgctataatcagaatttatggtgttttggggcctcatgagtgacttggggaaataagaactggatggaagatgaaagagatgtagagaaccatcacttgaccttagatttccatacgatggtgattgggtcactccttcttcaaaatatcctacatcagtcccgaaaaatacccacctcagctcaacacctgagcttccaggcttccatggcagcctgggattttgaacaggaaaagccaaggaggggacactgtggcatctgcctcaatacccttttctgagctcacccaacctcaactgctgggagcttctaggagctcagagctgtgccctcactgggaagtgctattagctccaaagaaaacttccttcctcatatttaggcccagttttgagagttttggtttgatgactgcctgagccaagaacccaaggccctgtcctaatagaggatgacactgaaaggccttccagatccagacatcccagtatggatgcctgaggcctcagttgcaaccctattgtgggtcagggtctccttctggtgggcgatgcctccctcactccttccagatcctctgtgcatgcacatctttttctcagagtctacttccaggaaacccaaactaagatggctggctatcaccaaaataaactaccatagacctgaggtggaaacaccagcgaatttcccaaatttccattgtgaacatccaaatgcccatttatatctgagtgttccttgtattcttataaaatgaaaatggagcctgacataccaggtttttggagtcctgaaggagatgtggagacagatccttctgcaaggaatccaccgaaaggggagcagcctcaccccatgcaggggctggagatgctcccacaggggcagctgtagcatggacgctaccaacctccaccctgcacatcctgcacaaacaatcactctttcacccctccttcagcttatcaaagttgacacttacgaagccagcacagctcacccttgtcaatcagactccttcaaacctccatcaaccacacaatctcaacataaagaatctccccaacataataataggaacagtagctatgaaaatggctataaaatatctcataaataattttagattgtgttcatgtgtaaatattatttttcacactttgggttaaataaaatatattactgaaactagtttacctttttattttttatgtctagtatggtgactagacagtaggattcacatgagactcacatcatgtgattgtacaatgctggtcttgtcttaccccttgaggtggcaggtgctttggagtaacctgcttcagcaagccccatctccacccgtaggacatatgtgtgaagccatggagaggcactggtggaagagaaatgagaacacagatgtggaccagctgtttatgcaggtgactgagtcctggagccctgatcctgttctaacctagatgtgtcacatccatctcaccagagaccgctgctggcctgccttagctcataactggggggatctggcagttcatgaaacatggtcgcttgatgtccagtgttatcctgtctctctcagggcccaataagacaaaaggagctgcttttagaaagggaagtaacactctactgcacatgacatggccttattccaaaaccccatgagtctacgttgggattctccagtggggtttgccatgtacaggaggtttcagttcccacagtagagtcagctggattctctggacccaacagcaggacactcacaaccctgcctgcacctgctgcagagcctcaatgctctgggcctggaaaacaatgggtgatatttgtggctcctgatatatgggttggagccacatccccaagtgtaaaatatgctactcctagacctttatagaccttgtgtctgtttcttcctggagggaattgaagggtataataacatgttctttaatttgtaggagactctcagctgctccagacaactgaagtcccaatttctgctaatacagaagagggaacagtttatttcccactcttaaaagtgcatggatctcacaaaagcttccagtaggccatgcccatcatgtatatgtgattcaactatgatatcaagatggtctgaaccctcatgatgatatcatgatagagataagagagctaatgatgctgggcagagaaagtgtgaatgtatactgtcgtccattccacctgaatgcacactgattctgatcctattctctgagggaaatagacaagacctcagtatctgcttcagtgaggtaactgtgcacctgcagccatagcattctgttcccagagatccccatctggcacagatattgctaatgccactattgcccatctgggtctgtacaaatccaaattcatcttccaggatcattcaactattgtagagatcagtccagtaaactgaaaacaaaaccccagaagtaatcacacgtactgcgggagaggagagagctgtctcagagggcacagtcttgttgaaattcctctgctccttgggaagaaacagcccagaaaaggccccaggggctgcgtctcatctgggttcctggatgaggcacaccccctactgcactgagattccacagaagctgggggtgaagtgcaaataccgtctttggttcatccttgggattttctttttatcacacactcgtcattttgtccacaatgtccaaagtttctaaagtgctgtctaatagatagaggttctttgtgcgctgaactaaaagctcttgggttggacaatggtgatgtttgcacaacatttttactgtacttactgccgcttaattacacacttaaaaatgattaaaaggatgaaacattttgttatgtttattttaccataataaaaatattgcatgctcaggaagcaaagtaattttgcaattatacaactgttaaaaatggaagaattatgtactgagcaccattttctctgttgtttatgctacaattcaactttctctctctctcactctttctctaattagcaatgatcttctgtctggtccaaggtcacacatttccagtcttccagaaatgtctgttgaatctgttaatttgttgccaggaagaatactcaaacttctcatgctcatatttgagtgttagctgtctccagccagcatttctaagccagaccctttgtcaaggcttttgaataattttgtgaaaagtacccccaaagatgacagtgttcactgttggcagcaggactgtttccatgcagtagggctatgctgggtgtgcagtggagctgtgcacactgtgctcacggggcagattctgtgctgctgactctgatccctgtgcttgggaggaccgtgtccactgctgagtctacatctgaatttgattctcaagaaaaaggtcattcatagctattggacactgagtcacatagagggacagaaggtggctgaggacaccttatctctgatgagcataaggggattagatctgctggtggaacaggaagctgaagaaacctgtggctctaaacatggaatttccagccctgagtctctgctgtccgtgcccctctcatctgtatgttcctgggagatgtggaccacgggggttagaggtgaaggggattgggaagctttcatgttctctctcaccatctcccttgcttatctaacacactcttacacacctactttattggagcttctgctctacaaacatggctgagctctaaattagagacttttgaaagtgcagacggatgcaggaactcgtccatctggagactttccaccacttgaagcagtgaacacgtctgtgcaaggctcagaatttcaagtgacaggatgttgggatttcaaagaaaactaaatctttggatgaaccacgacagaagagggaaggttcacacatttccctgctgcttgggcctcagtgaggactgactcagccagtctcaggctcctggagaccgcctgggagatctgcactaggaaaccattttcagcacagcctggggctggtaaggggcccttactctgttattctgctgcctgataattttgcatccagagaagaattaggacctgtgagtccaggaatttcaaagcccatagacaaggtcccctcattctgccgtgacagcctcagctctgctttcccaaaaaaagagcatcttcccagcatgaagaaccaggagcaaagagggagcttctcccaggggtgagcagggcagaagccaccttggtcagtgggaaggaaacatgctcagctcacatctgacccagaatgactcagtcacacctgtgcagggtcacctgtgtgtgagcatcatctatttgctccatgagaaaataccttgtgtggctcttgggtaaaatcataccataggtgacatttctctgcctattgcttcagccgatgcttttcgtgattccctttaggacactggcataaggtaagcatgtcaggtgtgggacgtattgaacaggaaaagcagaggcttctcatatcaatgctcgtggcttgtatttgggcccatacctcatggaaatgggaaaaacagaaaagaaaatgatactctgctcaaaaaagcactgagaaatgctatagtattaatatatcgacaactcatttattgagctaatgaaatattaacatagatagatcatttttatagggggatccctaatccttaaacattatattaaaaatttgtcagcttaaaggatcattaaaaggcctatgtttgattgaaacctggagtactgtactttgagtcttctaatcagccaatgagtgcagggagctggctgccctcccaggtcctgactggctccatgtccaggtagagcagcgctccccacaggcagctggaggaactgacgaggggaagctgttggcatcagggcctcaaaaatttgactcaggattttcccacgtcccctccccaagtccaggcgggttccaggacactcagaagagctcatcattatgggtctaggacttccctggtcctgctcttctttcttccttccccagtggccttaagattgtcactccctgtcacaggcccttcctttccttgtcaagtgcactccctgaattctctgctcctgggtcaggaaagctctggaacttcagggaaagcagtgctgggtgacccaatggggacccagaaagctggcccagggccagatacacaggcagcagggtgggtccctacagtgctgcctggtgggcatcaggtagaggggagtgaccaggaccaactcccctgagtgtcttcagggccaggtgaactagggagggtctgggacctggtgtggacccatgcactgacccaggaataggacaggaaactcctcagagcaaggactgtgttttcctcatgctgagctcctgaaaagcagtcttgccaggatagagtgggccagggtggatatatgttgggtgaatgagcttctgtctctgttttattgcaggagtcactacgaaggtacgctggccctgtatttgtatccagaaccagtcaaagccacctgtgagtcctgcatccctcagtaccaagccccagtcccccttcaggaccacccaccacacagagagacagacgtgcagggagcctgaggaagaacctgaaacctcctctactacatggagtgtttgtatttccatcaggaatcttgagcaccttgtgccgggtcttgaggcaggaaggggccacacagagaagaggagtttcttccctgaggtcagcagtccatgaacgaagggatcagggacttgagcagcagattctgaagcaacacctggacccaggaggcccctgagcctccagcagcccgcgtagagtggccaccagggggcagcagagagtaacctggcagaagcacctggagatggggtgggcctgggcatcagggagatgcccacatgcagggagggtcggtgaccatgacctgagatctggagggaaagaggttcttcttttcttagagtatttgtccttgacaccgatgtttacattcttctggcttcctggttctcagatctgactcttggagatgatccttatttttctgacacacattcaggcactttgcctcttcccatcgacctggcccccatctcactgtcacacatgccatcccatcctgtagtcagacgtgtcccacctccctgcctttgctctgggagcccctgtcctgcagacacagccacttctccttccctggccacccctcaacgtccactgtccccggtctttcctgactctgttctggggaacctgccaattcgtagttcttgatttccttatgagacacacaatacttactcattaatcttttgttgacttaagtttttatccattgttacattttcccagcaacagaagacaacttagttataataaacacttacttcctgggtcttggagtttgcagccccctctcattttctcatgaagcaaacatttccttcacctcctgatctgtccctggtcctgacagcaccctggtgatactgaggcacagcacccatgacctgacactagaactcgcagccaaggtagaaacttaccgcatcccatggatcttccaaaattctatgtgcccttggcaaccaagaattgcattctcctctagcacagaggagctgtgccctggaatggggcctgtacctgtccaaggcttgtgccgtcccctgtgggagatgagaagcgtccctgcattgggctcttggggacccgtcttggacatgagtgagaatgaagagggtccctgcattgggctctggcatgtgactttaaatggatttaggcctgtaccagacatctcatgtctgacataaaatatttacaatcaggacattactagagaagcagaaaaaagctaaccacctccctcctgagccaggatggaatgaaggaggggactgtggaccccagataattcccctgtcaccactgtgactctaacaacctcttaaatcacggccaacatctatcccataggaaggtctttatatcccctagaaaatacagaggaagtcagctctgagcttttccacgaccaacccagccaaggagcaaggctgggcacaacctgggtaaagatgtgagcccagaccatgggaccagtgggtgaaggaaaatcgcatgggctgagggggtgggtaagcaggggccagccctcctctctctgtttcctttggggctgagtccttctctggaaaccacagatctcctccagcagcagcctctgactctgctgatttgcatcatgggccgctctctccagcaaggggataagagaggcctgggaggaacctgctcagtctgggcctaaggaagcagcactggtggtgcctcagccatggcctggaccgttctcctcctcggcctcctctctcactgcacaggtgatccccccagggtctcaccaacctgcccagcccaagggttctgggtccagcgtgtccttgattctgagctcaggagggcccttcctgtggtgggcaggatgctcatgaccctgctgcagggtgggaggctggtggggctgaactccccccaaactgtgctcaaaggcttgtgagagcctgagggactgcacctgccaggagagagtagtgagttttcagttcaaagtctccatacaacaggaaagtcatgggccactggggctggggctgattgcaggggataccctgagggttcacagactctctggagcttgtctgggacagcagggcaagggatttcataagaagcatctttcacctgcaagccaacctctctcttatttatttatttatttatttatttatttatttatttatttttatctttgcaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatcccacggtgacacaggcagatgaggaagtgagacaaaaacaccctcccagcctcggtcaccctcttgctccagccccgggaagcctgttgataaagccatgagtgaatctggcccagttcacctggatctgagcctttcaggttgcccttccctccagccccctccaggagtctctacagaagatacatcaggcataaatatggcctggaagggccagaatcatctggtgacttggggctgttgtgtgagttagagaatgaaggcttgggtggaaagacagacagaggcaacctctgtccactgtcctacccctggatggtcatatggtggggacagggcaagtccttagaccaactgtctggatcaggccccagaactactgcccagttctgctgaggtcctggcccccaggctgtgtggcagcctgtgattcccaacagagcaaaccagaggaatggacactgtgaagtctgcccagatcccctcctcaatgtgacccacctggcactgctgagaagcccagcagctcagagctgtgccctcactgggaagtgctgttggttgcagaaagcttcctcaagtttgtgtcccttttcagaggggttcggtttaatcaaccaagatctcaaatccttgcctcaatttaagatgccactgaatgaagggcctcccagctccagagctccctgtgtggatacctgaggcctcaatgtcaactccatcacgagtcagggtctccttctgccccgtgttgcctcccccactcccttctgaatcttctgtgcatggacatctctattgcagagttagcttccagagaaccccatctaagatggccagctgtccccaacatgggtcatcagggacctgagtaggccactataaactgaaaactctggtttctgtccaaatttgcagagtaaatgttgaaatgcccaatctgatggttccttgaatttttatggaatgaaaagggagcctgacatgccaggtgctctgggttgagggattgttggagtcagatctccctgcaggaaagcccggggcagggggagcagcctcacccctcacaggaaccacagatacacccacaaggtgagctgcaggatggatgctgcccacctccaccctccacatcctctgtaaatgttgctcctttctacaactccaaccagatatgtagatgtggcgaactacgtaaaatacggatcattcatcacatcaaaacccactgcaggacaccctggtcaacaaagaacccaatcacatccccatcaactacatagtttccaaattttccatctccagaaaaataacaataacaatatacatgaaaatcgatgtaatttatctcatacataatttcatgttgataacgtgaaaatgatagtattttgctctactgaaataaataaaatatatatatatatctgaatttatttgtcttatcttttcatatttaatgtggtgactagacactagggggtcacaggaggatcgtgtcataccactatgggacagagctcctcacaactctttcaggtgacaggtactgttgagtaacctgctgcaagcatccccatctccaccagaccatataagtgtgaacccaggaagaggcactggaacaatagagagaaaaacctgcttgtgcagaagacggtgcccttgagccctgctcctgctccatcctacgggtgccacattcatctcatggtgtaatatttcgtgccctgcctgagcttatgaccgaggggatatggcaggtctgactgtgtggttactggtgtctcatgaggttctggatgtaacaaagccctcgaatatagaagaggttgttttcaaaaggaaataattatctactgcacatgacatagacttgttgctaaatcccatgcgtctacactaggattctcctctgaagccttgccttaagcacaaggtttcagttcctatgtccagttcctctattatggtagagtctgctagtttctctggcccaatagcaggacactcactcccccacctgcacctgctgcagagcctttctactcttggccccaaaacactgggtgacacagttctcagacccatgatttatagtgtcagtattcaggcctcaggggtccctgatggcttctctggctccaagtctggaaacacagcctccatgaccatctctgggttccaggctgaggatgaggctgattattactgcaactcacataggagaggtggcactttccaccgtggtccaagttcatggggaattgagacccaaacctgccctgggctctcagcctctctcttgttctgaagatgcttcctcaccctgtgcaaggggcttcttgcagcactgccttgagaatttcccctctcccagctcctctcctttctcaccaggaagtccaaaaggaaacctgctctgtgatttctcatccaggacagtgacagcttcctgatgcttgtgtgctgtggtccctgaatgtgcaactcttcctagctcttcaaatgcaggcacatagtgagaaaagctgcctgactggtgcattcactgctgtttttaaggatgtcctcacccaaaatgcatcctcctcccaaattgtgaagaacaatctggacagaggtcattacagggagtttcaagaaactgcatcttattcaattgtgtccaccatggtctggtaaagatggccctcctggatggactattcctctgcatgtctgtcctgaagcagtgaccactgtgagaagatctgaacatgtttgtgaggtattaaggacgagaggaaactgttgtttttattattcttttgtttttgtttttgaaacaaacttttgctttgtcgccaggctggagtgcagtggcagaatcttggcttactgaaatctcagcctcccaggctctaccaatgctccctgcctcagcctcccgaagagctgggataacaggtgaccaccaccatgcctggctgatttttgtatatttagtagagacgggatttcaccatgttggccaggctggtcttgaactcctgatctcaggtgatgcacccacctcggcctctcaaagggatgggaatacacacaggagccactgcatctggcagtgttttttttatttttgctcctcctctttgcctcaatacctcaggttgctgagctggggagattttgcgtgacaggctcagtgctccctcaaaatcctcccgtctcaattcgctggggccctgtcctggaaactccccaaaagtggatggtgtccctataggttgggagtttccaaaatggccccacagggaagagttaacgtgagtccattccttcttcctcattgacatccagcatttgtaatttccatgggtgtcaatacttttgtagctgaaatctttcttaatctactaaaggtgagaatgaatttaataaatattcagacattagttgcatccaatatttaaattttatgagtcaattggtagacatagccattattatatataatttaggcttcataaactttgattaaataggttttattaaaaacaaagtaaccattttattatgtgtttagactatatcaacatgttgtgtacctgaaatatccacaagaaaatatatttcaaaaaccaaattgtatttattgtctattgttgcataaaaattgctccctaatatttagcatggtaagagaacacgtgtttgtgatcttgtcacttcggtgcatctggaattgagagcagcttagttttgtggttctggttctgggttggtcatgaagttgcagccaagctgtcaggccaggctgcattcagaggccagagcaggtggccaggcccagcctgaggggcttccactgtccctaacctgtttgtctgatgtggaaaatctcagaggaaaaggagagagtgaagtgtaaggcacctgtcccagtcccccttgtcaaaggccatcccatacctgcaccatttcttattctttcctggggcgtcataggcatagagcactgcccattcattctaacgctgtagagtattctgtagtaggattttagccatgcagcctctaatggttatcaccatgattttgatcttacaaatcacactgcagcaagcatccctgtgcagactcctttgagttcatgtgtgcatatcaccataggataaatttccagaagtggaattgctgggtcaaaaggatgtgcatttttaacttttatccattgttttcatattcccctccagttctaccagtttacaataccagccctaaatattgattggaattcattggtgaaagtgcaagtttgtgccaacctatcagatatacaaagttatcttgttacacatttatttttgatttctcctattttgcttgaggttgagcatttactcaaatatttcagtgctcattatgttttaggatttggtaaaccgtttcttcaatgcctcggtaagaggtattttagtctttgccatgcacaagacaacgttgggataatatgtatgttctgatacaccatctacaacgtaatcattaaaacatataaaaaccactatcagttctggggccattaaaaaaattggtggcaggccagggatgtcccacaggatgtggtttaacggtctctggtttctagggttatttgaagtttgaacattgcacccgcatatgttctatgtggagatctctttgtgagggacactgtaattcacctcctctaggggcctgaggtctttctttggataagaacctacctgtaccatgtgtttgattggatcttgtgtctgctcaagacagccctgtgtcacaagctcatgactttcatcttcatccatttgctctgttttgtgagagcttcagtatatcaggaatagagattcctccgaggtgaaaaattagaggcagagggaggggcaaatgggcaaggaagcttgcaccaagtcgggagtgatccagtgtaggctgagagaaaaaaggtcttaaaatcagccttgtagctgaaaccaaaaacacacaagatggttggtgttctgagcatcattaacaaatgataaatgaagttgaacttttaaatgtattgcaaatttttataaagcaagtagatcgttaaactcagaatgcaacaatggaataaagaagagagtttgagatgtttttaaaatttatttatttatttatttatttttgagatggagtctcactctgttgccaggctggagtgcagtggcacaatcgcggctcactgcaacatccacctcccgggttcaagaaattctcctgcctcagcctcccaagtagctgggattacaagctctcgccatcatgccaggctaatttttgtattttttgtagagacatggtttcacaatgttgaccaggatggtgtcaatctcctgacctcatgatccacccgtctcggcctcccaaagtgctgggattacaggcatgaactaccgtgcctggctgagtttgagattttaactgtaagtcctccaactaagttgccatgacaagaacagggatgatgagagtggaaatatgttatcctgcaaattatcgttttatgtaaaagaatattttccctcttttaggtaaaggaagcatcttctggagcaccttctctctgactatcaaagcaccattaagccacaaataaactgtaacatgaagtaggaaacaactgcccttttatataaccattgagaggtggctttatatgcataccaaaatgttgatgctcaatgctaaaattggatttagtaatttaatatgcctacaagaaattaattttctttggattatattatttctgtgtacgatttatcttagttaacttggaaatattctgctctaaaaacaactcttgttttttgggttatattttctgtatcaactatagctcttttccaaatgctgtcagagatagcccatggctactgatcacaaaattcaattttatggcatttaaattattctatactctaaattattttaaaagtgcacagatgtgaatttttcacatctgactcaaaaatgttgctgatgttgactcacttttttatttcaatcttattgaagtaggagtttacttttctggaacctggatgataacaggagactggagaggaaaccccccaaattgttttcctttaaaccctcaggatgaatcatcctggataatcacccacacttgatttgggtgatatctaaatgagagttgggtcttagagtaggtgctgagttagtttaggacttgcgctgttggaatgagttgaatgtttttacaagtgagaaagacatgagttttttggagtccagagggtggggggttattggctgaattaagtcccccaaaatgtatgcattgaagctgtaacacacaatatgtgactgaaattgtgcatagggtctttaaagaggtgactaagtgaaaatgaaaaaattagggtggattcttctcaaattggactgatgtcctcctaggaagaagaaatttgcacacacagaaatgaggcaccagaggtgagcgtgcagagaaaagaccaggtgaggattcagcaaggaggtagcaacctgcaagccaaggagagagtcctcaggggaaaccaaacccactaccacctttatcttgggttttccagcttcagaactgtgagaaaatatgtttctgccatttcggtcactaattctttcctatcttcttgtgggagctctagcaaaaacaagagggaccccaaagaccttggatgagggagaaggaggagatggagcagggtgcaggaggcggtgcaggaaggggctggaaggtcgggctctgaggtgcatctcctgggtggaatcttgactccactccctattgtctggaggacttgggaaaaacatttaacctcctaatattcactcactaataaagatgggcttgaagcacaaggctccccatcatcctattctatattacaaaagtcttcttgaggtaacacttgtaaaactctcgctaatgcatctggcatgtattatggactcataagtagcccttctgagtgatctagtgatgtgcagaaaatggcattcatgctgtgtgcaccagggggcactgtgaggtttagtctgaggcccctaatgagtccaagcccctagtaatgctcaagggcgaagagcctgactgttgcttcctatgaggccccttctagtgggtaaatctgaaaatgcacttggcccttcttctgatcttgagaaattactcagagaaggccatcaggctcagggctcagacaagaaccaggacaaatgttttagggaatggagaacagatttgcatccactgctcaccagagccacctaacgacgacacaagaataaaggaagtagatttgcatgaagagacttcccttcctatgataagagaggcctggaggttcctccttagctgtgggctcagaagcagagttctggggtgtctccaccatggcctggacccctctctggctcactctcctcactctttgcataggtgctgcctcccagggctcaaccccatattatcatgctagctgtgccaacctggccctgagcttcggctcaacacagggagtagtgtagggtgtgggactctaggcgtgaaacccttatcctcacctcttctgtcctcttttgcaggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatctcacattgacacagacagatggggaagtgagacagaaaccccttcactatctgtgtcatcctctctctccagccccagcaggactgtgaacaaagccataaacagggctggcccagttcacctgcatctgagacctccaggctgcctttccctccattcctccaggtaggctctgcagaaggtgggtcaggatgatgtgaggcttgaaggaccaggctgttctgctgttgtttagactgagtgtgccttgcctcaagatgacctgaatggaaggaccacaagaaggagatgggcagctgttgagtggtcatgatccctggagttcctcttgtgtggtgactggatctaacacaatgcctgtactttgtggcccaaatgccctggattattggtctgaactccccatgtttaactgagaccctcaagccccagctccatgcatcctgatgttctgaacaggaaagtcttttctagtgagcactgtggcatcccttggcatcccagcttcacacagcaattccccaccaaaaaatgcctttgagtgcaaagaacggcttcatgcaaagatgtgcctccttcagaatgtagttcaggagcaataactacctgatgccttaatcccaaagccatattttaatttagaatgaccttgaaatgccttctagctgagcagtcagttgtaacacattcccagtcacgcctcccacacttctttcctgacagtatgtcatgaaaccctactgcatggaatcctgcctcttagagtaggattccagggatctcaaaaattgtttagaaatgaacaaaaacagtctagttggaagagtatcaaagaggaggcagttgcacatgcagagaactctgaggtctgcaaatatacatgaactgatgagcacttgtgtgtaaagaaacacctccgaaagagaaaagaaccacgcaaagactcttgagggaacacctcacagagctcactcccacacacacccacccacgcactcacagacactcacacactacagtcacagaggaaaggcctgacttacagggcatgaggttgactcatcagaagagctttgcctcagtactggggaaaaagtcaccctagacaaaatgctgctcaggtctcaactatgaaagtgtaaaagcaaacagaaaactcaaactgtttttctgaacagtaaagtaactttactgaattcaacaataaaagacagaaatagagaatgaactgcaaaagaattctcaacccagcaggaaaaatgcacaatgccttcatcctgtcaatatttcctgcaaggtaaccagaaaatatatgctatatcaaacagagaagtgaatcaatcccaaatggcaataaaattgcacacatgatagaccttgtaggcaaggatatgaaagaaattcttataactctattctattctacttgttcttgaggatataagattgaaaaatcatattaagtggatacataaaacatataaagacagacgcaagttatactcttataaatgatccataatatgtctgcaataaaaaatacactgaatgagactgattgcagattggattctgtgaaagaatagatgagtgaacttgaagatatggcaatggcagctattcaagacgaagcacaaaagcgtaaacagagtatcagtgagttttaggacatcttcaactgcctaaattggtataatgaaagtcattaaaggaggtaagattggacagggaagagaaaaggcagaaaaacaatttaaaggaacaatgaccaaaatttcccaaattttgtgaaaactagaaacctcctattccaaaaagtttaacatgtcccaaagacacacacacacacacacacacacacagagagagagagagagagatagagagagagagagaaagagagaaagggagagagagagatacaggtgaacaacaaaatgacaagaacaaatttggtttttaaaaatttttttaattttagtggcttcatagtaggcatatatttttattgggtacacgagatgtttcaaaacaggcatgcaatgtgaaatagccacattatggaaaattcggtattcattcactcaagcacttatcctttgtagtataaactattcaattacactcttttagctttataaaatgtacagttaagttgttattgactatagtcatcctgttgtgctgtcaaatagtaggccttattgattatttctaactagttttttcttacccagtaaccatccccaggtaatagttgatttcttattagaagtaatgcaagcctaaatcagtggagttacatttagaaaatattaaatgaagaaacttactacccaaagcaatctacaaactcaatgcaattcctatcaaaataccaatgatattattcacagaaataaaaaatcctctaaaattggtataaaaccctaaaagacgctgaatagccaaagcaatactgagcaaaaagaacacagctgaagatatcacactactagaattaaaatatgctacaaactatagtaaccaaaacaggaagttattggcatgcaatcagacactgagaccaatataacaaaatagaaaacccgtaaataaatccatatatctatatatagctgactttcaacaaagatgtcaagaatgtacactgagaaaatggcacaattttcaataagtggtgctgagaaaactggatacccatctacagaacaatgaaactagacacttatcctctccacaaaaaaatatcaactaaaaatggattaaaggcccaaatataacaccccaaactataaaactactagaagggaacttaacataggggaagaacaaattctttaggacattgttctagataaaaaattatatggccaagacttcaaaagcacaggcaacaacaaataatagagatatgggacatcattaaactacaaagttcctgaaaagcaaaggaaacaatcaacagagtaaagacaacatgtagaatgagagaaaatatttgcaaactgttcacttgacaagggcctaacattcagtgtatgaaaattttaaaaaaactgaaataactcattagcataaaaaaactaataatatcattaaaaatgggccaagaatttgaagagacttttctcaatagaagatatacaaatggccaacaggcatacgagaaaaatgttgaacatcactaattagtgagggaatgagaatcaaaaccccagtgagatacaatctcaccctagctggaatggctatgatcaaaaagacaaaaaatgcaaagctggtgaaggtaggtgacttcacatttctctagtccgattctctgggaacaatgagagtgctctgtctttgctctccctctagtaactatttttcacacgcaaaaatatggaccctagtgggaaataatgcctaagaccaccaacaccttaatcatttgttcatcacactagaaatgaaactgttttccaaataatattaacatctatctgtgtctatcgccattgtgtcaatgtctgtgtgatcctataacatttagaaggcctagaagaatgcccttgctttttgcaatatgaaaatggccgatatcatagatgatatagatatagatagatagggggttgtattttgaaatgtatttctctaaaggacttctttcacttcaaatttgaaattattcttgttttaaatgtcacaaatgataaaccttatagaatgataacacaattgtatgtgttataaagtcacagggtctatcaaatgatgaaccaatcattcggtgttgaggttagtagtattttttttatttcgattctcactaaatgagaacacgttttgtattgaggggccatgccctaaccataccacatcgtggggttgctcagagactgtgaggttctgcccacactaagccagaaggagaattttattcctaagccaggatgagaattttattcctcacactgctctctgcacttgtttgtatcccataatatcccccaaaagtgagcatgagaagttcattttttaagctgcttgttcattctcttacatttaatacatgtaccaaaaattgtcttcatttttaaaataaaatgttatgctatcttgtaatctataaccctatagaataatcttgatccatacacttttgctatcacaagcagaacaagatccacttcctctctctgggataaatcccatgaccgctgctctttgagcattatttttcttaagttattttttaaacagaaatttatctgacttaccttaaccaaatgtcttttcaaagtaaccgcatttcttttaagtgaaaaattaaatagttaccttctgttatcaagaattatctgaatacaaaatatttattgtttcaactttagaaggaatgaaaaacatctacaggttactaatctaaaaatgcaggctctgggtttctatggtgttaacatgtcttccaaattttaagtaacaggtatttaaataacatgaactttgttttcaaacttagaaaatgtttcaaccttttggctgggcatggtggctcaagtctataatcccagcaatttggaaggacgagctgcgagttttgtctgatcccaggagctcaagaccagcctgggcaacatgatgaaactccatctctaccaaaagttataaaactttgccaggcatggtggcactgcctgtagtcccatctactcaagagactgagatgggaggattgctggagccagagaagttgaggctgcagaaggtaaactgtagaggctaaaacatgataaatatttaattcatcacttaaaagaaatgttggttacattgaaaagaaatttgattaatgtaattagatatatttctgtttaaaaaataattgaagtaagccctgttagcaccactgcattccagcctgggcaacagagcaaaacctgttaaagaaagaaagaaagaaagagaaggaaggatgaggaaggaaggaaggaaggaaggaaggaaggaaggaaggaaggaaggaacgaaggggaaagaaaaaaaggaagaagatatttcaagctttacagtaccagagccactctgtaatcaataagcaacaggaccaaaacagaaagagattctgtagaacagtctaaccagcgatacaattatacatttctgttcagatatcaaaaccattttcaatagtaaatatatggaatgaactccccacagagatcaagtaggatgtatgatgtgtgaatgaaattatgagttgagagtaggaaatttataaatttaatcaaacaaattaaagcattatgaggaagttgtactgctaatgtattacttggcaagctgttcagtggaacaccaagatattcttaaggaagttgcaaatatcttttaaaatgttatcattgaagtggatttttaaaaaatgaggacatgaatacctttacaaagtattcagggataaagagagaaaaataaatttagattgtgcatacatatataaaatttattttaaaagataagcttgtcttttttatcccttaaataaaaggagcagatatttaaattccttgtcttttattttaaaatttagaaaatgcttacagcttcccacactgaaatttatactaagacagataatctaatcaagggataacaaaatcaaaacagaattctcttgatgaatctattttcttgatttttaagtctcagtgtgtactctatagtaaaactatttataattgattctgctgtttgaaaatatttactgatcgtttatcttgcaccaagtgatctccagctctgaagataggtcagtgggaaaacatacaaagttgcccagcttcgttaaacttaaattctaatgaggaaaaaagaagtaattaatcagggactttaaaacaggagtgttgtgatatggcttggaattctaactgcttcctgtgcttgctgtgtggagactggattgaaaaatagggcgatagaagcttaaattcatatagaatatggctagcctgtattttgagggcccctgaaataagaatgtatagtagttctcattatttcctcaagaaatctgtgcagtagagctttggccttgggagggaagtactatagtcaccaagtggtgagggtgggaaggtgaatttgcaaataccacttggaatgagttcactttaaaggtaaagctggcaggattttcatacatgtcagatctgaaaaaatgtgtgtgcgtgtgtgtgtgtgtgttatagagagagagagagagagagagtgaaaaccagacagataccgagagagaacgacagatctgcagtgacagagagaattaaaagcggacaccacgaatattgagctcagaaactataaaatgggaggtgccattaaacagaatggggaagagcaagtttgaggagtatcagtggctccatgtggacttattgattttgacattcctaacagatgtccaaatggagaagtcagacagtgttgtgcgtagtctagtgttaaggtatcaaagaaaatatcaggaaatgagtgacacaaaaattagtaagaaagcaaagataagaaacattagtcaaagtcctgagtccagtggttatctaacacccaaaaagtagtaggccgggtgccgtggctcatgcctggaatcccagcactttggaaggccaaggcgggcagatctcctgaggtcgggagttcaaggccagcctgaccaatatggagaaaccctatctctactaaaaatacaaaattagccgggtgtggtggctcatgcctgtaataccagctactcaggaggctgaggcaggagaatcgcttgaagcagggaggtggagggtgtggtgagccgagattgcatcattgaactccagcctgggaaacaagagcaaaacttcatctcagaaagaaaaaaaagtgataaagacaagaagaaaccagcaaaaaagtactaggggtaattatcaaaaatgtcaaagggaaagtaggttaagtgttctggaattctctcaaagaaagttttgaaaaaaggagggaggaagagatcaactgctttcaatgctgctgatacataaattaagacaaaggctgaggaattatgcttcaattcatcatttaacgatatggatattgtttgtgctttgataagagcaattttcttggagtgagtaggtgagaaaccatattggagtggtttctcaaaggaatgcctgatctctggattcttaaggaaactttttattgaacagtggaggcacaaattggatttgttttaattccggggtcgggacacactctaaacatgtgcctctgcatgcctcgcttattacagctaggtatcctagtatctttcagtaacagaataatcacctgcaaaacccacacccatttaatagacacgctttacaaagactgatactagaagttgttggagaggatgtggttccacgtaatatcttatgagtcactgatgggcaagtaagctggtaaaatgtctttggaaaactcactatacctgctatactaaaacattcagataccaaacaccagaaattccatattgtaatatatttctatgagaaaaaaacaagagccctgtattaaaatatagattattattaaaaataatcacactgggtttcctgatttttttattagcaagtcagtctctgcctgattcaatagtacaacctctatctaatatatatatatagtgtttttaatcaaccactaagaaaaagtattatattttatatcaattctacattcagtgccgaaaccagcattttgtagattccagagatttgttgaataaataatgaataacttaaataagttaatatttatagtatccatatacaaataatacatcatctcagaatacaataataacgtttgttatgcagaaaatgatttcaatctcagttaaaaatattttgggcttaggagttactgtcatatatggatgctcacattgttttgtttatacgaaaatgtttgtagttaacgtacgtttttggtacttaagccttttgttcttgctgccatagcaaatagtgtgcctattaggaacaagaaccagaggtttacttcatcttaacagatttcttaataaaatacatgccatactgtttggtttaatgcataagcaaagagtcattcactccgccattgctacgtgtccctcctctaatacggctcctgaagatgttaccgatagcagaggactttgtgttcaacctaagcactttatagccctttcactttcaactaagtatgagataaaataattcagcaccaataaaacaaacacttcttaaatactgaccctttttttgagcctgtttcacgttacgcagcaagacagagtacacttctctttcccagcaaatcagtgttggcactacaccctctacactctgaaaacttgtattattggcttccttagaaacacaatttgagcttataatttagatgtcatcaaataatgtacaaaaatatgctacttccttccccttcacttctcttctcttctcttcttatcagataattgtcagttgttttttctctccaactcctttcctccgactacctgatttttaaaagactttctgcacatttccaatcttagtattgtagagacaaaatgtgtggtcaaactgcatatataggaagagctgaattatatgcaagcatttttaaatacacaattcctcctcagttttctgtgattatttcatataatcaaatgtcttccagatacacatcccaaacgagtggttgtcaagctctgctttgtggtctaatttcatcagaattatccaaaattcttatgataaatacagataaattgacataactccagatttatgaaatcaacatttccagaacccaggaatatgcattgaaaaagtgtattcctcagatgatgctgacatgatacgggatccgagtttacaatgcaaggaaaattaccttccttgcccttcagctgacccttgtatccagaggtcctcttcccctttcatattctgccctctctccttctgcacctttctcctttcctccctccagttctgctcatccagatcccaagccctcccccatggattccctaaacctcccaaatggtcagttgccactaaagttccctctgtctcatgaacaagttatgtgggcaaatgtaaaatttaagcttggaccaagctgactcaagagcggcaattacaaatttccctaaacccagaggggaccagcaaacacttgtagaagattagagatttcctgtgagtgcaaagggctcagagtgtcctgatgctgtagaccaaatcttactgtcccctccaattcatgtgttaaaatctaattccctatgtgatgggatttggaggtgaggccttggaaggtgattaagtgatgaaagcagagaacccgtgaaggggatcagtgtccctatcaaagggacggctgagaactcctcatcccttctgtcatgtgaggacacagtacaaagatggccgtctatgaaccaggaaggaagccctcaccagacacaaaatgtgctgaccactcactgctgactccagtgagtcagaggagcgcaggccacatacctgggtctctgcctccatgcctcccacagtgcccagggctgagagcagagtggcagctgctgactggggctgtgctggccacctgctctcttctacctcttgctcaagccatgctttcagccccatggctgaggccagtggctagagcaggtgccatgatgtcaggcagctccttaatgggctggtccttggcaggaccagggcaggggcaggagggctctgcagctgcctctagctccagttctgtccctgaagggggctcttcccctagtgctggcactggctcatcagctggtgctggaaggtcctggattgccgcacattgagcaggagatgaaaaagaagaaagagtcaccaatgtcagtcactttccactggaatttccacacacagaatcagcctcactgaattaaaggaattccagtccaaaaacactgcccccgcaaagtctccaaaactacaggccccccctcaccatgtgcctgtgcctggaggaactccagaggctccagcaggccaaggacaatgcacggatgtggcccggatgggatcaccagtgaggcctggcctcgtagggcctgcccagggctgtcctgtggtacctgggtgcgccttcggccagaggtgcctggggtgaggaatgagcctgcatcggcatcatgggaaaaggctgtcactctgggccctcctgaagcaggagcctcaagatatgcggatgcagcatgagaacatcttgctctcctgagcatctcccaccaagggaactggctgcgggactgtctctaggatgtgggtgcctggttaccagaattctaagttctgtgagggtatatcaccaaggaagtgaagtcacttctttaaggttccgtatcctcagccccttccttccataagacctactcagaaccccctgggctgctggctgctcaccctccccccaggccagatccttacctgtacacaggtaagtccacccagggcctgcttgtacacgtgctcctgatgtgcacctgggacctaggaatccacttagggcctgtgatccaacaggggcctaatgttgtttaaaagtaatttttattattcctacaggaaagaaaaggccttctagcaataagaagcacagtttcacatcaaaaacataaaaatgatcaaaatcttggggaagaaatgtatcaattttaatcactgaaatgttaacttttgataaatatttaagtttataaggaaaaataaaaccatgctgataaaaccacagttgtagggaatgctatagagtttctcctttgtggtttgaacacagaaaggtcccacctagttaggctcataattttctaccttaatcttcttgttcttatgattaatggaaaaaataccatgacaatgatggtgatgatggttcaagtacacactgaggtttagtgacagaaacatcaggtgctcccagttacagtgcagctgttcttattggggtgggaaaatcaatcttgtgttcagtatacacgggaagcaggagtacatgtggatatgaccacatttcactggacttatattttaaacagaagatctacagtttattcttcaaaaaataataacacttgccatgcaaagtatatatataagatgtctcaaataattgtacttacattgcatatgaaagtgatacattttgatatgctaggtaaataaagtaaattatttaactcatttacttcttccctttgtatttttaatgcgatgactagacattcagatttccatgaggctcacatcatattgtgaatgaacagtgctggtctgcaccccttcaggttacaggggctgaggagtgacctggtgcaggaagccccatctccatccataggacattggtgtgaacccagggagaggcgctggtgtaagagagatgagaacacaggtgtgaaccacctgcttgtgcaggggactgagccttcacataagttgacacttaaaaagccaccacaccccacccttgtcaacaggaaacccattcacatctccatcagccacacaatctccaagattcttcaaaaagtaataacaatagccatgcaaagtatatgatatatatcataaataattgtacttacattatatatgaaaatgatactctttttgatatgctaggtaaataaaatacattatttaaactcattgacttcttctctttgtatttataacatgacaactagacagtgggattcccatgaggctcacatcatattgtgattgaacaaggctggtctgcagggcttcaggttacaggggctgtggagtgacctggtgcaggaagccccgtctccttccataggacatcagtgtgaacccagggagaggcgctggtatgagagagatgagaacacaggtgtgaaccacctgcttgtgcaggggactgagccttcacttggagccaaagttttctttcccaggttcaatcctgaacaagagggccttctggacttctttttgttttcaggcttgtgccccttcaggtttggggctgtctggatcccagccaggggacactgaggaaatccaggagtctcacactgactgttctatttcatctgctggggccatcccaaactgctgtgtaccatttcctttcctggtgctcaaatagctgctccatgcccttgtcatggtttcagagatgaatctaggtgggaagacaggacagtgtatgttataatatttaaatggaagctgaatccattaatatttattttaatatgaaacattaaaagaattttgtcataagcaatgaggaaagaggaaaagatattcaagttattttgagaaaaaataaaaatgtatttatcaaatgtctgtgtgtcttcagtgtcgcagggttgagagcagccagctttaggttgccctgaggatgcgctcagatgggaaaaagcgagaaagcaggaaacgcgtctctgtgacctgacagataaatcacagtaatggaaataagtctttcaataattcaaacattcacaataaatatcactctgatgcacacagaaaggcctggtaacaaactttccctttgacctgctggctcatatccccatggatcacctgtgtgcagagtggactctctggtccccatttctcaggctgagaactagaggctgggaaggacaagtggcctgctcatgagtgggaagggcgggattgggagcagcagactcgggctcaggactctggccctggtcagtgctccttgttccctccacagggtccctcccacatgtgcccgtgtggatgtgggtgcactgcctggggtggctgatgtgctccagggattcaatgcggcagatgcttcagcaccaaaggtagggagtagggatgggacgaggctgcagctgtggagaccagggacccatgatgcccagcagaggtttccacggggtgggtagccccatttcctgacagtagagacagcctagaggtgggtgccaagcagagggcactgtgccatgtgcccaggcctggagggccacagagacacaggcgccacacagcagagacactgagagccaggagctcactcaggtaagggatgtcagcagatctttctctcctgagcaaatcaggtacaaaaaaattaagatcctgccatcagaatagacaaacagggactttaatctcctcggctgagccccgctgtccagggaagaagaagtctctgagcccaggcccaggtgagggtggagtgaggagaggagctcagggtgcagatttgcataaaggccccgccctcctctgaggcagaggggataagacagggctggggtcaggcccagtgctgggatctcaggaggcagctctctcggaatatctccaccatggcctgggctctgctcctcctcaccctcctcactcagggcacaggtgaggcctccagggaaggggcttcggggacctctgggctgatccttaactcctgctcctcaggctcacctgggcccagcactgacttactaaaatgtgtttcttcctttttccaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagcttatatacaagcagcagcactttccacagaggtccaagttcctggggaactgagaccaaaacctgccctgggctctcaggccccctccttgctctgaagatgcttcctcgcccagtgcaagcggcttcctgcagtgcggccttgagaattcttctctctcagctccttccctttccaccatgaattccaaaaggaaacccgctctgtggtttctcatccaggacagggacagcttcctgatgcttgtgcgctgtggtccctcaatgtgcagctcttcccagctcttcaaatgcagggacagtgacaaggagctgcctgagtggtgcagtcactgcttttttcagggatgtcttcaccctacatgcatcaccatcccctacactgtgggtagaattttagcaactacattctaatggttatcgccacaactttgatcttaaataacagtgcagcgaacatccctacgcagactcctttgagttcctgtgtgaatatgaccacaggattcatttctaaaagtgaaattgcaggtcagaaagattgtgtgtttgtaattttcacccattgttgtcagattcccctccagagggattgtaccaattttcaatgccagctggaagtacttgttcagagtacattgttgaaagtggaaatttttgccagcttatcagacagaaaaatgttaccttgttacagttttatttttgagtctcctgttctgcttacattttggccctttcagaaatagttcagtactttttctttttttaggatttagtaaactttataaaaaatatccagataaggagaattttagtgtttgtgggcaggcacagtggctcacacctgtaatcccaagcacttcgaaagagtaagacaggtgaattgcttgttcccaggagtttgagattagtctgggccacacagcaaaccctcatctctattaaattaatgcaaataaaaataaattttaaaaagaattattttagtctttgtggcccaagaatcaactttagggatattacataggtacttataacatcatttacaatgtaaccatttaaaaagataaaaatcactgttatctctgggccatgcaaaaacagttgtcaggccaggagtggccacaggatgtggttgaacggtccctggtttgcagagttatctgaatgttgaaaattccaccagcatatgatctaggtggggatctctctgtgagggtcactgtatttcacctcctgtattcggctgaggtctttccttggataagaacatgctcacatcatctatttgatgggctcatgggtttgcccaagacaaccctgtgtcacaatcacataacttttatctgcattgcttgttctgagttttgggagagctttaatatatcaggaatagactcctcctaagggaaaagtctgagggatatggatgggcaaggggtcaagaaagcttctaccaaagctggaatatccagggcaggctcagagagaaggatcctaatatcagcatttgactgaagccaaaaccagaagagaacatggacgttctgagaataataagtaaataaacagtttaaattttaaatgtattgaatattcttatactccatgaaaattctagaacggaatttaacaatgggataaggaagagagcttgagatgttaaactataaagaccacaaggcaagttgccaggaaaagaacaggacctttttagtggaaataggtttctgctgcaaattacctttcctatgaaattggtttttaggtataaggaaacatcccatggaacattcttctttcctacagtcaagatcaccctcaccccacaagggaacctcaatatcaaatagaaaaaataatgcactttgtataaccattaggagagtctttatttgcacatcaaaatgaggatggttaatggtaacattggaaatagtagtttaatatgcataagtgatgaatttcttttgactataccatttctgtctgtgatttatctttcttaatagggacatactctgttcttaaaacaatttaacttgtgttatcttttgttctattatctgtatcagctctgttttttttttcaaacactggcaaagttattccatggttaatgattattaaattcaatttatggatatttagattatttaaattatttcaagagtggacagatgtgatttccccacatatacctcacagatgttgctgatgctgacttgttcatctcttccaacctctgcaaacaaagtgggaaattggatttttctgaacacccagatgacaacgggagaggaggtgaaacccccctaaagctgttatcctttaacccctcatggtgaatctcccatccacacttgagttggatgatatgtaaatgagagtttggtcttagagttggtgctgagttagttcaggatttgggttattgggatggagtgaatgtgctttacaagtcaaaaactatgagtttttgtgtgcataggttggagagctcttggctgaattgtgtcccccagaattatacaatgaagttctaatgcacagtgtgtgactgaatttggagacagcctttacagaggtgattaagtgaaaatgaggtcatgagggtggcttcttctccaatctgactggtgttctgagaagagaaaatttgcacacatagaaatgagacactagagatgagcatgcggaggaaaaaccatgtgatgacacagcaaggaggtagccacctgcaagccgaggagagaggcctcagggaaaaccaaacccaccaacacctttatcttgactccccagcttcagaactgtgagaaaataagtgtctgctctttaggccagcaggtctttggtatctcattaaggtagcactagcaaatgaaaacaaaagggaccccaaagaccttgggtgccagagaaggaggagatggaggatggtgcaggaggcggggcagggaggggctggaagttcaggctctgaggtgcatctcttgggtgcaatcctgactccactcactgctgtctggggacttggggaagaatcattaacctcccaatattaattccataataaagattgggtcttgagcatagggctgctcatcctcctattccatatgatgcaaatcttcttgaggtcatgcttgtaaaacactcagcaatgtatctggcatacactatggcctcagaagtggttattctgaattttctagtgatacatagagaatggcattgttcctgtgggcagaggaggcactgtggaccttggtttgaggactcagaaagacaccaagtcctctggtagtgctcaagtgcgaagagcgtcacagatgcttcctcccaggccccttctattgggtaaaatttactctccactcctgacacccatctggtccttcttctgaccttagcacattatcagtttgaagacttaaggctcagggctcagatgggagctaggacaggcacactggggaatgcggagtagatttgcattcactgctcatcagggagcccacccaacaaggatacaagaataaaagaagtagatttgcatgaagagcctctccttcctatgataagagagggctgaaggtccctccccgctgtgggctcagagacagagctctggagcatctccaccgtggcctggacccctcccctgctcaccctcttcactctctgaactgcctcccagggctcagcccccaaaggaccagagatcagcctggacctgagcttcagctcagcacagggagtgatggagagtgtggggtctgggaatgaccctcatcctcataattacctcttctgtcctctcttataggctttgtggcttcccgtaagctgactccagagccagcagtgtctgtggacagtcagcaagggtaacctgccagggagaaaacctaagaagccatggtacaaactggtaccagcagaaccctgccagatgcctgtgcaggtcatacatggtaacaacaaccagccctcagggatcccagaccgattctctggctccaagtcaggaacacagccaccctgaccatcactggggctcaggttgaacatgaagctgactattaccgtcactcatgggacaacagtggtactcatctcacagtgacacagacagattggaaagtgagatctaaagaccttcactgtctgtatcaccctctttctccagccatagcaggactgagcagggctggcccgggtcacctggatcgaagcccttcaggctgcccttccctccagccctcccggcagactgcagagagtaggtcaggataggatttggggctggcagaaccaggctgtcctgctgttatttggaatggatgtaccttggctcaagatgacctgagtggaaggacagtaagagggagacagctactgagtgctcatggtcactgaatttcctcctgtgtgttgactgaacccaagacagtgcctctactctgtggcccaaataccctggattatttctctgaactgcccatgtttaactgagaccctcaagccccagctttgtgcatcctgatgttctgaacatggaagcctttcataatgtgcactgtgacatccttcagattcccatttcaggacttatgcacccaccatccacccagggctgcagggagttcctggcttctcacagctcttccccaccagaaactgccatgcagtacagagaatagctttgctcaaagaattgcccatttcaaaatgtgtttcatgggcagtgactccctgattgccttaatctgaaagtcatgctttaatttaagaccctgaatatcaaattgaagtgccttctagctgaacgctcaattgtaaaacattcccagtcacacactccacacttctttcctgagaatgtatcctgaaaccctactgcatggaatcctccctctcagagtaggattgcagggaactcaaaaattaaaaacaaacaaacaaaaaacagtctagagggaaaagtattgaagaggagagagagagtgcacaaggagacaactctgaagtctgcaaatattcatgcactgaagagcgcttgtgtgtacagaaactccctctgaaagagaaagacccttgagggaacactccaaagagcgcgcgcgcacgcgcgcgcacacacacacacacacacacacacacacattccagtcacagaggaaaggcctgagttatggggcatgaggtggactcatcagaagagcttcggctcagtattgaggaaaatgtcgccctagacatagggctactctgctctcaactaagaaagtgtagaagcaaactgagaaaagttaagacagtttccaagtaactttactgaatccaaaaataaaagacgaaaatagagaagaaaatgcaaaagaattataaactcaacaaagaaaacttcacaatgattggcattcaatcaacatttcctgcaaggaaaaaagaaaatatatgctctaacacagagaaaaatgaatcaatccaaagtggcaataaaattgtatacgtgatagatagaccttgtatgcaaaaattttggagcaattcttataactcttctccttgctcatgaggatagaggattgattgaaggtgttaagtgaagaaatggaaggcatgaagaaaaatccaagtttaacttttagaaatggtctctaaatatctgcattgaaaaaatgcactgaatgagaatgattgcaggttaggtgctgtgaaagaatagttgagtgaacttgaagacatggcaatggaagctattcaagatgaagtacaaaaaaagtgaagagagcaccagtgaatttcaggacatcttcaagctgacttacttggtataattaaaggcatgaaaggagataacattggtgaggggagaggaaaggtagaaaagccgtttaaaggaatcatggccaaaatttcccaaatttgttgaaagctagaaacctacaactccaaaaatcttaacaagttacacacacacacacacacgcaagtaatacaacaccaatactcatcataatgatattgctaaaaaactatgataaagacatacttttaaaagtagccatagagtaaagacatggtaggtacaggcgaacaacataagaagaagaacagatttcgttttctttgtaaaattttcttcaacatctgggggaacatagtagatatatgtatttgtggaatacatgagatattttgatacaggcatgcaatgtgaaacagtaacatcatggagaattgggtatccatcccctcaagcatttatcctttgtgttacaaactactcaattacagtattttaggtattttaaattgtacaattaagttgttatcgatgtgctatcaaatagtattgacataactctgatgcgctatcaaatagtaggtcttattcattctttctattttatttacccattaagcatccacaaataagagcagatttcttcttagaagtcatgcgagcaggaagctcgcatgtggagctatatttataaaatattaaaagaaaaaacttactacccaaacccatctccagaccatgaatttctctctggatatcttattaaaatattgtctcctatcaaatctctatcaaaataccaatgacattcacagaagcagaaaaaaaattctgtaactggtatggaaccacaaaagcccctgaatagccaagcaataccaaacaaaaaaccccaagatgaatatatcacattatctgaatcaaaatatactacaaattatggtaaccaaaacaggatcaatggtattggcataaaatcagacattgagactaataaaattgtatagaacacaccaaaataaattcatgtatttacatccaactgattttcagcataaattccaagaacatacattgagaaaaggacgcacttttcaataaatggtgctgagaaagtggatacccgtatacagaagaatggaactagacccttgtctctctccgtatacaacaatcaactcaaaatctattaaaaaccccaagtataagacccaaaactataaaacaactaggagggaacgtagaggacatagggaaagttcttcaggacattggtctagacaaaaattccatagctaagacttcaaaaacacaggcaacaacaaaaactagacatatgggacttcattaaactaaaaatcttctgaaaagcaaaggaaacaatcaacagagtgaagacaacttgtagaatgagagaaaatatttgcaaacaattcaactcaaaaggacctaagatccagtataagaaaataagacaaggagctgaaataactcatcagaatagaaaaccagtaatagcattaaaaagtgtacaaatgatatgaatagacttttcacagtcaaagacatacaaaaggccaataggttaattaaaaaatgcccaatatccctaatcaccggggcatgcaaatcaaaacctccatgagatatcatctcatcccagctaggacagctatcattaagaagacaaaaaaataacaaatgctggtgacgatgtagcaaaaatagaagacaaaaccacatggtcatctcagcagtcacatcaaatgttttcatgtaaggaaacattaccatttgctgtttttctagtcttgctagagcaccataaaagataagactagtggtgccaatactgtagaaaatgttattacatgcagagaatctcactatcccataccaaactacatggattcttactgttaaatgctaaaagattacaactctgcatttccaaatgttctggtggtcagagaccacttccttgacaagtgatgagtacggtgatgtgaaaggatagttagcatttacgcaggtattgggtgaagaatagtgatatacacaggaaagctttcaaagagagaaacacatggaggttggaacacagaagagaacataatatgtctgagaaataaagaaagtccagactcactggagctgagtgagaacaagaaaaacggcatgaaccatgtatttcactctggatatctcattaaaatattgtctcctccccaacacaccaccgatgtgaattgtaaaaatgcccgttcttaaattattttttgcacatcatgacagggtcaagcatgtgaatcaagctgagtttgatgagtccaggtctgtctgatgagtccagacccaggtggcctcagaaggacttggtggaacgagggcttgttgtcaaaagtagaggaagtgagattttccattgtggcttagacaagagattcttaaatttcagtggacacacaaggcccctgaggggtctcggtaagatgtagatgcagcctcagcagttctggatgtggccccaaattctctgtgtccagcaactcccaggtgaggctgctgctgctggtcctcccaggaccacactttgaatggcttagctcttattcacccacctcactcaagccacaggtaagactcacacaaggagagcatattctagaagcacaggtcacttctcactcctccccttgtgtcttagatccttttctgttacaacaaagaagtacccaaggctgggtaatttatagagaaaataaaaggtttatttggctcacaattccaatggccacagagttcaagatatggcatctgctcttgttgaagacctcaggctgcttctagtcatggtgaaaggtgaaggggagccagtgtaggcagaggtcaatgggggagaggaagcaagagagaagaggaagatgccaggctcttttaaataaccagctctttcggaaacagtgggaattcactcaccccaagtgaggacattaatctattcatgagagatccactcccatcaccctaaaagctcccattagttcccacctccaacactggggatccaatttcaacatgagatttggaggcgacaaagatcaaagccatagcaccctgaggtttggccacgcacttgctcatctccacatttgtccctcccctcatgactggggtcctgaccactctgactcagtctccctccacttcatggacacctggcagtcggtcatcatctgttttgctgaatcaacagcagtattgggggtattcaacattccacatttgtattgtttgaaaattgcccaatcttaggtgttttgttattgctacacaaacagactaagacatttactatttaatggttacatttcattctctttttatgaaattttgttgctaacagggactttctgcttggtcagaagattaacaattgtgtctcctggttccaccagaaacagagtagagacccacacagctgaggtatggggtcatagattaaaactaagagacataagattgattctcaggctccaagtctggcaagtgagcttctttgagactccctgggatctcagcagtcagactgatcattattgctgtcccaaacatcctatgtgatatggaagtaatatcaaaaccctcctgagattcctgacttgtgtcccgacatgaagtctgttgggattcctgtcattccttcaagattgttcaaataagcagcaacaatcactctcatatgagatatgaaaagaagaattccacatgaaccaaaccctgaagcccacactgaagtctgccaagttatctgcagtccagcgcgatggagggagcattttcgtggggacttttgagagtatggagaaggcctgaggaaacgaggctcagctatgggttccagaaacaaagctctgggatgtctccccatggcctcgacctctcacgtgctacctctcctcactctttgcacagatgctgccccaggctaagcccccacaggaccctaatcctagtcctgaccctgagctcagcccaggtgatatttcaggagatgggaccctgagaatgagccctaaagtctccttatcctgcagcccctgtggtctcttagactcagctacccccagtagagttggccatgagacacctgtcccccacctgctcaggagagagtgcagcaggcaacagtgcagagagaaccagcaggagccaggccaggcgctgcattcagagcagcccccaatccaacagattctccagctctagcctggggtacagcccccaccttctgcgggctgaagtgggcttctcaggatgggcaggccatgatggggattggcagtgtgtccatgggacacagccctactgcctgcctggccctcatgccccctccctccccatcctggttaagcaccaccccaacgggcccagtttcagaactcaggacacctgggccagctcctggacttgcccccactgctctctgttctcctgagccacttagtctcttttggcctcagtgttacctgctgtgaagtgaggagccttatactgaactgaggaagctctttcttcattcaaaattaaaagacagaaaaacaacgaaagtcatgcgaattaaagcctgatgaggggatgtcacttaatgggcttcaatgggcttcagacaaaacttcttgtctttcctctgcagggattccaagaaagggactcaaaaagagcttgctttctgtatggtgggaagagcagtccccagctgagaataagcaggagagtcccagtttaatcaggaagacagactagggtagtgtagaaatcctctcagcacaaactctgagaagtatggaatgaaataaagacaaacaagaaattaatggtgccgacggtggtgatgttagctcacagctaagctgcagaaccagaaacatgcggtgatgggctgagtctcctccaccagctgggggcagcagagctgcagccaggagctttcaggagagaggctggggctgcccagctggggcaaagagaaggccagcctggggttcaacaggtgtccaagaatctgtcttcagactgaaagtgagtgcagttcatcctatcccctcaggcttcagtgaccacgctctgagggtcagacacacggtgtcaccccaggacactgacagaagcctggcacagtgaaggcctcaccagggaaatgcagctggaggaggctgggcccagatgtgagcttgggcagcttcctcaggaaggggaatccctgggaggcgtcccaaggtcgaggtgctctaggagggggtatagtgtgaggtgatggggctcccagggcccgggttcttcacccaggatggcggcctgagcctcctgccactctcagggtgtcatccctcctggtccagcagtgtcctggggagctgagccctctgtcctgggcacttccagatacacccgacccctcctccctctgcctttccttccagctccaggcggactctgactcagggggcagctcctgtactcaggggagtctcgggtgggtgtggtggggcatttgggaccctggccctggatgggcatccccagcctccttcaggagacactcttcagagggacagggcttctcacctgcctcaggccacagctctgaccatggtgctgtccacgctcagtgacaggacactgagcaggggcctggctggagtaaccagggaccacccaatctctggagctcacatgctgtgcagagaccatgaccctgggacccttacagagaccatggacctaacgttagattctcagtccagtgtggttttctgctgctttttgcaagtttacataaaatattgatgagaaaaacatgaataaataacagacaagttgacggtgctgattgctaatctcttgtggcaatgaggggtgatgtagcaggagcagcaccacgactgaaatgagaccagatgccatgttgactccacaggggtgtgtggttgcttaaatgacccaaatattcccactgaataatcagcaagtgtcctaatgacacagcacagcatttagatgaaatgaacaagaggggactgagtctgagggaccaggaggaggaagatcatgggtccctgggccacctgctgctgagtcaggtgtcatcatgatctctccacagagcccagctcagccccatggccaacctcctggaaggtccacagctctgctgagcctggcccaggacagaccccaggtcagcgaggtttgggacagtggtcatgaggttaattcccacaaaggtctatgatcacagggcttgaaggctgcagctgattttctaaccagagaccctgcttgttcctcctgttgcctgtgctgccctcacagctggtttgagagacatctctccaggaagagccacagaggatgtaaatttgcataaacgcttaacactgactgcccccgaaagcctgagagggaataagagaggcctgcggagcccaactgttctgtgggtccaggaggcacagctctgggaatctcaccatggcctggatccctctcctgctccccctcctcactctctgcacaggtgctgaccccaggcccttccccaggctcagtccccacagattccaagttgagcctgacctgaatcctgagcaaagcccagacacagcctctgggtgggactcctggaaatgggtcctttgtcttcaagccccctctcttgttcttccttgcaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtggtacttatcccacagtgacacaaggagacagggaagtgaaacataaacccctccccctctatttcatccccttccttctgccccaggaggactgtggacaaagccatgagcaggcttggccaaattcacccaaatttgaacccccaggctgcccttccctccagccctccaggcaggcgctgcaaaggagtcagtctgcagtggatttgtgcctggcaggcctggcagtcctgtgtttctttgcctggggtttgagttgttgatggagggtctgactggaaagacagacacagggagacatccatgcaggcatgtccagagggatgtggggaactctcaggtctcagttcagtgcagtcattgttgtatcctctgggaaagcattcctccagtgcacctaagacctctagacccacagagcctgaggtcgggatgagagaatgtcaaatttttgctgatggatcactaaaggcatttttgagtggagccactacaatttactccttgattctggactcgtggatcctgactgtgggagaaacagcaccatctattgggcactgatgcacagcacatgccccatcctggaagacattgcccaaccctacacatacttgccacttgcctggtgcagtaatggagtctccatgcagtcattaaaccattcatataagccacatgtctcagaatgttggggacaagagtaagaatcttgaatgccaggagaaaaggcccatagccctttatttgcggtgaaacgagttccttggtcagaacctcctgtggaataccatcgtgatgggtgcatcattctgtaatccagagataacagttttggcagaagcattgctgtcaatgaaagcaaatcctctgtacatgccaatgctagtaaggaaaaagagctgtctctcccatgatggaagagctctaatgaaattaatatcaagcaggcccctggctgttttccacagagaaggtcatcctatagggatgcctgtgttggtctctgctgttgacagattgtcacccagcagtggcttcagccaggccagctccagttagtggaaattcacattgatgagcccattatcagcctctatccctgccaccatggccacatttttttggagtctgttggacaatgacaggagtggttgacggaggctgcctggtgtccatagaacaggtcaccctactcacctgattagcaaaatcacttcattttcacagaagacttagtgagtatttatatatggaaaaaaattctcatgctttttgcccactggaggaggtctactcacacatctctccccctgacatatttgtgatcagtattcctgttgtatctctcccaagttcctgaacatccttgaccatattccaggaccctgagtcacagcccatgaattaggaacctctgcccatctctttgcaggtgacatgagccaattacactgcttaaaattctgctttaaggagaatgttcttccaccactgctgttcagggattctcagaggccaggtggagtactagcaccgttcacaccagtggtggatgcatgtcctgcagaaacatctgtaaccccagcctaattgcctcctactaggcagctgatctcagggagccactctggaggccaaggctgtagggtgagaggaaggcatggtgcagggcttgggtcatgtctgtttggccaactcttcacgcaacttacttggccctcgtaacctaatccctcaagtcacaaatacatccctgccgtgtgattggggagctgcctaaaatggccacccgggactgtgtttcagacgaaatccagcatatcagcaacttgagtctcgtggtgagctctgtggccacaatcacacagagcctctgccaaggctcaggagccctcgcagtctttctcaaatggtgttttctgctcattcaaaacaaaataagtaggggggggggctgctcacgtgcttccagtctgggacactaggaccacctaaaccacacccacgatcttgtctgattattttgattccttgttggctcagttatgcattatggcaaccaaaccacagtgtcattggccataaaatgccaatccttggtccccacctaccctgggatcccctcaaccacatcttgctacccagttaaggtttcagcaacactgagaaaaatgtatttttatattgagagaggaaacattctttcaattgtgaaaaatttataaggcaggaatgtgaaaatattttaaaagacattttacaaagggtgaaagaccctccattaaaccactcaatatatgacactgtaattggcctcccaaaccctgacttcagctctgggttgggaccttctgtaaaggggcctttcatcctcaagccctcctctcctctcctctcctctcctctcctctcctctcctctcctctcctctcctctgctctcctctcctctcagcctgtgcctcctacatacagagacagctgctctcagtcttggtggccctgagactgacaaccatgatcacatgctctggagataaactcaggataaacatacacttaggaaccagcagatgccaggccaggcctcggtgcttgtaatctggtataacagcaagtgaccctcagggacctctgcccaattcttaggctccaaatcaaggaacatggccaccatgaccattagtggggcccaggcccgcgacaaggctgactattactatactgcagataataacagtgggagcagctggcagggactcatagtaacacagagagatagggactagccacagtactgtcccacctcggcctgcctctcattctcacctgccctctgagcagctataggtcaggcctcagggtcaggtgtcctctctggtcttaacctggcccctgaggggctggaggttctgagcagcttctccatcctctcagggcctgcatgtgtccaatgagaagtggacagggtgaaggtggtcagagctgccaggacctttgtcaggtttgtggtgtacatgaacagtttaggaatccacacaaaagcacatggtcccagttgtaatcatacgtcatgcaggggaggagagagctgtcgcagagggcacagtcctgcagaatttctcctttccttgggtaaaaccagctcagtggaagccccaggggctgtgtctcctctggtttccagatgagttgacccccacattctaataggttgcctgatgcctgacaaggactggagacccagccccttttggcctcagggccctttctgtactgatatttctcagaaactgaagaggaagcacagacactacctttggtcccacctgggaactgtgtttggggcacactgacctcccatggcccccaaagtcccatcaccttccccaggtaggtcagtcctgactggatgtgcccccagcgccctgatagtttggagtttatctttgggctctgggctgctttctgaggagctcactaagaaacccttgatgccaggcccaggacctgcgcctctgctgcatgtcccagggctgcaggtgtgaagggagggtcctgctgggtgagggtgatgcccttttccaggagagatgtctgattccagtctctagggccacatttattgggctttcttttctcactaggatgtctcagtctttttatttccttctttaaaagtacaactggtttagggtgacctgctcgggtccccttccacattgtagaagctttgttatttcactcttcacaaaaaatctcgctgctgctcactctttgggtccatgccaccttaaaaaaaaagtacaactggtttaatcatgaaatcatgtgtacacactgaagtttacagattattgccatcagcatatatatatatatatatatatatatatatatatatatactgtttctggttgggacaactgtggacaaggccatactggggtctctgtctctctcgttatcacaagtgaggatactaacagctctcttttatgcagactgtggtcatgtttcccagttgcacacgaatgtctcttatggttgtttagtttccttaccagccaagacccttaagttttcatgcagacaattggatgttatttctctctgacccaacatttttcaaacagtattccttggaacccaacaaaagttccacaagaaaagctcaagtctctggtgcacagttggaccaggttcattgtgtgcagtaggaccttgctcaagtgatgggtccatttgatattttcactatcaaggggaagggtgttacgacttttgggcactgagttgatagagggaagatagcagctgatgatggccctacccaccaatgtgtgtgtgggcagtacctattgatggatttagaagttgagggaactgtttattctgcagatggaatttccagtactgaatctccagcacccagccactagcattcagcaggtgctctgtaagaagaccttcactgccaatcacagccattacacaggtgaaggagaggatgacttttaacagccactgactcacagtaaactgaggtagaaattcagcttcacaaagtgactttgagggaacagactgaggaagcaggttaattattcgctgaaggctttgcccagagcaggaacaatacagggttgatgaggacgtagggatgccctggtgtggaaggaacaaggcctgaaccaggagcaggaagaagcatgggaaagaccacgctgccacatgtgatgagtcagcacatggaaggcacagcaaatgttgcgcaaaggtttttgtgtaataacctggcaaacagctgcttctctatccagattcatgagccaaaaaatgttactgatgcattgctgtcacatgttaaaatgctgggaagcatggtgacattcaaggaaacctgttctctgcaaacacctacccaccggcacaggagacaccccagctatgccaagggctttgtcttcctctggagtaagagcctgggaacaatcaggtggcccctgaaaggggtgccgcgtcttctgctctgcatggctgagttaattggggaactcccagagaacattccagaaaacagtcaacctgtctgtgctgggtgcattgagcatgacccaggatcaatggaagagacagaagcttaatttccttatggctgcaaggtgagcactgggaggacggctgaggcaggttagccaccgcccctgagtggcttcagccccaggcaaacagggacaggtgaagggcctatctgagcgcacctgtatctaaccagtcccagcatcagcaactgcatcctgtggaccacgagggggtgtgtgtgcccagcccctcacagatcacctgagcataaacaggaaattctccaccttacacccgactgcacaacacatctgcctccagctcttcatttacaaggtgatatcacatcagacagggactgatctgggtcccagatccctcaggtttccgctatcctttccagtccccacacagagcagactcttcactgcagggtgttgagccagctcttcccctcacaatgcctgttacaggtttacaagttactgttctccaatatgattggggtttgtttcactgtttctctatatatatatatttgcattttcttgggtaagctgagccccttgtacctggtcttgagtcaggcaggggccacacagagaagaggacttcctcccctggcaccagccgtccacagatcagggcatcaaggacctgagcagcaggttctgaatccacacctagaccccggaagtccctgagctcccagccgacagtgtggagcagccaccagggggaagcagagaatcaactggcaaagcgacctggggatggggcaggcctgggtgatagggagatgctgacatgcagtaagagccagtgaccaccacctcagatttagagggaaagggtctttattgtcctagagtattgtccttgacactgatgtaaaaattctagaatcacattttgtcttcagctcttttgcatgctgactctttgtctgacacagatccaggcacttgacttctcacaacgccccctcctccacacccagttgtgctaaaactgcatccccctcatgtgcagtgtcctctctgaggtcacaggtatccccctactcccatttgatctgggaacccctgtcctgcagacatagtggctggcttctaacttcctagctgcccctccacatccaccgtccctggtctttcccgactctctcctggggaagctgccaaatcacagctcttgatttcctggtgagtcacaaaatagttgctcattaacctttagttgacttaagttcttatccattgatacattttccccagcaactggagacatcatatttataataaacattcacttctggggatcttggagtttgcagccccctctcattctctcatggagcaaacatttccttcacctcctcatctgtccctggtcctgacagcatcctggagatactgaggcacagcagcaatgacctacctagaagctcacagccaaggcagaaacttccagcatctcatggatcttccaacactctgtgcgcacttggcaaataaggaatttcattgacctctatcactcagaggttgtgggctgtggtgggacccgcacctgtccaaggtgtgcattatcacctgtacagtggagacgaagagggaacttgcattgggttctggaaagtactgtctaaaaatagatttagacctacaccagaaatgtcctctctaacataaaatatttatgataggacacattagaggcctagaccaaaatgaaatacctccctccagagccaagatagaatggaggaggggactggggaccccagataattccacagttaccagcatgactctatggtcacctcccagaccaggtcaaaacccatcccataggagggacttcatattcctttgtaaatacagacaaagtcacctctgagctctgctgtgaccaagggagcccaggagtgaggctgagcacagtgtgatgtggggatgtgtgcagagaatatggaatcaattcataaaggagatcctgtgggcaaagggtgggagggcaaggtcacccctaacctctttgggtcccttggggctgtgcccttctcgaaatcacaaggctcctccagcagcagcccctgactctgctgattggcatcatggacccttctctccaacaaggggttgagagacctgggaggagcctgcccagcctcagacttgagaagcagcattggaggcacttcagccatggcctggcccctcttttccttggtctcctgactcactgcacaggtgctgcccccagggtctcacccacctgcccagccccaggcctccaggttcagcctggccgtcagtctgagctcagcagggccctgtgtgtggtgggcaggatgctcgtgaccctgctgcagggggaggggctggttggggtgaaatgcccccactctgtgctcctgtgctcataggtgccctgagagctcttttattcctggggctcactccagccctggcaagtagccagatatccttgggttgagaccctcagtttcaagttttttctgtccccttttctttccttgtaggctctgtcacctatgagctgacacagtcaccctcagcgtcagtggccccaggacagatgaccaggatcacctgtggggaaagcagtattggaagtaaaagtgctcaatggtaccagcagaagccagccaggcccgtgtgtgggtcatctatggggatagcgggcggccttcagggatctctgagagattctctggctccaacttggggaacgtggccaccctgaccatcaacaggacccagggtggggacaaggctattactgtaagatgtgggacattagcactcctcatcccacagtgacacagggagatgaaggagcaaaacacaaaaacctcttccattggtgtcactcttgtcctccagcccaggaagacagtggacaaagccatgagtgtgtgttgcccagttaacctggatgtgagacccccaggctgccctttccacaggccctccaggcaggctctgcagagggggcatcaagagtgaatttagggctgagatgaccaggatatattgaggtgtggaggaatcagttgtgatttggggaagtggggcctggttggaagatcagaccaaggtcgacatgcttagttgggctctggatttccatagggggtgaaggctagtccttgggctgaatatcctgagtcagtttccagaactgcccagctcacgttcccgtggcatcctgccattctcttcaggaaaaccagtggagtggacactgtgggatccacccatattccctcttctgagctcacccacccagcactgctggtagctctggcagctcagagctgtgccctcactgagaagggctgtcagcagagaaaactgtctcctccaggtttatgccccttcttagcaaggtgtggtttcataactgcctgaggtgaagctctcaagactccctttcaatatgggagaaacagaaaatcctcccagcttcacagctccttattgggatggtagaagactcaatgtgggtcagagtgtccttgtgcccggtgttgcctccctcacttagtttcacacctactgtgaaagcaaagctccatctcagagtctgcttccaggcatcccaaaataacataaccagtcatcccgaacgtgagccatcaggaacctcaggaggccacagtataccagaaagcaccagtttattcctaatgatcattgtgagtttgcaaatgcccaatgagatctgagtgtttcttgcatttgtatggaatgaaaagggccctggcatgccaggcactgtggggtctgagggagagttggagtcagatctccctgcagggaaacctggggcaggaggagcagcctcatcccatgcagggaccacagatgcacctgcagggtgagctgcaggatggacactgcccacctccaccctccacattctgtgcaaaaaatcattctttccacccctccttcagcctatcaaagttgacacttaaaaagccaccacagcccacccttgtcaacaggaaacccattcacatctccatcagccacacaatctccacataaagattcttcaaaaaataataacacttgccatgcaaagtatatatataagatgtctcaaataattgtacttagattgcatatgaaagtgatactattttgatatgctaggtaaataaagtaaattatttaactcatttacttcttccctttgtatttttaatgcgatgactagacattcagatttccatgaggctcacatcatattgtgaatgaacagtgctggtctgcaccccttcaggttacagtggctgaggagtgacctggtgcaggaagccccatctccatccataggacattggtgtgaacccagggagaggcgctggtgtaagagagatgagaacacaggtgtgaaccacctgcttgtgcaggggactgagccttcactttgagccaaacaagcttcttttcctatcttcaatcctgagcaagaggactttccggacttctttttgttttcaggtttgtgcccctccaggcctgaggctgtctggatcccagccaggggacacagaggaaatccagaagtctcacaccgaccctgttgtatttcatctgctggggccatcccaaactgctgcgtaccatttcctttcctggtgctcaaatagctgctctatgcacttgtcatggtttcagagatgactctaggtgggaagacaggataatgtatgttattatatttaaaaggaacttaaattcattaatatttattttaatatgaatcattaaaaaaatttgtcataggcaatggggaaggaggaaaagatattaaaattattttgaggaaaaaaccaaaattgtatttctcgaatgtctgagtgtcttcagtgtctcagggttgacagcggtcagctttaggttgtcctgaggatgtactccattgggggaaagcaagaaagcatgaaacacacatctctgtgacctgacacataaatcacagtaaaatggaagtaaatcttttaataaatcaaacactcacaataaatatcactctggtgaacacagaaatgcctgttaacaaactttccctttcccctgctggctcatatccccatggatcacctgtgtgcagagtggactctgtggtccccatttctcaggctgagaaccagaggctgggaaggacaagtcacctgcttgtgagtggcaggggaaggattgggagcagtggactcggtctcaggactgcggccctcaggaccaatgccacctagcagaggtttccacggggcgggctgccccatttcctgacagtagggacaacctggaggtgggtgccaagcagagggcactgcagggtgtgcccaggcctggagggtcacagagacacaggcaccacacagcagagacactgagggccagaagatcactcaggtaagggacttcagcagatctttctcctgagcaaatcaggtacaaaaaaattaagatcctgccatcagaatagataaacaaggactttaatctcagctgagctccactatccaaggaagcagaagcctctgagcccaggcccaggtgagggtggggtgaagggaggagctcaaggtggagatttgcatgcaggccccaccctcctctttggcagaggagataagacagggctgggggcaggcccagtgctggggtctcaggaggcagcgctctcaggacatctccaccatggcctgggctctgctgctcctcaccctcctcactcagggcacaggtgacgcctccagggaaggggcttcagggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctccacagtggtccaagttcctggggaactgagaccaaaacctgccctgggctctcaggccccctccttgctctgaagatgcttcctcacccagtgcaagcggcttcctgcagtgcggccttgagaattcttctctctcagctccttccctttccaccatgaattccaaaaggaaacccgctctgtggtttctcatccaggacagggacagcttcctgatgcttgtgtgccgtggtccctgaatgtgcaactcttgttagctcttcaaatgcagggacagtgacaaggagcttcctgattgatgcagtcactgcttttttcagggatgtcttcaccctacatgcatcaccatctcccacactgtgggtagaattttagcaactacattctgatggttatcgccacaactttgatcttaaataacaatgcagcgaacatccctgtgcagcctcctttgagttcctgtgtgaatatgaccacaggattcatttctaaaagtgaaattgagggtcagaaagatgtgtgtgtgtaattttcacccgttgttgtcagattcccctccagagggattctaccaattttcaatgccagccggaagtacttgttcagagtacattgttgaaagtggaagtttttgccaacctgtcagactcaaaaatgatacctgttatggttttatttttgagtctcctgttctgcttaagtttgggccttttcagaaatagttcagtactttttcttttttaggatttgggaaactttttcttaaatatccagataagaagaattttaatcttcgtggccggacaccgtggctcacgcctgtaatcccaagtgtgttggaagggtaggatgggtcaattgcttgctcccaggagttgagattagtccgggccacacagtgaactctcatctctattaaattaaagaacataaaaataaattttaaaaggaagtattttagtctttgtggctcaagaatcaactttggggatattccataggtatgtatagcatcatttacaatgtaaccatttaaaatgataaaagccactgtcagctctaggccatacaaaaacaggtgtcaggccagggatggccacaggatgtggttgaacagtccctggtttgtagggttatctgagggttgaaaattccaccagaatatgatctaggtgggaatctctctgtgagggtcactgtatttcacctcctgtattagcctgaggtctttcattggataagaacatgctcacatcatctatttgattgtatcatgggtttaagacaaccccgtgtcacaatcacataacatttatctgcattgcttgctccgagttttgggagagctttaatttatcaggaatagactcctcctaaggcaaaagtctgagagagagggatgggcatgtgggcaagatagtttgtaccaaagctggaatatccagggcaggctcagagagaaggttactaatatcagcatttgactgcagccaaaaacagaagagaacatggaggttctgagaatgacaaataaacaaatagtttaagttttaaatgtattgaatgtttttataatccatgaaaattctagaacagaatttaacaatgggataaggaagagagcttgagatgttaaaactataaagaccccaagccaagctgccaggaaaagaacaggatctttttggtggaaatatgtttctgctgcaaattattattttatgtgtgtgtgtgtgtgtgtgtgtgtgtgtgtgtgtgtgtgtgtgtgtgtgtaaggaaacctcccatggaacatccttcttccctacagtcaagatcaccctcaccctacaagggaacctaaacaaaatgtcaatatcaaatagaaaaaaataatgcactttgtataaccattagagagtctctatttgcacatcaaaatgtggatgcttaacgttaacattggaaatagtattttaatatgcatatgagatgaattttctttagactatttttgtgaattatctttcttaataaggacatactcttctcttagaacaatttaacttgtgatattttttctattttctgtatcagttctgttttttctaaacactggcaaagatatcctatggctactgattaataaattagattaatgtgtatttaacttaggtaagttagttcaagagtggacagatgtgatttccccacatatcctatggctactgattaataaattcaattaatgggtatttaacttaggtaagttagttcaagagtggacagatgtgatttccccacatatcctatggctactgattaataaattcaattaatgggtatttaacttaggtaagttagttcaagagtggacagatgtgatttctccacatatacctcacagatgttgctggtgcttactcactcttctcttctaatcttagcaaataaagtgggaaatttgacattcctaaacacccagatgacaacaggagagaggaggtgaagccccaaagctgttattctttaaatcctcaggatgaatcaccctggagaatcacccacacttcagttggatgatacgcaaatgagagtttggtcttagagtggtgctgagttagttcaggatttgggtcactgggatggggtgaatgtgttttacaagtgaaaaatacatgagttttggggtctgcagggtagagagttcttggctgaattgtgtcccccagatctgggttgagtgacatcccaccaagaggagtccaggagaagtaaatttgtgtaaacaccaaacatgcactgccccactaggcctgagaggaaataagcgaggcctgggaagcccacctgtgctttgggttcaggaggcagagctctgggtgtcttaccatggcctggaccccctctctgcctctccttcctcaccctctacaaaggtgatgcccccaaccctgccttaggctcagcccttacaggatcctgagctggtcctgccctgaaccctgagctcagcctaggcatagcctcagggtgacaccactggaaatgtgtttgttatcttcaagccccctctcctttcctctcctgcaggctctgtggcctcctatgagctgacacagccacccgcggtgtcagtgtccccaggacagacagccaggatcagctgctctggagatgtactgagggataattatgctgactggtacccgcaaaagccaggccaggcccctgtgctggtgatatataaagatggtgagcggccctctggaatccctgagcgattctctgggtccacctcagggaacacaaccgccctgaccattagcagggtcctgaccaaaggcggggctgactattactgtttttctggtgattagaacaatctcacagtgacacaggcagatggggaagtgagacacaaatccatttttcatctgtctcatcttttcctccagcaccaggatgactgtgggccaagccatgagcaggtctggccaagttctactggatatgagacctccaggccatccttttgttcagccctacaggttggtgctgcagagggtagagcaggagtggatttagggctgctataatcagaattttcttgtgttttcaggcccctgaagtgacttggggaaataagaacgggatggaagatgagagagatgtagagaacaatcacttggccttagatttccatacgatggtgattgggtcactccttccaaatatcttacatcagtccccaaaaatgcccagctcagctcaacacctgagcttccaggcttccatggcagcctgggattttgaacaggaaaagcagaggaacaggaaaagcactgtggcatctgcctagatatgcttttctgagctcacccaccctcaactgctgggagcttctagaagcttagagctgtgccctcacaggaaagtgctattgtttccagaaaacttcctttctcatatttaggctcagttttgagagttttggtttgatgactgcctgagccaagaacccaaggccccgccttaatacaggatgacactgaaaggccttccagctccagacctcccattgtggatgcctgaggcctcagttgcaatcttatgatgggtcagggtctccttctggtgggtgatgcttctctcactcctttcagattctctgtgcatgaaaatgtttatctcaaagtctactttcagggaacccaaactaagacggccagctgtcaccaaaatgagccaccatagacctgaggtggccactataccctggaatgcatcagcgaatttcctaaatttccactgtgagcatccaaatgcccaacgatttctgagagatccttgtattcttataaaatgaaaagggatcctgaaatgccaggtgctctgagtcctgaaggagaggtggaggcagatcttcctgcaaggattccacggaaaagggagcagcctcactccatgcagggaccagagatgctcccacgggggcagctgtaggatggatgctgcccacctccatcctgcacatcctgcacaaacaatcactctttcacccctccttcagcttatcaaagttgacacttacgaagccagcacagctcatccttgtcagactccttcaaacctccatcaaccacacaatctcaacataaagaatctccccaaaataataatagtaacaaaataataataataataaaataatagtaacaaaatagtaatagtaatagtaatagattttcaggcacagaaatagtaatatagtagctatgaaaacttctataaaaatctcataaataattttagattgtgtgcatgtgtaaatattatttttcacactttgtgttaaataaagtatattattgaacctagtttacctttttattttttatgtctactatggtgactagacaataggattcacatgagactcacatcatgttgtgattgtacaatgctgatctggtcttaccccttcacatgacaggtgctttggagtaacctgcttcagcaagccccatctccacccataggacatatgtgtgaagccacggagaggcactggtggaagagaaataagaatatgggtgtggaccagctgtttatgcaggtgactgagtgctggagccctgaccctgctctaacctagatgtgtcacatccatctcaccagagaccactcctggcctgcctgagctcacaactggggggaaatcgcatttctggcaacatggtcacttgatgtccagtgttatcctgtctctcccagggcccagtaagacaaaagaagctgtttttagaaaggggagtaacactctactgcacatgacatggccttcttccaaaaacccaggagtctacattgggattctccaacggggtttgccatgtgcaggaggttttatttcccatggtggagtctgctggattctctggccccaacagcaggacactcacaaccctgcctgcacctgctgcagagccttcctgctctgggcctggaaaacaatgggtgacatttatggctcctgatacatggattggagtcacatccccagtagtaaaatatgctactcctagatcttataggccttgtgtctctttcttcctggggaaaattgaaggttataataacatcttttttttttttttttttttttaagatggagtctcgctctgtagcccaggctggagtgcagtggcccgatcttggctcactgcaagctccacctcccagattcacaccgttctcctgcctcagcctccctagtagctgggactacaggcacgcgccaccgcacccggctaatttttttgtatttttttattttagtagagatgagttttcaccgtgttagccaggatggtctcaatctcctgacctcgtgatctgcccgcttcggcctcccaaagtgctgggattacaggtgtgagccaccgcgctcggccataacgtgttgtttattttgtaggagactctcagctgctccagacaactaaagtcccaatttcagctaatatggaggaggaaacatctttgtttatttcccactctcaaaagtgcatggatctcacaaaagcttccaataggccgtgcccatcatgtacatgtgattgaactatgatatccagatggtctgagcccccatgatgatatcatgatagggaagggagagctaatgaagctgggcagaaaaagtgtgaatgtatactgttgtccattccacgtgaatgcacactgattctgatcctattctctgaggacaatagacaagacctcagtatctgcttcagtggtttaactgtgcacctgcagccatagcattctgttccaggagatccccatctggcacagatattgctaatgccactattgcccatctgggtctgtacaaatccaaattcatcttccaggatcattcaactattgtagagatcagtccagtaaactgaaagtgaggaccccagaagtaatcacacgtactgcaggagaggagagagctgtttcagaggccacaatcctgttgaaattcctctgctccttgggaagaaacagcccagaaaaggccccaggggctgcgtctcatctgggttcctggatgaggcacaccccctactgcactgagattccacagaagctgggggtgaagtgcaaacaccgtctttggttcatccttgggattttctttttatcacacactcgtcattttgtccacaatgtccaaagtttctaaagtgctgtctaatagatagaggttctttgtgcgctgaactaaaagctcttgggttggctaatggtgatgtttgcacatttttactgtacttactgccgcttaattacacacttaaaaatgattaaaaggatgaaacattttgttatgtttattttaccataataaaaatattgcatgctcaggaagcaaagtaatactagtttaattttgaaatcacacaactggtaaaaatggaaagaaaagcaccattttctctgttctatatgctacaactcaactttctctctctctctctttctctaattaacaatgatatcctgtctggtccaaggtcacacatttccagtgttgcaggaatgtctgttgaatctgctaatttgttgccaggaagaatactcaaacttctcatgctcatatttgattgtcaactgtctccagccaacatttctaaaccaggatcctttgacaagacttgtgaagaattttgtaaaaagtaccccccaagatgacagtgttcgctgttggcagcaggactgtttccacgcagtagggctatgctgggtgtgcagtggagctgtgcacactgtgctcacggggcagattctgtgctgctgactctgatccctgtgcttgggaggaccgtgtccactgctgagtctacatctgaatttgattctcaagaaaaaggtcattcatagctgctggacactgagtcacacagagagacagaaggtggctgaggacaccttatctctgatgagaataaggggattagatctgctggtggaacaggaagctgaagaaacttctggctctaaacatggaatttccagccctctgtctctgctgtccatgcccttctcatctgtatgttcctgggagatgtggaccacgggggtcagaggtgaaggggattgggaagctttcatgttctctctcaccatctcccttgtttatctaacacactcttacacacctactttattagagcttctgctctacaaacatggctgagctctaaattagagacttttgaaagtgcagacggatgcaggaactcgtccatctggagactttccaccacttgaagcagtgaacacatctctgcaaggctccaaatttcaagtgacaggattttgggatttcaaagaaaactaaatctttggtgaaccacgacagaagagggaaggttcacacatttccctgctgcttgggcctcagtgaggactgactcagccagtctcaggctcctggaaacctcctaggagatgtgcactaggaaagtcttttcagtacaacctggggcaggtaagtggcccttactctgatattctgctccctgataattttgctttcagagaagaacaaagacctgtgattctgggaagttcaaagcccccagacaaggtcttctcattctcccgtgacagcctgagctctgcattcccaaaaggaggagcatcttcccggcatgaagagccaggagtagagagggagcttctcccaggggtgagcagggcagaagccaccttggtcagtgggaaggaaacgtgctcagctcacatctgacccagaatgactcagtcacacccgtgcagggtcacctgcatgtgagcatcatctatttgctccatgagaaaataccttgtgtgactcttgggtaaaatcataccgtaggtgacatttctctggctattgcttcagccaatgtttttcaaaattcactgtaggacacttacataaggtaagcatgtcaggtgtgggatgtgttgaataggaaaagcacaggcttcctgtatcaatgttcatggcttgtattcatggccataactcgtggaaatggaaaaaaaaaaaaaacagaaaagaaaatgataccctgctcaaaaaagcactgagaaataccattgtagtaatatatcttcaacttataagttgagctaattgaacattaacttagatagatcatttttatggggggattcctaaacctaaaacattgtattaaaaattttgtcaggttaaaagatcattaaaaggccaatgtttgattaaaatctggagtcttttactttgggctgcaatcagccaatgagtgcatggagttggctgccctcccagaccctgactggctccacgtcgaggtagagcagcgctcccgacaggcagctggaggaactgacgaggggaagctgtttgcatcagggcctcaaaaatttggctcaggattttcccacgtcccctccccaagcccaagctggtcccaggacactcagaagagctcatcattatgggtctaaaacttctctgatctcgctcttctttcttccttccccagagaccttggaattgtcagtccctctcacaggcccttcctttccttgtcaagtgcactccctgaattatctgctcctgggtcagcaattctctagaacttcagggaaagcagtgctgggtcacccacatggggccccagaaagctggctaaggaccagacacacaggcagcaggctaggtccccacagggctgcatggttggcatcgggtagaggggagggaccaggaaccactcgctgagtgtccgtagggccaggtgaactagggaagggctggaacctggtcaaagaattgtgtactaagcaccactttctctgttctatatgctacaactcaactttctctctctctctcttctctaattaacaatgatatcctgtctggtccaaggtcacacatttccagtgttgcaggaatgtctgttgaatctgctaatttgttgctgggaagaatactcaaatttctcatgctcatatttgattgtcaactgtctccagccagcatttctaaaccaggatcctttgacaagacttgtgaagaattttgtaaaaagtagcccccaggatgtcagtgttcactgttggcagcaggactgtttccacgcagtagggctactgcaagccacacctgtccccacacagtagcatcttcctggaggtcaagagtgattttgtttgctatgctgccccagatcacctaatttattacctgtgaatttcacacactacacatcctgcctgtccccaaattcttcacttatgggcaaatgtcacatctgacctgaactggtttacatcccagatccccttcaggcttcccactgtcctttcagatcctcacacacccaagacccttctccgcagggcacagacacagctccctgcacacgcttccatcacttgtctcttcactccttcctcaaaggaactccacagactcttcttcagggaggccttctccaatcactgaagctacagcagccagccagtcagcttctgtcagaactttcaatgattagctgcatagagcttacaattacacatttgttttttctatcgttatcttttgactgatttatttctattaatcattgcattatcagtcagaaatgctttttcactacaagaacacatgtggcaggaaccagggagcttccaattttcttccacaaaaataagtctgcacgtgcttggtggttgttttccagatgctctccagttccataggaagctcaaatatttctacctctccattccctttcaatgagatgttgactttgttttcattgttgttgatgtaagacctcagcatggctgctgcagctccagctatcacacccaagttcaagagaaaaagcaaagcacaaacccaatctagtccttccttcataagaggaaaagtttcctgagaagaatctcagccatctgactcttacatcctatggaccaacgctgggctacatggtcactgctggctagaagaaactggaaatttgcctgactttcaagtgaatagaggggatgacacacaagtagaaggtggtagggagtatctgctgggtctgtaaacccaatctgcctactgcactgatccagcaacaggacaggaaactcctcagagcaaggactgtgtcttcctcatgctgaattcctaaaatgcattcttgccaggacagagtgggtcagggtgaatatttgttgggtgaatgagcttctgtctctgttgtattgcaggagtcaccaccagtgcacattggccctgtatttgtatccagaaccaatcaaagccacccctgagtcctgcatctctcagtaccaagctccagtcccccttcaagaccacccaccacacagacgtgcagggagcctcaggagggcactgtcacctccttctccacatgtgagtgtttgtatttccatcaggaatctgagcacctcgtgcccaggtttgaggcaggaaggggccacaaacagaagagaaatttcttctctgaagtcaacagtccatgaatcaaggaatcagggacctgagcagcagattctgaagctacacctgaacccaggaggcccctgagcctccagctgacagtgtagagtggccacctgggggcagcagagagtaacctggcaaaaatccctggaaagggggtggagctgggcatcagggagatgctgacatgcagggagggtcagtgaccatgacctgagacctggagggaaagaggttcctcttttcttagaatatttgtcattgacactgatgtttaaattcttctgacctcctgtctctcagatttgactcttggaaatggtgcttatttttctgatacagattcagacaatttgcctcttctcattgccctggcccccatctcactgtcacacatgccattccattctgtagtcacgcgtgtcccacctccctgcccttttctctggtagctcgtcctgcagacacaggggcttctccttccctggccactcctccacgtccactgtccccagtctttcccaacactgtcctggggaacctgccaaatcacagctcttgatttccttatgaggcacaaaatacttgctccttaatcttttgttgacttaagtttttatccattgatatattttcccagcaagtgaagacaacttagttataataaacattcacctccagggtcttggagtttgcagccccctctcattctctcacaaagccaacatttccttcacctcctgatgtgtccctggccctgacagcaccctggggatactgaggcacagcacctatgacctggcattagaactcacagccaagtagaaacttatcacatcccatggatcttccaaaactctgtgtgcacttggcaaccaagaattgcattctcctctagcactgaggggctgtgccctggggtggggcctgtactggtgcaaggcttgtgctgtcccctgtagagtgggaagtaaaaggtccctgcattgggttctggattgtgtcttcaaaatgaatttaggcctataccaaacatctcatgtctgacataaaatatttatgaccaggacatttctagagaagcagaagaaagttaaccacctccctcctgagccaggatggaatggaggaggggactgtggaccccagataattcccccatcaccactgtgactctggtaacctcttgaacagggccaaccactatcccataggaaggactttatatcccctagaaaatacagagaaactcagctctgagtttttccatgaccaactcagcccaggggcaaaagtgggcacaatctgggtaaagatgtgaactcagaccatgggaccagtgggtggaggagaatcccatgggctgagggggtgggcaagcagtggtcaccccttttctctctctctctgtgtcccttgggactgagcccttctctggaaaccacaaagctcctccagcagcaacccctgactctgctggtttgcatcatgggctgttctctccagcaaggggataagagaggtctgggaggaacctgcctagcctgggcctcaggaagcagcatcagcagtgcctcagccatggcctggacccctctcctcctcagcctcctcgctcactgcacaggtgctctgcccagggtatcaccaacctgcccatccccagggctctgggtccagtgtggccatgactatgagctcaggagggccctgcctgtggtgggcaggatgctcatgaccctgctgcagggtgagggactggcggagctgaagtcccctcaaactctgctcagaggcttgtgagagcctgaggggctgcacctgccaggagagagtactgggttttcagttcaaaggctccatgcagagggaaagtccatgggccactggggctagggctgattgcaggggataccctgagggttcacagactctctgaagcttttccaggacagcagggcaggggatttcatacggatcttttacctaaaagccatcctctcctttttttttttttttaatctttgcaggctctgcgacctcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgatcatcccacggtgacacaggcagatggggaagtgagacaaaaacaccctcccagcctcggtcaccctcttgctccagccccgggaggcctatggatagagccatgagtgaatctggtccagttcacctggatctgagcctcccaggccgcccttccctccagccccctccaggagtctctatagagcatacatcaggcatacacatggcctggaaggaccagaatcatctaatgacttggggctgtcgtgtgagttagagaatgagggcctgggtggaaagacagacagaagcaacctctgtcctctgtcttacccctggatggtaatggggtggggatgaggccagtccttagaccagctatctggctcagtccccagaaccaaccctgctgaggtcctggcccccaggctgtgtggcagtctgtgattcccaacagaccaaaccagaggaggggacactgtgaagtctgcccaggtcccctcttcaatgtgacccacctagcactgctgagaagcccagcagctcagagctgtgcccacaatgggaagcgctgttggttgcagaaagcttcctcaagtttatgtcctttctcagatggttttggtttaatcaaccaagatctcaagtccctgccttaatgtaagatgccactgaatgaagggcctcccagctccagagctccctgtgtggacggacacctgaggcctcagtggcaaccccattatgagtcagggtctccttctgcccactgttgcctccctcactctcttccaaatcttctgtgcatggaaatcattgcagtcaccttccagggaaccccatctaagatggccagctgtccccaacatgggctgtcagcgacccgaggagtccactatccactgaaaattctggtttctgtcctaaattttcagagtacatgttcaaatggccaatctgatggttccttgaatttttatggaatgaaaagggagcctgacatgctctaggttgagagatagttggagtcagatctccctgcagggaaacctggggcaggcagagcatcctcgccccacgcagggaccacagatgcacccacagggtgagctgcaggatggacactgcccatctccgccttccacatcttctccaaatgtcacccctttctacaaccccaacccaaatcattgatctccagaaaaataacagtaacaatagccatgaaaatctatgtaattcatctcataatttcatgttaacatgtgaaaatgatagtattttgctttattgacataaataaaatatactatttatccaattttatttgtcttatatttttatatttaatgtggtgaccagacactaggggtcacaggaggatcgtgtcatactgttatgggacagagctggtcaggactctttcaggtgacaggtgctgttgagtaacctggtgcaggaagccccatctccaccagacccaggtgtgaacccaggaagaggcgctggaacaatggagaggagaacctgcttctgcggaatacagtgcccttgagccctgcccctgctccatcctacgtgtgccacctccatctcaatgtggatcatttcttgccctgcctgaggtcatgactgaggggatctggcaggtctggctgtgtggccactgctgtctcatgtggttctggttgtaacaaagcccaggaacatagaagaggctgttttcaaaaggtaaataataatctactgcacatgacatagacttgttgctaaatcccatgggtctacagtaggattctcctgttgaggtttgccttaagcagaaggtttcagttcctttgtccagttcctctattatgatagggtctgcagtttctctggcccaatagcaggacactcacacccccgcctgcacctgctgcagagcctttctgctcttggccccaaaacaacgggtgacacagttctcagacccatgatttatggtgtcagtattcaggcctcgggggtccctgacggcttctctggctccaagtctggaaacacagcctccatgaccatctctgggttccaggctgaggatgaggctgattattactgcagctcacataggagaggtggcactttccacagtggtccaggttcatggggaattgagacccaaacctgccctgggctctcagcctctctcttgttctgaagatgcttcctcaccctgtgcaagtggcttcttgcagcaccaccttgagaatttcccctctcccagctcctctcctttctcaccaggaagtccaaaaggaaacctgctctgtgatttctcatccaggacagtgacagcttcctgttgcttgtgtgttgtggtccatgaatgtgcaactcttcctagctcttcaaatgcaggcacatagtgagaaaagctgcctgactcatgaagtcattgctgtttttaggggcgccctcaccctaaatgcatcctcatctcccacgctgtgcaggccaatctgcacagaagtcattacagggagtttcaagaaattgcaccttagtcaactctgtgtccactatgctctcgtgaagatggccctcctggctgggctattcctctgtacctctgtcctgaagcagtgaccactgtgagagctgagcatgtttttgagggattaagaaccagaggaagctgttgtttttcattattattattattattattattattattattttgagacagagtctcgctctgtcaccaggctggagtgcagtggcacaatcttggctcaccgtaacttcagcttcccaggttcaagcaattctccctgccttagactcctcagtagctgggattacaggtgcccaccaccatgcctggctaatttttgtatatttggtagaaacggggtttcgtcatgttggccaggctggtcttgaacttctgacctcaggtgatccacccgccttggcctccgaagtggtgggaatacacacgtgcgccaccacacctggctgcgtttttcttatttttgttcctcttctttgcctcaatacctcaggttgctgagctggggagattttgagtgacagactcagtattctctcaaaatccccctctctcacatcgctgaggccctgtcctggaaactctccaaaagtggatggtctccctataggatgggagcttccaaaatggctccacagggaagagttaacctgagttcattccttcctcctcattgacatccagcatttgtaatttccatggccatcaatactactatagctgaaatcttcattaatctactaaaggtgagagtgaatttcatacatattcaaacattagtttcatccaacatttaaattttatgagtcaattggtaaacatagccatgattacatgtagtttaggcttcataaactttgattaaatggattttatttaaaacaatgtaatcattttactatatgtgtatcctacctatatcaacatgttgttacttgaaatatccacaagaaactatatttcaaaaaccaaattgtatttattgtctattgttacataaaaattgctccctaatagttagcatattaagagaacacgtgtttgtgatcttgtcactttggtgcatctggaattgagagcagcttagttttgtggttctggccctgggttggtcatgaagtcgcagccaagctgtcaggccaggctgcattcagaggccagagcaggtggccaggcccagcctgaggggcttccactgtccctaacctgtttggctgattggaaaactcagcggaaaaggagagagtgaagtgtaaggtgcctgtcctggtcccccatgtcaaagaccattccatacatgcaccatttcttattctttcctgcaacatcctaggcatagagcactgcccattcattctaaggctgtagagtattccacagtagaattttagccatgcaacctctaatggttaacaccatgattttgatcttacaaataacactgcagcaagcatccttatgccgactcctttgagttattgtgtgcatatgatcataggataaattttcagaagtggaattactgggtcaaaatgatgtgcatttgtaatgtttacccattgttttcacatgtttcaccagtttacaatgccagccctaaatattgattggaattcattggtgaaagtgcaaatttttgccaacctatcagatataaaaaagttaccttgttacacttttatttttgatttctcctattgtgcttgaagttgagcatttgctcaaatgtttcagtgctcattactttttaaaattcggtaaactttttcttaaatgtataaataagaagtattttagtctttgccacacaggagtcaactttggggatactatgtaggtactgacagcaccatctgcaatgtaaacattaaaatatataaaaaccattttaacccattaaccatccccagataatagctgatttcttattagaagtaatgcaagccagagtcagtggagttatatttagaaaatattaaatgaaaaaacttactacccaaagcaatctacaaactcaatgcaattcctttcaaaataccaatgacattattcacagaaatttaaaaaaacctctaaaattggtataaaaccaagaaagatcctgaatagccaaagcaatactgagcaaaatgaacacagctaaagatgtcacactactagaattaaaatatactacaaactatagtaaccaaaacaggaaggtaggtattggcaatcagacactgagaccaatataacagaatagacaacccagaaataaacccatctatcatatagagccaatcgattttcaacaaagatgccaagaacatacactgagaaaatggcacaattttcaataaatggttctgagaaaactggatatccatgtacggaacaatgaaactagacacttatccccctccatataaaaaatcaactaaaaatggattaaagactcaaatataagacccaggctataaaactactagaaaggaacttagagaacattggggaagaacaattctttaggacattgttctagataaaagttgtatggccaagaggcaacaacaaataatagagatatgggacatcattaaactgaaaagctcctgaaaagcaaaggaaacaatcaacagagtaaagacaatgtgtagaatgagagaaaatatttgcaaactactcacctgacaaggacctaatattcagtataagaaaagttaaaaactgaaataactcatcaacaacaacaaaaaaaactaataataccattaaatagtgggccaagaatttgaatagacttttctcaatagaagacatacaaacggccaacaggcatatgagaaaaatgttcaacatcactaatcagcgagggaattaaaatcaaaaccccagtgagatacaatctcaccctagctggaatggctatgatcaaaaagacaaaaaatacaaatgctgatgaagatatgcgacttcatatttttctagtccaattctctgggaacaatgagagtgctctctttgctctccctttagtaactatttttcacatgcaaaaatatgggccctactgggaaataatgcctaagaccaccaacaccttaactgtttgttcatcacactagaaatgaaactgttttccaaataatattaacatctatctgtgtctatcaccattgtgtcaatgtttgtgtgatcctataaagtttagaaggcctagaagaatgcccttgctttttgcaatacaaaaatggcctaacagatatagatgacatagatatagatatagatatagatgatatagatatagatatagatgatatagatatagatatagatagatagggggttgtatcttggaatttgtttctctaagggacttatttcacatctaatttgaaattattctggttttaaacattatagaatgataacacaattggtgaaccaatcattctgtgttgaggttaacagtatttttttacttcaattctcactgaatgagagcagtttttatacggaggggccatgccataacaatatcacatactggggttgttctcagactgtgaggttctgcctacaccaagccaggatgagaattttatttgtcaaactgctctctccacttgtttgtatcccataatataccccaaaaatgagcataatttcattttttatgctgtttgttcttacatttaatacatgtaccaaaaagttgtctttgtttttaaaataaaattttatgctatcttttaatctatgtccctatagaaaaatcatgatccatacacatttgttatcacagaaagaacaagataaatttcctctctctctcataaatgccatgaccgctgctttttgggattatttttcttaaattattttttaaacagaaattcatataacttaccttaatcaaatttcttttcaaagtaatcacatttcttttatgtgaaaaattatttaccttcttttatcaaaaattatcttaatacaaaatatgtattgttttacttttagaagaaatggaaactatctacacattactaatctaaaaatacatgctctgggtttatatggtgttaacatgtcttccaaattttaaggaataggtatttaaatgtcatgcactttgtttttaaatttagaaaatgtttcaaccttttgcctgggcatggtggctcatgcctagaatccctgcactttgggaggccaaggtgggaagatcacctgagctcaagaccagcctgtgcaatatggcgaaaccccatctctacaaaaaatttcaaaaattggccaggcatggtggcaccacccacaatcccagctactcgagaggctaagatgggaggattgctggagccggagaagttgaggctacagaaggtaaactgttgaggctaaaacatggtaaatatttaattgttcacttaaaagaaatgttggttacattgaaaagaaatttggttaacgtaagttagataaatatctgcttaaaaaataatttaagcgagctgttagcactactgcattccagcctggtcaacagagcaaaatctgttgaaagaaagaaaaagaaggagagaagggaagggaagagggaagggaaaggggaaggggaagaggaagacagaggtggagggggaggggtggaggaggaagagggaaggggagagagagagagaaagagacaaagagagaaagaaagacaaagaaagaaggaaagaaagaaagaaagaaagaaagaaagaaagaaagaaagaaagaaagaagaaagagaaagaaaaagaaagaaggaaggaaggaaaaaaagaaggagaaaagaaagggacagaaaaaggaaggaacgacggggaaagaaagaaaaaaagaaaaaatatttcaagcttttcagtagcagagacacttcgtaatcaataagcaacagaaccaaaacaaaaaaaaaaatctacagaacagtctaaatacaattataaacttctgattcggatatcaaaaccatttcaataataaatatatggtatgaaaacctcacaaaggtcaagtagaatgtattatatttgaaagaaattacgagttgagagtaggaaatttataaatttaatcaaacaaataagcattatgaggaagttgtattgctaatgtattatttggcaagctgttcagtggaacaccaagatattcttaaggaagttgcaaatatctttttttttttttttttttttttgagacggagtctcgctctgtcgccccggctggagcccaccaccacgcccagctaattttttgtatttttagtagaaacagggtttcaccgtgttggccaggatggtctcgatctcctgacctcgtgatccacccgcctcggcctcccaaagtgctgggattacaggcgtgagccaccgtgcccggctgcaaatatcttttaagatgttgtcattgaagtggatttaaaagtgaggacatgaatacctttaaaaaatattcagggataaagagagaaaattaaatttagattgtatacatatataaaatgtattttaaaagatcagcttggctgggcgcggtggctcacgcctgtaatcccagcactttgggaggccgaggggggcgcggatcatgaggtcaggagatcgagaccatcctggccaacatggtgaaaccccgtctccactaaaaatacaaaaattagctgggcatggtggcgggcacctgtaatcccagctactggggagggtgaagcaggagaatcgcttgaacccaggaggcggaggctgcagtgagccgagatcgcaccactgcactccagcctggcaatagagtgagactctatcaaaaaataaaaaataaaaaaataagcttgtctctttttattccttaaataaaaggagcagacacttaaattccttgccttttattttaaaatttagaaaatgcttacagcttcccacagtgaaatttatacttagataatctaatcaatggataataatatcaaaacagaattctttgaccaatctattttcttcatttttaagtctaaatgtatactcaaagaaataaaactatttataattgattctgctgtttgaaaatatttactgatcatttaccttgcaccaactgacctccagctctgaagataggtcagtggtaaagtatacaaagttgcccagcttcgttaaacttaaattctaatgaggaaaaaagaagtaattaatcagggactttaaaacaggagtgttgtgatatggcttggaattctaattgcttcctgtgcttgctgtgtggagactggattgaaaaatagggcgatgataggagcttaaattcatacagaatatggctagcctgtattttgagggcccctgaaataagaatgtatagtagttctcattatttcctcaagaaatctctgcagtagagctttggccttgggagggaagtactatagtcaccaagtggtgagggtgggaaggtgaatttgcaaataccatttggaatgagttcactttaaaggtaaagctggcaggattttcatacatgtcagatctgaaaatctgtgtgtgcgtgtgtgtgtgtgtgatagagagagagaaagagagagaattagaacaagacagatacagacagacaatgacagagctgcagagacagagagaattaaatggggacaccaagaatattgagctgagaaactataaaatgggaggtgccattaaacagaatggggaagagcagttttggggagtgtcagtggctccacgtagacttattaattttgagattcctaaaccacatccaagtggagaagacagacagtattgtgtgtagtctagtgttatggtatcatataaaatatcaggaaatgaatgacacaaaaattagtaagaaagcaaagataagaaagataaaagtcccgagcctagtggttatctactgcctaaaaagtagtaggctgggcatggtggctcaggcctgtaattccagcactttgggaggccaagttgggcagatcacctggggttgggagttcaaggccagcctgaccaacatggagacacctcgtctctactaaaaatacaaaattagccaggcatggtggcgcatgcctgtaatactcaggaggctgaggcaagagaattgcttgaacccaggaggtggaggttgcagtgagtcgagatcgaatcattgctctccagcctgggcaaccagagcaaaacttggtctcaaacaaaaaaaaaaaagaaaagaaaagaaaagaaaagaaaaagaaaattagcaaagatgagaagaaaccagcaaaaagtactaggtataattatcaaaaatgtcaagaggaaagtaggttaagtgttctagaattctatcaaagaaagttttgaaaaaaaagagggagagatcaactgcattaaatgctgctaatacataaattaagcaaaggctgaggaattacgcttcaattcatcatttaacaatatggataccatttgtgctttgataagagcaattttcttggaatgagtaggtgagaaaccatattggagtggtttctcaaaggaatgcctgatctctgggttcttaaggaaactttttattgaacaggggaggcacaaattggattagttttaattccggggtccggacacactctaaacatgtgcctctgcatgcctcgctttttaaagctaggtatcctattatctttcgataacaaaataatcacctgcaaaaccaacacacatttaatggacacacttgtaaagtgtgtactagaggttgttggagaggatgtgattccacgtgatagcttacgagtcactgatgggcaggtaagctggtaaaatatctttggaaaactcaccatacctgttatacttaaatattcagataccaaacagcagaaaatccatattgtaatatatttccatgagaaaaaacaagagctctgtattaaaatattgattattattaaaaataatcccactgggtttcctgacttttttattagcaagtcagtctccgcctgttttcagtagtacaacctctatttaacaaatgttttgtatttttaatcagccacttagaaaaaatattatattttatatcaattctacgttcagtgccaaaaccagtgttttgtacattccacagaattatttgttgaataaataatgaataacttaaataagttatagtatccatatataaataatatatcatctccgaatacagtgataacatttgttatgtagaaaatgatttcaatctcagttaaaaatattttgggcataggagttactgtcatataaagattctcacattgttttgtttatatgaaaatgtttgcagttaacgtacatttttggtacctaaggcttttgctcttgctgccatagcaaacagtgtgcctattaagaacacgaacctgagttttatttcattttaacagatttcttaataaaatatatgccaccttatttggtttaatacataagcaaagagccatccactccaccattgccccttgtccctcctccaatgcagctccttaagatgttactgatagcagaggactttgtgttcaacctaagcactttatagcccttttattttcaactaggtatgaggtaaaataattcagcaccaataaaacaaacactctttaaacaatgaccctttttcttagcctgttcaacaaaacgcagcaagacagagtacacttctctttcccagcaaatcagtgttgccactacattctctacgttctgaaaacttgtattattgactttcttacaaacaccctttgagcttataatttagatgtcatcaaataatgtacaaaaacacgctacttcctcccccttctcttctcttcttaccagactattgtcagtttgcttttctatccaactcctttcttctgtctacttgatttttaaaagactttctacatatttactatcttggtattgtagagaccaactatgtggtcaaactacacatataggaagaactgaattatatgcaagcatttttaaataaacgattcctcctcagttttctgtgattatttcatataatcaaatgtcttccagatacacatcccaaacgagtggttgtcaagctctgctttgttgtctaattttatcagaattatccaaaattcttatgataaatacagatgaattagcataactccagatttatgaaatgaaaatttccagaacccaggaatatgcattgaaaaaatgtattcctcacgtggtgctgatgtgatatgggatctgagtttagaatccaaggaaaattaccctccttgccctctagttggccagaattacctagttgaccagagttgctctcttgttatctagaggtcctcttcccttttcacattctgctctctctccttctgtaccttcctcctctcctccctccacttctgctcatccagatcccaagcccttctccattgattctcctaaaactccaaatggtcagttgccactaaagtccctctgtcccatgaacaagatttgtgggcaaatgtagaatttaagcttggacagagctgaatcagagctgcaattaaagatttccctaaacccagcagggaccagcaaatacttatagaagattagagatttcttgtgagtgcaaagggctcagagtgacctgatgctatagaccaaatcttatggtcccctcaaattcatgtgttaaaatctaattccccatatgatgggatttggaggtgaggccttggaaggtgattagatcatgaaagcagagactgtatgaatgggatcagtgtccctatcaaagggactgctgagagctccctcatctcttctgtcatgtgaggacacagtaaaaagatggcagtctatgaacaaggaaggaagccctcatcagacacgaaacctgctgacgagttgaccttggattttaccatctccagaagcatgagaaatgaatttgtttctctgctacctagtgcagtgcattatcttttggcacccagattggctacagtaccaacatatcaacttgtacacgtaatttttgaaattctgatgccaaatctttgatggcaacaggtgattgatctgctggaggaatggactgacatgatccctctttccacaataaaccagagagtaaaaacaagcaaaagtaggtcaaggtcttctaaaagccgtacctgaaaggtttccagtaacagttgattagatggtaattcaatcacacaaacaaccacggcaaagatacacaactatcagacattttcagaatagcctctaaaacaacatctgacaacattagggagttaaagaaggcacgaactttcaaaaagtcaaactttatttaaatgttattgtagaaacttgtaattttaacactatggatgaattctagggcaggtggtggcatggcatggcgatttgggggcacaagtgctgagttttgaagcttcggttttgataccctttggagatgccccctggcctccacacccctgcccacctgtcaagaagagcctgtcctgggcagcacctcagggacaaacagcccagaagcccagttgagggcagacctccaaggttggaggaagaagccgcctctgggagcaggaggagctgctggatcccctcctcccaggtttcttttcctgccccccagcgcctcttgcaggcaggcaaacaaccccagcaggagcagcagcaggcccttcagccgcagggctgcagctctgctgaatgagagaagcctctctctggcgagtcagaggagcgcaggccatatacccgggtctctacctccatgtctcccactgtgcccaggactgagcccagcgtgggagatgcgggctggggccgtgctggccaccccctctcttccacctcttgctccagccatgctttcagctccagggctgaggccagtggctagagcagatctcatgatgtcaggtagctcctcactgggctggtccttggcaggaccaggacaggggcaggagggatctggagctgctgatagctccagttctgtccctgaaggggggtcttcccctggtgctggcactggctcatcagctggcgctggaatttcctgtgttgctgcacatggaacaggagatgaaaaagaagaaagactcaccaacgtcagtcactttccactggaattttcacacacagaatcaacctcgctgaatgtaaggtattccagcccgaaaacactgcccctgcaaaggctcatagactataggccacctcaccgtgtgcctgtgcctcgatgaactccagaggctccagctggacaagaacaatgtgcagatgtggccgcgatgggatcaccggtggggcctggcctggtagggcctgccctgggctgccctgtggtacttgggggcgcctttgcccaaatggccagaggcgcctggagtgagagatgagtgaggtattgcccctcacaagagggcattagctgcggggatccgcccacagaccctgacccaaatgacggatgaataaaacgtacactgacacagagttattctgctttgccagtcctgctgagtgtcccactgcctgcacaccaagagaggtttgtcactgcagctggccgtgaatagctcgcactgcaggcatttatttagtatagaatttacaacggaagctttgagtaaatactcttgtggataattaacatggttaagagagtagttctaccaatgattaaagctcaggtaccatggtttaaagtaaataccactgggggcaatttcccgggtctacctcccccctcctccccaagaggactatctggctcaaaggctagttaatggaagtagggtaaacagacttaactggggaagcctctattgtccctaacatttaccctatgagctaatgctctaagataagaagcagctgccttcagcctgttcaattattacaagctatgtaacctttccgccttccaaaaggtttgtgactattccctgtaactttccctaatatttccctttaatatttctgccaccatcctgagtgaatcccaatagatgagcctgcgtcagcattgtgggaaaaggctctcgctctgggccctcctgaagcaggagactcgagatgtgggaatgcagcatgagaacatcttgctctcctgagcatctcccaccaagggagctggctgcgggtctgtccctaggatgtgggtgcctgattaccagagttctaagttctgttagagtccatcaccaaggaagtgaagtcacttctttaaggttccgtaccctcggctccttccttcaaaacctactcagaaccccctgggctgctggctgctcaccctccccccaggtcagctccttacctgtacacaggtaagtccacccagtgtctgcttgtacacctgtgcctgatgtgcacctggggcctgggaatccacttagggcctgtgatccaacaggggcctaatgttgattaaaactaattttgattattcctatggagaaggaaaggccttctagcaataagaagcagagttccaaatcaaatacgtaaaaatgatcaaaaccttgtaaaagaaaagtatcttaattttaatcactgaaatgttaactttttgataaatatttaaggttataatgaaaaataaaacaatactaataaaataacagttgcaggaaatgctattgagtttcttgtttgtggtttgaacactgaaaggtcccacctagttatggtcataatttcctaccttaatcttcttgttcttatgagtaatagaaaaaaacacaatgacgatgaatgtgatgatggttcaaatacacaactgaagtttagtggcagaaacatcaggtgctcccaattacagtgcagctgttcttactgaggtgagaaaaaaaatcttgttttcaatacacacgggaagcaggagtgcacgcggatatgaccgcatttctctgaacttatgtttttcacagaagagctacagtttatcctgcattctccgttctgtgatcaaaaaccatggaacagagaagagcatttcaacctgagactcaattataagaattgcgtctgccccacctccctgcaaccatatatgccacctctctgtgctgagcctgaggggttcacatatggcacagactgaggctggactcaacagtccttaccctcgcaggtgacaggcgttctggggtcacttggaggagggaagctcctgggctctgtcttctccaccagcagggggcagcacagctgcagacagaagagaggctgaggctgcccagaaggagcctaagagggaggccagccatgaaggctcaaaaggtgtccaaggatcagtcctcaatttggaagtccagtaaagtgcatcctatcccctcgggctgcagtaactccgtcctgactgtaagactcatgcagcgtcactcagggcactgacaggagcccagggacagtgagagcctcacctgggaaatgtagctggaggcgcctgggccccggtgtcagcctggggagcttccacagggctgggattccctgggagacgccccgaggtcaaggtgctctaggagggggccacagtgtgagaggacagggtttccagggcccaagcccttcacctagtattgctgcctgagcctcctgccactctcatggtcttgtccctctctgatcagcagcattctggggagctgagccctcagtcctgggcacttccagagacctccccccgccaccccttctccctctgcctttccttccagctccaggcatactgtgactcagggggcagctcctgtgctcaggggagtctcacgtgggtggggtggtgcactcaggaccctggctccaggatgtggcatttccagcctccttgaggagatgctctccacagggaaggggattctcacctgcctcaggccagagctctggccacgaggctgtccttggctcagggacaggatacacctcattgcaggaaccaaggaccacccaccctgcagaccccacaccctgtccaaaggctgtgtccctgggatgcttacagcgaccatggggcttaaagttgaatttcccatcaatatttcatgtaaacttgcaaaaagcacaagaaaaccacactgggctgagaactctggtgctattttgctgttttttacaagtttacataaaatattgattggaaaaataaacaatggcagagctgaggatggcaatggctggtctactgtggggatggggatggcctagaagtatcagccccatgggtgaaatgagaccagacgtcctgatgactccacatgggtgagtggttccttaaatgactcaactattctcactgaaatagttaactagtgtcctaatgacacaatccatcatttagatgaaatgaccaggatgggacatttcctccagccaggaagactgtggacaaattcatgaactgggctggcccagttcacctgggtctgagaccccctggatctgagtccctccagccctccaggcaggctctgaagagggggcgtcaagagtggatttagacttaggtgaccaggatgtattggggtttgaggactcagctgtgacttagggaaatggggcctgattgaatcatcagactgaggtagacatccatcagctgggctctggatttccattggtcatgacaagccagtccttggcctgaatatcctggatcagtccccagaactgcccagctcaggctcaagtcattctctacagaaaaaccagtggagtggacactgtaggatctgcccagattctttcttctgagctcacccacccagcactgctgggagcttgtggcagctgagagctgtgcctttcctgggaagtgtggctcagcgcagaaaactgcctcctccaggtttatgcccttcctcagcaagattaggtttcatgactgcctgaggccaagttctcaagactctgcctcaatataggaggaaatgaaaatcctcccagctccacagctccctgtaggaaagactgagacctcaatgtgcgtcagggtctctttccgcccagtgttgcctccctcacatcctctgtgcatgaattcctcatctcagagtctgcttccagggaacccaaattaagatcaccagccatccccaacatgggccatgcggaacctcaggaggccactgcacactggaaagcgcccatttattcctaaattagcactgtgagtatccaaatgcccaatgagatctgagtgtttcttgcatttgtatggaatggaaagggagcctgacttgccaggtgctctgggtctgagggagagttggagtcagatctccctgcagggaaacccgggacaggaggagaagcctcaccccatgcagggaccacagatgcacccacagggtgagctgcaggatggacactgcccacagggtgagctgcaggatggacactgcccacctccaccctccatgccctgtagaaaaaatcattctttccacccctccttcagcctatcaaagttgacacttaaaaagccaccacaccccacccttgtcaacaggaaacccattcacatctccatcagccacacaatctccaagattcttcaaaaaataataacactagctatgcaaagtatatgatatatatcataaataattgtacctagattatatatgaaaatgatactttttgatatgctaggtaaataaaatatattatttaaactcattgacttcttctctttgtatttataatgcgatgactagacagtgggattcccatgaggctcacatcatattgtgattgaacaaggctggtctgcagggcttcaggttacaggggctgtggagtgacctggtgcaggaaaccccgtctccatccataggacatcagtgtgaacccagggagaggcgctggtatgagagatgagaacacaggtgtgaaccacctgcttgtgcaggggactgagccttcactttgagccaaagaagtttcttttcctatcttcaatcctgaacaagagggctttctggacttctttttgttttcagatttgtgccccttcaggtttggggctgtctggagtcccagccagaggacagtgaggaaatccaggagtctcacactgactctgttatatttcatctgctggggccatcccaaactgctgtgtaccatttcctttcctggtgctcaaatagctgctccattcacctgtcatggtttcagagatgaatctaggtgggaagacaggacagtgtatgttataatatttaaatggaagctgattccattaatatttattttaatatgaaacattaaaagaattttgttataggctatagggaaagatgaaaagagattaaaagtattttgaaaaaatgtatttatcgaatgtctgtgtgtcttcagtgttgcagggttgagagaggtcagctttaggttggatgtgctcagatgaggaaaagcaagaaagcaggaaacacgcggctctgtgacctgacacataaatcacagtaaaatggaaataaatctttcaataaatgaaacattcaaaataaacgtcactctggtgcacacagaaaggcctattagcaaactttccctttgtcctgctggctcatatccccatggatcacctgtgtgcagagtggacactgtagtccccatttctcaggctgagaactagaggctgggaaggacaagtcacctgcttgtgagtgggaggggcaggattgggagcagtggactcgggctcaggactgcggccctggtcggtgctctgtgttccctccacaggatccctcccacatgtgcccgtgtggatgtgggtgcactgcctggggtggctgatgtgctccagggattcgatggtgcagatgcttcagcacaaagcttgggggtggggatgggatgaggctgcagctggggagaccagggaccaatgccacccagcagaggtttccacggggtgggcagccccatttcctggcagtagagacagcctggaggtgggtgccaagcagagggcactgcagggtgtgcccaggcctggagggtcacaaagacacaggcaccacacagcagagtcactgaggaccagaagctcactcaggtaagggatttcagcagaactttctctcctgagcaaatcaggtacaaaaaaattaagatcctgccatcagaaaagacaaacaagaactttttatctcctcagctgagccccactgtccagggaagcagaagtctctgagcccagcccaggtgagggtggggtgaggagaggagctcagggtggagatttgcatggaggccccaccctcctctgaggcagaggggataagacagggctgggggcaggcccagtgctggggtctcaggaggcagcactctcgggacgtctccaccatggcctgggctctgctcctcctcagcctcctcactcagggcacaggtgacacctccagggaaagggtcacaggggtctctgggctgatccttggtctcctgctcctcaggctcacctgggcccagcactgactcactagagtgtgtttctccctctttccaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttccacagtggtccaagttcctggggaactgagaccaaaacccaccctgggctctcaggctcccttttgctctgaagatgcttcctcaccctgtgcaaggggcttcctgcagcacggccttgagaattcttctctctcagctcctctcctttcccaccatgaaatccaacaggaaacctgccctgtggtttctcatcccggacagggacagcttcctggtgcttgtgtgctgtggtccctgaatgtgcagctcttcccagctcttcaaatgcagggacagtgacaagcagctgcctgattggtgcagtcactgcttttttttcagagatgtcttcaccctacatgcatcaccatctcccacactgtgggtagaattttagccaaatatggctgggcgcagtggctcacacctgtaatcccagcactttgggaggccaaggctggcagatcatgaggtcaggagatcgagaccatcctggctaatacggtgaaaccccatctctattaaaaatacaaaaaattaaccgggcacggtggcgggcgcctgtagtcccagctacttgggaggctgaggcaggagaatggcatgaacccgggaggcggagcttgcagggagccaagattcgtcactgcactccagcctgggtgacagagcaagactccatctcaaaaaaaaaaaaaaaaaaaagaattttagcaactacattctaatagttatcgccacaactttgatcttaaataacagtgcagtgaacatccctatgcagcctcctttgagttcctgtgtgaatatgaccataggatacatttctaaaactgaaattgcgggtcagaaagatgtgtgtttgtaattttcacccattgttgtcagattcccctccagaggggttctaccaacttacaatgccaaccataagtatttgttcagagtacattgttgaaagtgtaaatttttgccaacctaccagactgaaaaatgttatcttgttacagttttatttttgagtctcccattctgcttaaggttgggccttttcacaaatagttcagtactctttatttttttagtatttggtaaactttttcttgaatatccaaataagaagaattttagtctttgtggcaaggcacagtgggtcatgcctgtaatcccagcagtttggaaggcttagacacgtaaattgcttgagcccaggagttcgagattagcctgggcaacatagtgaaccctcatctctattacattaaagaaaataaacataaattttaaaatgaagtattttagtctttgtggcccacgaatcaactttggggatattacataggtacttacagcaccatttataaagtaaccatttaaaatgataaaaaccactgtcagctctgggccacacaaaaacaggtgtcaggccagttctggcagggtgagggctactatggtgggaaagggaaatggaagccagtagagcttctcctacctagaaaaatagtaaatcaaaaacagtgtcatatccctggagggattgcagagattagtgccaccatcaaggacttgaaagacacagaggtggtgatcagcaccacatccctgttcaactctcccagttggcctgtgcagaagacagatggatcttggagagtgacaatggattatcataagcttaaccaaatggtgacttcaattgcagctgctgtaccagatgtggtttcattgctcaatcaaattaacacatctcctggtagctggtatgcagccattgacttggcaaatgcctttttctccattccggtccattaggcccaccagaagcaatttgccttcaactggcaaagccagcaatatacctttactgtcctacctcagagatttatcaactctccagctttgtgtcataatcttgttttttttttcttttgagacagagtctcgctctgtcaccaggctggagtgcagtggtgcaatctcagctcactgcaacctctgcctcctggattcaagcaattctcctgcctcaacctcctcagtagctggggctacacgcgcgcaccaccacgcccagctaatttttgtaattttagtagagacggggtttcaccatgttggccaggatggtcccaatctcttgacctcgtgatctgaacgcttctgcctcccaaagtgctgggattacagacctgagccaccatgcccagccctttgtgtcataatcttattcaaagagatcttgatcacttttcacttctgcaagatagcacactcgtccattacattgatgacattattggattggattcagtgagcaagaattcacaaacacaatggacttatcggtgagacatttgcatgccagagaatttgaaataaatctgactaaaattcagggaccttctacctcagtaaaatttctacgggccaagtggtgtggggcctgttgagatattccttctaaggtaaaggatacgttcctgcatttggctcctcctacaaccaagaaagaggcgcaacgcctagtgggcctatttggattttggaagcaacacattcctcatttggttgtgttactctggcccatttattgaatgaccctaaaggctgccagttttgagtgggttccagaagaagagaaagctctacaacaggtccaggctgctgtgcaagctgctctgccacttgggccatataacccagcagatccaatggtgcttgaggtgtcagtggcagatagcaatgctgtttggagcctttggcaagctcccataggtgaatcacagtgcggtcctccaggattttggagcaaggccctgccatcctctacagataactactctgcttttgagagacagctgttggcctgttactgggctttggtggtaactgaacattgactatgagtcataaagtcaccatgggacctgaactgcctgtcatgaactgggttctttctgatcaatgtagccataaaatgggtcatgcacagcagcattccatcatcaaatggaagtggtatatacatcatcaggctcgagtaggccctgaaggcacaagaaaattacatgaagaagtggctcaaatgcccatggtctccactcttcccccctgctttctctcccccagcctgcaccgatggcctcatggggagttccctatgatcagctgacagaggaagagaagactagggcctggatcacagatggttctgcaagatatgcaggcaccacctgaaagtggacagctgtagcactaaagcccctttctagaacatccctgaagaacagcggggaagggaaatcttctccgtggacagaactttgagccgtgccactgggtgtgcactttgcatggaaggattttagccaactacattctaaaggttattgccacaactttgatcttaaataacagtgcagcgaacatccctgcatccctgcatggaaggaatgccatttcccataaatcaccaaatcactcagaatgactacgcataagcccttaatatacgccagatgcattggttattgttttacaagcgggacctcaagaagactttcataatacggaataggatgatgcaaagccctatgctcaaggcccgatctttactagaaaactagtattgggaggttacatgttttccccaaacagatctttgaggaatcccgcagatgccaaagacctgctggcctaagagtagacacttattttctcacagttctgaagctggagagccaagataaaggtgtttataggtttggtttcccctgaggcctctctccttggcttgcaggttgctgcctccttgctgtgtcctcacatggtctttcctctgcacactcatttctggtgtctcacttctgcgaatgcaaatttttattagcctgggttaataatttttatatcagcctggcagattctatcactgatttacttgattatcctatttacttgattattaaactccttctctgctgaggtcacccattggtgagcactcgcatgggatacaaatatcttcacagtttttgatcactcagagggatccatccacatagctcttccccaaatttctttgtcatcaattttccaatcatgcttcttccaagtccctgatcatccaaccaaaccattggctacagcctatgaatcagtataaaattgcatatctggacatttctccttccaggcagtgctgagaaaagtggacatccacatgcagaacaatgaaactggacccatctctctccaaataaaaaatcagcccaacaaggattacaaacctaaggataagacctgaagctataaaacaactagaagggaacatagataaaattcttcaggaccttgggatacacaaaaatttttatgactaagacttcaaaagaacagacaacaaaaataaaaatagacaaatgggagtttattcaactaaaatgcttctgcaaagcaaacaacagattgaagacacccttagaatgggagaaagtattcatgtgaataggtcctaatatcctgttcatctgaaaaggcataatatccagtgtaagaatagaggacaaggctctaaaataactgattagcattaaaaaaaaaaaaagtgggcaaaggacctgaatagacttttctctaaagaagacatacaaatggcaaacaggtatgtgaaaaaatgcttaaggtgactaataatcagggaaatgctaactaaaacccaaatgagatatcatctcaccgctgctggaatgactatcatcaaaacataacaaggctaggcgcggtggctcacgcctgtaatcccagcagtttgggaggccgaggcgggcggatcaagtggtcaggagatcgagaccatcctggctaacatggtgaaaccccatctctactaaaaatacaaaaaattagctgggcatggtggtgggcacctgtagtcccagctacttgggaggctgaggcagaagaatggcatgaacccgggaggtggagcttgcagtgagccaagatcgcaccactgcactccagcctgggcgacagagcgagactccgtctcaagaaaaaacctaacaaacacccgtgacgatgaagagaaaatagaagaaaaaatcacatgactgtctcaacagtcagatcaaatgttttctttcaaggaaacatttttgttggttgttttttctagtcttgttagagcatcacgcatgataagatttgtggtacagaagttagaggggatgttgttccatgcaaaatatctgaatatcccatacccaactcttcggttacttactgataaatgctaaaaggttacaattttgtattttcaaatattctggtggccagaaacctcttccttgacaagtctggagtacaggtatctgactccagatgattagaatttaggcaggtattgtgtgagcagtgaggtcacacacaggaaacgttccagtcaaagagaaaaacagacggaggctgaaacacagagatcatatgtctgagaaataaggaaattccatactaatgggagctgagtgagaacaagatatgaaccatctatttctctctgaatatctcattgggatcttgtccctttcccagcataccactcatgtggattttaaaattgtctgctcttaaaacatttcttgcacatcattagagagtccagcactggaatcaagctcagtttgatgagaccagggcagttaagcaccaaacccaggtgttcttagaagggcttgtagaagacaaaggtgtgttgtcaaaagcagagaaagtgagactttccattgtggtttaaaccacagcttctggaatttcattgggcacacaaatcccctgaggattctggttaagatacagctgtgccctcagcacatctgggtatggccccagattctccatgtctagcagcttccaggtgaggctgatgctgctggtcctccaaggacattttgagtggcttagctcctattcaccctcctcacgcaggcacaggtaagactcacctaatgaagaaacctgagaagcacaggtgaactctccctcccctcctggtgtcttagtaccttttgtgttgctataaaggaatacctgaagctggatagtttgtaaagaaaaaaaagggtttattggggtcatgcttctgatggctggaaagatcaagattgggtatctgcgtctagtgagggcctcaggctgtctccactcatgatagaaggtgaagggaagccggtctgtgcagagatcactgggagagagaaagcaagctttttttcctaacaaagctgcagggatgtaattgagtcatattcataaagtgctcaatacagggcgtaacatattcaagtgctccttagtggacagcaattattactgaccttgctcatgaaaattagacctcagatggaggaaaggcagtgccgagggttttagattgttcgaaataagagagattaaaatgatttaaaatagaggcccaggagctgaggcaagcatccccaggtgttctcctgccaactccccccatgtctcagaagctgttttcaggcaagtcagccagggaggaaagtgggggagtttgtagaaccaaggattgcaacttcatccatgaggaggaggtgtagccagccaggtggggagaggctgctaagctcatctgaaggctgttgaaggctttctggccccatggtcctgggccatccctccctgcccagggccgcattcctcagctgacagccacaaccttgagagaggcctgtgagtctgatcagaaatcctgccagggccccgagggggcaggcatggaagggaggtgtctaaggtcacaggagacactatttgctgcctgtggggctgggacaggctccttgagaggaaattcgggcactgtacgggaggaaaacacaggacagggaggcctctccccaaaggattgtgatgatagagaccaaagcatctgcaaagagcccagccctacaggggattctctgaacacagcattcctcggggcgtctgtgttattttgccagggttaccataataaagtagcacagactggatgctcagagaaaagaaatgtcttctccactaatctgtaggtgatgttagaatctgagatcaaggtgttggcagggttggtttcttctgaggctgagcgagggcctgttctgtgcatctccctggcttcaggtgcttctggaaggatgtgctgttccctgaattacagacaaacaccccaatctctgcctccatgttcatatggcattttccctatgtgtgtctctgaccatgtttcctcggttttttgtttgtttgttttttgctgttgttgttttgttttgagatcgaatctcgctctgtcgcccaggctggagtgcagtggcatgaccttggctcactgcaacctctgcctcccaggttcaagtgattctcctgcctcagcctcccaagtagctgggattacagatgcctgccaccaccttcagctaattttcatatttttagtaaagatggggtttcatcaggttggccaggttggtctcgaattcctgacctcaggtgatccacctgcctcagcctcccaaagtgctgggattacaagcctgagccactgcattcagccatttcccccttttataacaacaccgctcctgttggattgggagcccactctacttcagtatgatgtcatgttaacccattacatctgtaaccaccccattcccatataagatcccattttgaggttctggggctgaggacttcaatatcaattcggcgggggggagcctacaatgtaaatttgtaacattgtctctgtcatgggccagctgtcaatattccctgaatatccaggatccacccatgctctctggccatcaccagagtgagcaaatccctgacacatggataagagttgcttccatgggctcccagccaggctggaaattcttgattcatggaatcaagaatctttctccagtgggtggggctaaatgcagctgcctccctgacagtctccctgggacactaggcttatcagcttttctcctaaagctgcaggtcctgactgtcctgagccccagctctgctgtggtctttgcatcttaagatcttattcaactcgcttttgtgcctcagtggactgacttacaggaaaacagtgggagatgcccctgctctctctccccagggtctcctcccctcagtggcacaagacctgccctattgactggcagtccccccatgcccatctcaacctccacactgcccactgtgcacggtcacaggtcacaaactgattgttcactttgggcagatcaccttgacagtttctgcagaactgggtgcttcttcccagaatcaggaatttacaaacaaggccagttctagagatgcaactgggagagtaatgtgcatcacagcgaatctggacaagacaaagtggttttgctgtagttctcctggaacacattctggtgatgtgtccatctcccaggatagtcttagcaagttacatccaatgctgcatcaggacccacaagaaaaggaactggcctgcatgagtggccggcagggtcctgggaggagaccctgagatgcccagtgacaggaggagtggattcttaggttggtaagcgtgtggaggaactgcgagtgatgtgctcagccaggtacaggagcaggcgtattggtgacctgtggcctcatcttatctcagttgtctctttagaccaaactccaggaaatcagcacatagagacttctgtctgtctccgagatcatcgcaggacttcacacgtcttttctatttataatacaacatcatgttgtgattgaattactttcatcacagcctcaacagtcctaggtctgaaaactaatacatatacttagaatattaattaaggaatactttcttgtcaattatgtttattaaattaaaagacttcagtatctagtgttacagctgtcctaattcaacagccttgaccttcttagaaataaaatcctgatcccaaatttttctggggatatgactggcacaaggagccaagcagacatctggatgtcccagtgtcactgctgacatgtgcttttttgttatctgtcatggggtgaacagaggaagtgtccctacctctgtccacagaacccatcaaagacagtgcacctgattaaagaagagagggttgtgatcagaggggtccggggtcctgggatgaggtgggaggaggagactcatgggaagaaaggaagcagggcaggaagaagctgaagttcaggctctgaggtgcatctcctgcatggaatcttgactccactcacttctgtcattgtgtaatctttcaatgttggttctgtcatcagtaaacttgaggagaggttatgccataagcatagggctgaggaagggttattataaatatccagtcatggttgtgcctataaaacactcaccaaagactctgaatatattaaggtctcataagtagttgttttgcataatctagtgatacatggaggatggcattcctcctgtggacagcaggaggcactgtgggtgtatcgtttggggatgctaatagctccaagtcccccagtagagctcacgtgcaaagggtgtgactgatgtttcctttcaggtccagtctttttgagtacaatccactctccactcctgacacccacttggcccttctcctgcctttgagaaatgactaccctgaggccatcagctccagggctcagctatgagctcagacagacacgcttgggaatagagaacagatttggattcaatgctccttccttcttgagcttcaagaagaggataagataggagctggttgtgtccaggctccactgggcagcctcgatcagagctctcggaagtgcctcccaccacggcctgtgtctccttctacctcctgcccttcatattctccacaggttggagcatccagagaattcagggaaaccctttcactgctatttccccccagcactggtcctcagtggcattctttccagttctcctgtgcattcagcatcattcatgaaattatatgtttccaggtctctgtgctctgtctgtgctgacccagcccccgtctgcatctgcctggctgtgagcctcagccaaggtcacctacaccagtgaatagtatcaacagagaccaaggaggtccccctagtgtataatggaggttaagagtaatggcagcgacagcaaggggaacaggatccccagtcacttattgggctccagccctggggctgaatgctacttaattatcttcaacctccaatctgaggatgaggccgagtatcactgtggagagagccacatgtttgatggtgaggatgggtgagccacagtgacacagaccaagaagtgaggccaaaacataccccctccccttcctcttcaaggactgagagtgagaagccctatgtcatctccattgaccctgagaatgttgactctccccctttcaaatttcatcatcccagatgtcctccctcaagacacccttaggcagaggcagatgcaggccatgattgaggccattttgataagtcatcaatctgtttccaccacaccagcctgtggggactacactgggagagaccagaacagcccaggcaggaaaacggccctgagagaggggtcgggctgagatgactgcatccagtgagtgccattgcaccctgcacccctgcctcaggggactgtcatggggctctgcctgaggaggcaacatggatcttgacatgtccccagccatttatgagaactgtagttgtgtgcatcctcattaacactcaatattattgtcagtttttgtttaaagccactctaatagatctgtagcgattcttattaattttttaacttgtattttcttagcaacatcaggctgagcatcttttcaggtgcttgttatctgtatatcttctttggtgaaaagcttaatcaaatcttggtctatttttaaaattcacttttccccatattccccttcatgcagtatttttcaaaaatggtgaataaatgaaagttttgctgacatttaaaaactcacagaattgttcaccaccagactgttgctattagaagggtaaaggatatccctagacagaaggaaagtgatgtcacattgaaatgtgaatttacacaaaaaagtgaaaacatcaggctgggcccagtggctcatgtctgtaatttcagcactttgggagactgaggcaggagtattgcttgagcacaggagtttgaggctgatgtgaggtatgatcataccactgcagtccagcctgggcaacatattaagaatctgtctctattaaaaaaaaaaaaggaaataaaaaaattaaatatcaggtacagtaactacatagatacttgtgaaaacctctgtattatgttaatgccaataaaatacagttcactgatcaaagataaattaataaaatacattgtgatttataatgaaaataaaggcaaattatatgacaaagacagcacaaaatctgtggtgggtgaagaacatgttatcaaggtctcatatgggaatgtgtaacaactgcaggtagattttcataagatctctatatacataaaccttaaagtagtcattaaatcaaaccttttgatcaaaaaagaattagagcgaataagctacattagggttatccacagaaacaaaattggtaagatatatatgtgtgtataacatacatatgtgtatatacacatgcatgtatgtgagcatatcgagagagagagagaaacttaaaagaagaaattggttcataggattgtcctgtctgacaaggataaaaatctcttgggcaggctgaaggctggaaatgcaggtaagagttgatgttgcgtcctgagcctgaattcagcaatacaggacttaagaaatcctcactctttgctctaaacacctaaacactttcttttttttttttttttttttttgtgagacagagtctcactctgtcacccaggctgggttacagtggtgtgatctcagctcactgcaatcgccacctcccagcttcaagtgattcttgtgcctcatcctcccaggtagctgggattacaggtgtgcaccatcacatccacctaatttttgtatttttagtagagaccggctttctccatgatgaccaggctggtctcgaactcctggcctcaagtgatcctcctgcctccttggcctcccaaagtgctgggattacaggtgtgagccaccaggcctggcctgctctatacactttctactcatgaatgaggcccaccgcattgtgatgagtaatctgcttatacaaagtctactgagttaaatgtgagtcacatctggaaaatatcttcacataaacttctatgtttgtactggacaaaatcaacctggaaccacatcctagtcaatgtgccacttaaaattaaccatcacttaagccggcatgaagatagaaaggaaccattttttaaagcaatcaaaaacagagacagagaaagggaaagaaaaacaaggaacatatccatagattgtattttttaagtcactttttgaggttttctgttgttttcctgttttctatttcattgatatttggctcttaactatattaataccttttctctatttaaattgaatttcaatgctctccttttccttagatttatgaggtagaaccttagtttattttagatcttgcttctttccactgccaaacattcaatccaatagatttatttaaaactacttacttatatctattttttaaattttaatacatttgtttttgtgttttaaaagttcagtattttctaattttgttgtgatttttttctttgacttatgaaatatgtagttttatcttctttcatttccaaaaaattgaagatttaccacagttcatcatgtatcaattccatttaattagttaattctgcattaaatcataccttgcatgagcttcatattttcaaatttgttaacatttgttttgtggcctagaataggaagtatcatgaaaaatgttccctgtgtatttgaaatagcaatgtttattctgctgctgtgggtatagttttctacgaattcaattagcctaagttggctaatagttcaaatatatattcttactgtttttttgtgtatttattttgtaggtctgtgagagagagagctattgaaatgaacaacactaattgtagaatttcccattgcttcttttgagagaggaaaatttccagtcatggttcttaatactttattctcctgacaaaaggtcacctatgattttccaacactaatcaaggaaaaaaaaaaggcagagttaaagccacactcatggatgccacgggagcagtgggtgaccacatgatgtccctccactggttcagtagatttagcgagacattatattttggcttttaaaaatcataaatctggctaagacatccatgaacaaatttgaagacatacacattgaataaaatatgaaaattaaaagaaaggtaactgcatacgtaaaacattgctatcacagcacctgactcatgggaaatggataaaaagtattataaattcaattacatttacttacacattaaacaaatatgaatttaaaccagttcactaaactgtctcatatactgtttaggtgatggagatttattggtgcacaaaaaagacaagaatacctgctctcagagtggcatcatggaagatggtggagtacgaagctccagcaaatggtccctcctgtgaaattacttgaagtggcaagagtcatgacattaactctcataaaacaacagaatcttgtcccacatttgcagtattcagggatgtgccgatgaagagagagacataaaataatctctgtcaggtcaatttctggccatggaaataattgaacagaaactgcatggatcactctgacaaggaagctggtccttaccaaaatattttggaaatgtcaccacgcaattgaataacagcacctttcagcaagcaacatcagccaaggcagagaagagagacaatctgatttcgagagtgacaatatcataacatccaaaatacccagatctcaagaaaagtttacaaagcagacaaacataaaagaaagcaagacccactaaaaggaaagaaataaatcaactgaatgcattcctcaggaagcacaggcattgcacgtgctacacaaacacttcaaatgaactgcccgtatatgctcaaaaagcaaaaggactccatggaaacagaactaaaggaaagcagggaaatgatgtttgaacaagcatgaaatatcaataatgacaagttttataaaggaaccaagcagaaatactgaaactgcaaagttcaatagctgaaatcaaaatctcaccagaggagttaagtagtggtgtgagcagacagaagaataatcggtgaacttgaagatacatcattgaaattccacaggatgagcataaatttttttagaaaagaataaatgaacaaagcctaagagacatatgagacaacatcaagcatatcaatattgctttatgggagtttcagaaagagaagaaaaacaggaaaggaaaaataaaatacataaagaaaaatagctcaaaacttctaagtttgatgaaagattagaatctatactttcgaggagctcaataaactccaagcaagttaaactgaagtctgcagtgagacacattctgatcaaagcatcaaaagccaaatacaaaaggaaaagtgtaaatagtaacaaaaggagagttggggtagctaaagcaatttcagacaatataggcttcaagttaaaaatgcttacaagagacaaagaaaggcgttataattgatgaaataaccaactagtcaagaagacagaataattatgcaccaagggatagcacttcaaagtacataaaggaagaccaatttgaaaaaaaaaatatgtagatctataatataacttggagacttcacttctccacttttactgaccacctaggccgggcatggtggctcacgcctgtaatcccagcactttgggaggctgaggcgggtggatcatgaggttaagagatcgagaccatcctggctaacacagtgaaaccccgtctctactaaaaatacaaaaaaaaaaaaattagctgggcatggtggtgggtgcctgtagtcccagctactcgggaggctgaggcaggagaatggcatggacccaggaggtggagcctgcagtgagcagagatcacaccactgcactccagcctgggcaacagagcaagactccatctccaaaaaaaaaaaaaaaaaaaaaaaaaaaaaaagataataagagaagagacacaaataagtaaaatcagaaatttgggacaatagtacaaagcttatggaaatttaaattataatagaagaacacacaagcaattgtatgccaaatcttagaagatatggacaaattcatagtaaacacagattgccaatctgactcaagaaaaaagagaaaaaaatcaacagaaatatagaaaataagggatgtaaatcagcaatggaaacttccgaaaaaagaaaaactcaaaaccagatggcctcactggtaattctgctaaatgtaaaaaggagttgatatcaaccataatcaatctcttcccaaaacagattaagaggaagtacttcccagcacattcgaagaccctagcattagcctgacaccaaaggcaaacaaggatagtattttaaaaaaactaaactaaaggctaatattccttaagaatgagcatgcaaaaatcctcaacaaaataaaagcaaaccaaatccaacgttaagttaaggggaataaaggatttcaaagatggttctacataagaacatgaatcaacgtaatatatattaacagagtgacagaaaaagtgtatgatcatctgagtagatgcagaaaaagtgtttcacaaaattcacattttcctgattaaaaaaaaaacacacactcagcaaactcggaatagaaggaaacttctacaaactaataaaggacctttatctaaagccacagtgtacatcacattaaatggtggaagagtaaaagcttccctactaagatcagggacaaaacaaggactcctgcctccacaactactatttgacattgtacagaagttttagtcaaagctcttaggcaaagaaagaaataataggtatctagaatggaaatgaaggagtaaaatcatccctatttgcacagaacccgattctaaacgtacaatatcccaaagaatacacgcacagaaaaactaacaaagtgaataaacacattgaaccaagtttcaaggtacaggaacaactggacttgccacaacttttctttgttatcctgggcattagttctcttggcctcaattttatctttaaaactgggaggcttatactgcagttgagaaaaagacacaaaaagaacctgttagttaaagatggaataagtgaatctcagagggtggacataggttggtgaggtcctgtccatctctgggggcatttttctggagtgtgggaaagcatgttcccagatgtgttagcaagatactcgcaattttctcaaaacaacagacaaggatagtgtagaaatcctcccaccacaaattgtgaacagtgtgtgatgaaataaaaataacagtcatagaaaaagatggcgatgatgatgataatgacttaagtacacaactaaggtttagtgatagaaacatcaggtgttcccaaattcaatgcagcttttcttataaaatgggggcaccagtcttagttcccatatatttaggaattgagggtccccatgaggtgtcgctgcatttctctgggcttttatgtttatcacagaagagctacagcttaccctgcactctccagcccgcaatcaaaaatcatggaccaaagaacaacatttcagcacaagactccattatgggaattgaatctgcccaccctcccgaaaccatatacacctttctgtgctgacatgagaaaaccacagtggatcacactggctcaaagtgaggctggactcctttgtccccaacctcccagatgacaggtgctgtggggtcacccggaggagaaaagctctcctaggctcagtcttgtccaccagcaaggggcagcagagctgcagccaggagcagccagaggctggggctgcccaggtggagcctaaggggtaggcagccctgggaggtctacaggtgtccaaggttcagtcctaggattggaagtcaggacagtccatcctattgcttctggttacagcgaccatgttctgagggtcagactcaaacagcatcacccaggacaccgacaggagccggggcacaatgagagcctcacctgggaaatgcagccggaggcacctgggcccagatgtcagcctgggcagctcccacagtgctggaattccctggaagatgccccaaggttgaggtgctctaggagggggcccagtgggagaggatggggctcccagggctcaagtccttcacccaggatggccatctgagcatcctgccactctcggggcctcgcccctccctctccagcagtgtcctggggagctgaaccctgtcccaggcacttccagggacgcctgacccctcctccctctgcctctccttccagctcgagactgactctgactcatggggcagctcctgtgcgcaggggagtctcaggtgggtggggcggcacattcagggccccggttcctgggtggggcttcccgggcctcctagaggagatgctctccagagggaagggggttctcacctgattcaggccagagctctgaccacaaggctgtccttggctcagtgacaagagtctgctgcattgcagagaccagggaccacccaccatccagagctcacactctgtgcaaaggctgtgtccctgggatatttgcagagaccaccgggcctaaagttgaatttcccatcaatatttcatgtaaacttgtaaaaagcaccagaaaaacacactggactgagaaccccgatgcttttctggggccttttacaagtttacacaaaatactcataggaaaaaataaataaataatggaagagctgaggatggcaatggctgatctatgtggggatgggggatggcctaaaaggagcggcaccatggctgaaatgagagcagacgtccagatgatgccacaagggtgtgtggttgcgtaaatgaaccacctactcctactgaaataattaacaagtatcctgacgacacagtacgttatttagatgaaatgaccaggatgggactaagtaatgctgggggacccagagaggagggggaatatggtgggttcttggtccacctgctgctgagtcaggtttcatcaatgatctctcagcagggccaaactcagccccaagccaggtttctagaaggcccgcagccctgctgagcctggcccaggacagaccacaggtcagagaggtttgggacagtggtcatatggccagtccccaggaaggtgactgtgatcacaggcctcagaggtcgaggctaattttctgaccaaagacccaactccttcttcagtcacctgtgctgcccccacagctagtttgagtgacatctttcaatgaggagtcccagaggatagaaatttgcatgaacaccaagcacttactgccccatagggcctgggaaggaataagagaggcctggggagcccagctgtgctgtgggctcaggaggcagagctctgggaatctcaccatggcctggacccctctcctgctccccctcctcactttctgcacaggtgcttctcccaggccctgccccaggctcagtgcccatagaccccaagttggccctgccctgaaccctgtgcaaagcccagacacagtcttagggtaggacccctgggaatgggctcttgatcttcaagccccctctcctgttttccttgcagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaatcatagcacagtgacactggcagatggggaagtgagacacaaaccccttcttcatctattttaccctctccctccagccccaggaccgctgtggaccaacccataagcaggtctggcagaattcacctggttaggagatccttaagctgcttttccctccactcctctaggcagactttgcaggaatgagtcaggagtggatttgggcctggcagggccagactgccctgtgtttccttgcccacggtttgagttgtgaatggagagtatgagtggaaagacagacacagcgggacatccatgcaggcatgaacagcccagagcgacaggggaaactttcagctctcagttcaatgcagtcattgttttatctcttggaagaagcatttctccagtgcaactaagactctagactcacagagcccgaggttgtgggggaggacattaaattttgctcatggatcactaaggacgtttttgagtggagccactacaatttattcattgattcctggactcatggatcctgactgtgggagaaatagtactgcatattgggcactgctgtacagcgcatgccccatcctcaaagtcattgcccaaccttacatgtttttgccatcctgctgccacagtaactgagtcttcaagcagacactgagccattcatataagccagatgccacattggtgaagatggtaagacacttgaatgccatgaggatgggcccatggttgctgtttatttgctgtgatatgagttccttggtcaaagccccctgtggaataccatcatggtgggtgaagcattctgtagtccagagataaaaggtttggcagaagcactgcagtcaaagaaagcaaatccctgtctatactaagtgtgtattctggcaagagcaaagagctatccctgccatgaaggaacagctttaatgaaattaatatcaaccaggcatcctatagggatcttcctgttggtcttcactgttggcagatggtcactcagcagtagctacagccaggtcagctctagtgagtggtagtccactttgatgagtccatggacagcctccttttctgcaaccatagggcatttgttattgagccaattgggcaatgatggcagtggttggggcagactgccaggtgtccagagagccacccatcctaccaacctgtttagcaaaatcaattccttctcatgtcagacttcacaaaatattcacataggagataaatattctcatgctttctgcttgctcacacatctctccctcagacacagttgtgatcaatattctgattgtatttcctgtgtccctgaacatccttgatcatcttccaagtccctgagtcacagcccatgaactaggaacctctgcccgtctctctttgcagatgacatgaaccaggtacactgctctaagttctgccttaaggagagtgttcctccaccactgctgttcagggaagcccagaggccaggtgggatactagcactgtccacagcagggatggctgcatgtcctgcagaaacctctgtaaccccagtctaagtgcctcctcctaggcagctggtcccagggagcccctcaggaggcccaggctgtaaggtgagaggatggccatggggcaggagttggcccgtgtctatctggccacctcttcatgcaacttatttgtccttgtgacctgatccatcaggtctcaggtacagcccagccatgtgatggggaggccactataaatggccacctcggactgggggtcagataacatccagctcattggcagcttgtgtcccatggtgagctctgtggccacagtcacaaagagcccctgttgaggcccaggagcccccccagtcttcctctaatggagctttctgctcatttagaaaaataacaatggggaggttgctcgcctacctcaggtctagggtcactgggaccacctagaccacatccatgatcttgtctgattattctgattccttgttggcttagctatgcattagtgtaaccaagccacagtgtcttaggcactaaaatgccactacttggcccctgcctaccctggggtcctgtcaaccacatcttggtatccaattcagttttagcaccactaagagaaatctatttttatattgagaacaggaaacattagttatttctattgtggaaattttataagacaatagtgtggaaatgttttaagagacattttacttagagtgaaagaccttccattaaaccactcaataaattgctccataaatggccagcccaaaccctgagttcagaccaggcacagcctcggtgttgggaccttctgggaatgggtctctgtcatcaacccttctctaccctcctgtctgcacagccctgggcctcctacatgcagggacagctcccctcagtgtcggtagccctgggacagatgaccatgatcatatgctctggagataacctcggaataaacacgcattttggaacaagcagaagccaagccagacctcaatgtcggtcctctagtataacatcgaccagccctcagagacctctgcttaatttttaggccacaaactagcgaacatggccaccctgaccatcagcagtgcccaggccagggacaaagctgactattactgtgcctcagattgtgacagtgggggcagctggcagggactcacagtgacaaagacagatggggacttgcaacaaactgtcccacttcagcctgcctctcattcttacctgccctctgagcagctgtaggtcaggcctcagaatcaggtgtcctctctggtcctcacctggtccctgcagggccggagattcgtaacagcttttccatactctcagggcctacatgtgttcaataaaacctgtacgggggaagctcgttgaagctgcaaggaccttttacaggtttgtagaacacatgagaacttcaggaatccatatagtgtcacatggctccatgtgtaattacacgtcacacagggaaggagagagctgtttcacagggtgcaatcctactggaattcgtcttttccttgcgtagaaacagcttagtggaagccgtgtctcctctggtttcctagatgagttgaccccacattgtaatggggcacctgaggcctaaggaggacaggagacccaacccctgtgggccccaggagccttcctgtcctgacatttcacagaaactgcagaggaagtgcaggcccaacctttggttccacctggggactgtcttcagggaacactgacctttcccagtccccaaattcccaggacctgtctgacctgactaggtgtgcctccagctccctgatagcttggattttatctctgggctctgggctgctttctgaggagctcactaagaagtccttggtgccaagtgcaggacttgcccctctgctccatatcccgggtctgcaggcacaggggacaggtcctgctaggtgaggctggcaccctcttccaggagggatctctcatcccaggccctagggacaggttcactgggctttcttttctcacttagaatctcttagtctttttgtttccttctttaagagtacaactgctttttggtgaaatcatgtgtatacatcaaagttaacagactactgtcacaagcgcatatatatacacatcctcttcctagatggggtaaccgtggacactctgccatagtcgtctttttgtttctctctctctaccacaagtgagactattaatagcactcttctatgcagaccataatcatattctccagttgcacaagaacgattcttatagttgctcaatttccttgcctttcaggaccctgaagtttcccatgcccacatttggttgccatgtctctctgatccaacagtattccttggaagccgaggcttatgaaacattttgcaaaaagttccacaagaaaactcaagttccttgtgcacagttggaccatgttcattgtgtgcagtagaacctcgttccagtgttgagtccattttatgttttgaccatcaaagggaagggcattatgacttttggggactgagtcgatggaggaaagatagcagtcgatgatgaccttatgcactgacgtgtatgtggccaatgtctatagatggatttggaacttgaaggagctgttcgttctgcagatggaatttccagtgccgcatctccaccacccagccactagcactcggcaggtgctctgtaagaggaagcccttcactgccaatcagccattacacaggtgaaggtgagtgagacttaatagctattaaccctcaaaacaaactgaggaataaactcaggttcacaaagtgactttgcgggaacagcctgaggaagcaagttaattagtagcagaaggttttgcccagagcaggaggaatcacaggatcactgaggacctagtgataccatggtgtggaggtgctgtgaggcatggtgacattcaagaaaacctgttctctacaaacacctacctacccacaggcacagcagacaccccagctatgccaagggctctgtcttcctctagagtaagagcctggtagcaaacaggtatcctctgaaaggcaggtgccccatcagtcagctctgcacgactgaaacaaaaggaaaattgccagagaactttccagaaaacagtcaacctgcttgtgctggtgcattgatggtgacccaggatcagtggaagtaacagtagcttaatttccccatggctgcatgatggacaccgggagagaagtgtggaggcggattaaccaccactctaagtggcttcagccctaggtaagcaggaacaagtgagggggctgagcccacttgtgtctaatcagtcccagcctcagcgactgcatcctggagaccaacagggagtgtatgcgctcagcccctcccagattgctgagcataagcaagaaatttccctccgcacacctgacgcaccacacacctgcccccagctcctcacttacaagacaatatcaaatcagacagggactggtctgggtcccagatcccctcaggttgccgctgtcctctcagatccccacacacagcagactcttcccctcacactcctgttccaggttactcttctccaatatgatgggggtttgctttcattgtttctgtattttttgtatttttatgggtaagctgagccccttttacctggtcttgagtcaggcaggggccacacagagaagaggaattcctccccaggggccagcagtccacggatcaaggcatcagggacctgagcagtaggttctgttcctatgcctggacccaggaggcccatgagcctccagcagtcagtatggagcagccaccaggggggcagcaaagagtcacctgggaaagccacctcgggatggggtggacctgggcatcagggagatgctgacatgcagggagggtcagtgaccacgacctgacacctggagggaaaataggtccttctttttctagagtgttgtccttgacactgatgtaaaaattctagcatcaaattttatcttcagcttttgtagatgctcctatttccctgacaaaggtccaggcacttgacttccccacacatcctctcctcacacacccagttgtgctaaaatgctgtccctgtcatgcacagtgtccttcctgaggtgacacgtgtccccctccctgccctttgctctgggagcccctgtcctgtagacacagcagcttcttcttccctggctgctccccatctccactgtccctgggctttcccatctgtctcctgggaaagctgccaaatcacaggtctcaatttccttgtgaggcacaaaatagttgctcattaaccttctgttgacttaattaagtttttaattccttgatttgttttccccagcaactgaagacaacttagtcataataaacattcacttccaggggtcttgcagtttgctgacccctctcattctctcatggagcaaacattttcttgacctccttatctgtcattggtcctcacagcaccctggggacactgaggcacagcatgtacgacctgccctggagctcacagccaacgaggaaacttaccgcatcccatggatcttccaacactccatgtgcacttggcaaccaagaaattttattcttctctagcactgaggagctgtgccctggggtggggtctgtacctatccaaggcacatgctgtcacctgtagagtgtggatagagggtccttgcattaggttctggaaagtgtcttcaaaaacggatttaggcctacacccaaaatctcctctctggcacaaattattcatgatcaggatacatctagaggcctagaccaaaattcaccacctccctcctgagccagaatggaatggaggaggggactggggaccccagataatttccccatcaccactgtgactctatggccacctcctgcaacagttagggataatcacataggaagggcttcatgtatcctaggaaaaacacccaaagtcatttatgagctctaccatgaccaagtgagcccaggagtcgggttgagcacagcgtggtgtggagatatctgcagagaccgtggaaccagtttgtaaaggagatcctgtaggctgagggtgagagtgcaaggccactcctccccctctctgcatcctttggggctaagcccttctctggaaaccacaaagctcctccagtagcagcccttgactctgctgatttgcatcacaggctgctctcttcagcaaggggataagagagggctggaaggaacctgcccagcctgggcctcaggaagcagcatcgggggtgccgcagccatggcctggaccgctctccttctgagcctccttgctcactttacaggtgctgcccccagtgtcccagccacctacccagctccaaggctctgggtccagcctggcctgacagtgatctcagcagggccctgcctgtggtgtgcaggatgctcatgatcctgctgcagggggaggggctgctggaggtgaaatccccccacactgttcttctgtgctcatggtcccctgaggacacttctattcctgaaactcaggccaggcaggtgggaaggcattgttgggttgagcctctcagtttcaagtctattctattctctccccttttcttgcaggttctgtggcctcctatgagctgactcagccactctcagtgtcagtggccctgggacagacggccaggattacctgtgggggaaacaacattggaagtaaaaatgtgcactggtaccagcagaagccaggccaggcccctgtgctggtcatctatagggatagcaaccggccctctgggatccctgagcgattctctggctccaactcggggaacacggccaccctgaccatcagcagagcccaagccggggatgaggctgactattactgtcaggtgtgggacagcagcactgcacacagtaacacaggcagatgaagaagtgagacacaaaccctttcgccatctatgtcaccctctttctctaattcaaggaggactatgaacaaagccttacgcagatctggttaaattctctttaatctctgcccccagcctgtccctccctccagtccttcaggcggggtctgcagaaagtgcatcagtagttcatttagggtgatgtgatcaggatggactggtgttttggtgactcagctgtgacttgggaaaatagggcctgcatggaagatcagactgaggtagacatccacagttgtctctggatttccataggtggtgacaggccagtccttgccccaaatgtcctagatcagtccccagaactgcccagctcaggctcctgtggtagcctgtcattctttagagaaacaccaatggagtagacactgtgggatctgcccagatcccctgttctgagcttacccactaagcactactgggagcttctggcaggtcagagctgtgtcctcactggaaagtgctgttcggtgcagaaaacagactcctccaggtctatgccctttctcagtgaggttagatttcatgactgcctgaggccgagttctcgactctgcctcaatataggaagacctgaaaatcctcccagctccacagctctctgtaggaaagacttgagacctcaatgagggtcagggtctcctgcccagggttgcctccctcacctcctttcacatcctctgtgcatgcaattcctcatctcagagtctgcttccagggaacccaattaagatcaccagccatccccaacatgggccatgtgggacttcaggaggccactgtatgctggaaagcacctgtttattcctaaattagcactgtgagtatccacacgcccaatgagatctgagtgtttcttgcatttgcatggaatgagaagggagcctgactcgccaggtgctctggggtctaagggagagttggagtcagatctccctgcagggaaacctggggcaggaggagcagccttaccccatgcagggaccacagatgcacccacagggtgagcttaagtatggacactgcctacctccaccctccacatcctgtgtaaaaaatcattctttccacccctcctccagcctatcaaagttgacacttaaaaagccaccacaacccacccttgtcaacaggaaacccattcacatctccatcagccacacaatctccacataaagattcttcaaaaaataataacaatagccatgcaaagtatatgatatatatcataaataattgtacttagattatatatgaaaatgatactctttttgatatgctaggtaaataaaatacattatttaaactcattgacttcttctctttgtatttataacatgatgactagacagtgggattcccatgaggctcacatcacattgtgattgaacaaggctggtctgcagggcttcaggttacaggggctgtggagtgacctggtgcaggaagccccgtctccatccataggacatcagtgtgaacccagggagaggcgctggtataagagagatgagaacacaggtgtgaaccacctgcttgtgcaggggactgagccttcactttgagccaaataagttttctttcccaagttcgatcctgaacaagagggctttctggacttctttttgttttcaggtttgtgccccttcaggtttggggctgtctggagtcccagccaggggacagtgaggaaatccagcagtctcacactgactctgttgtatttcatctgctggggccatcccaaactgctgcgtaccatttcctttcctggtgctcaaatagctgctccatgcacttgtcatggttttatagctcaatctagatgggaagacaggatagtgtatgttacaatatttaaatagaacctgaatcccttaatagttattttaatatggaacattaaaagagttgcatcataggcaatggggaaagatgaagaaagattaaacgcatttggaggaaaaactaaaaatgtctttattgaatgtctgtgtgtcttcagtgacgaagggttgagagaggtcagctttaggttgtcctgaggatgtgctcagatgggggaaagtaagaaagcaggaaacgtgcatctctgtgacctgacacataaatcacagtaaaatggaagtaaatctttcaataaacctttcaagataacatcactctggtgcacatagaaaggcctgttagcaaactttcccttttccctgctggctcatatccccatggatcacctgtatgcagaacggactctgtggtctccatttatcaggctgagaaccagaggctgggaaggacaagtcacctgctcatgagtgggaggggcaggattgggagcagcggactcaggctcaggactgtggccctggttggtgctccttgttcccttcacagggtcccacccacatgtgcccgtgtggatgtgggtgcactgcctggggtggctgatgtgctccagggatttgatggtgcagatgcttcaggacaaagcatgggagtggggatgggacgagctgccgctgggcagaccaaggaccaacgccacccagcagaggcttccagtggggttgggcagccccatttcctgagaatagagagaacctggcaatgagtgccagaaagaagttacttcgaggtgtgcccaggcctggagggtcacagagacacaggcaccacacagcagagacactgaaggccaagagctcactcaggtgaagggcttcaacagatttttctctcctgagcaaatcacgtgcaaagaaatcaacttcctgtcatcagaatagacaatcaggactttagtctccttggctgagccccgctgtcaagggaagcagaagtctctaagcccaggcccaagtgagggtggggtgagaagaggagctcaggatgcagatttgcatggaggtcccgcccttctctgaggcagagggataagacagggctgggggcaggcccagtgctggggtctcaggaggcagcgctctcaggacgtcaccaccatggcctgggctctgctcctcctcaccctcctcactcagggcacaggtgatgcctccagggaaggggccacagggacctctgggctgatccttggtctcctgctcctcaggctcacctgggcccagcactgactcactagactgtgtttctccctttccagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttccacagtgttttaagtcaatgaggaagtaagatcaaaacctgccctgggctctcaggccccttcttgctctgcagatgcttcctcacgctgtataagggtttcctgcaggatggccttgacaattctcctctctcagctcctctcctttcccaccatgaggtctaaaaggaaacctgctcgtgatttctcgttcaggactgtggcaacttccttttgcttgtgtgctctggtcccttaacgtgcaactattcctagctcttcaatgcagggacgtagggacaaggagtttactgcttggtgcagtccctcctgttttcaggaacatcctcattctaaatgcatcccccatctgccacactatgcagatcaatctggacagaagccatcagggggatggcttccagtttccaggaattgcatcttgttccactctgtgtccaccacgctctaatgaagatggccctcctagctggtctattcctctgcacctgggtcctgaagcagtgaccactttaagaagacttgaagatgtttttgagggattaagaacaaagaggatgctgctgtttttctttttattgctcctgctctttgccgaaattcctcaggttgctgagctggggagattttgagtgacaggctcagtgctctcgcagaattctcctcccctcacatcgctgaggccctgtcctggaaactcctcacaagtggacggtcttcccataggatgggggattccaaaatggctccacaggaaagagttaacctgagtccacctcccttcctcatggacatcgagcatttctaattttcatggctgtcaatacttttgtacctggaatccctaataatctaatggtgagaattgatttagaacacattcggacattagctgggtccaatatttaaattttctgagccagttgttaaatacagctattatcatatatagtttaggctccttaaacttcgattatacagattatatttaaaacaaagtaactagtttactatatatatttacaaagtaactactatataacatcatgttgtgtacctgaaatataaacactaaaatttatttcaaaaaccaaagtgtattgtctattgatgcataaaaaaacactcacaaaacttagcacactaagagaacacatgtctgtgaccttgtgacttggatgcacctagaattgggagtagcttagtttggtcattctcgctcctggttaatcacgaggttgcagccaagctgtcaggccaggctgcattcaggctacatctgccaaagaggttaggaactgtggaagcctccctctggctgtggaagcctccctctggctgtggaagcctccctctggctgggagacttccgcagttcctaacctctttggcagacgtagatcatctcaaggataaaggagagagtggagtgaaggcccctgtccttgtcctccatgtaaaaggccatcccatgcatgcactattttttattctttgctgagacatcctaggcatagagcactgccccattcattcaaaggttgtagagtattctatggtagaattttagccaactcacttttaatggttattatcactattttgatcttataaataacactgcagcgaacatccttatgtagactcctttgattttatatgtagacatgaccatagaataaatttctagaagtcaaattgctgagtcaaaaggatgtgtgcttgtaattttcactcactgtcctcagattctcctctagaggggttatctacaaattcgcaatgtcagccataaatattcgaacagagtacactggggaaagtttaaatgtttttcaacctagcagatttaaaaatgttatctttttttagttttgatttctcctgttctgcttgaagttgagcattttctctaatacttcagtgctatttatttttataatttggtaaacattttcttaaatgtccagataagaaggattttggtctgtggttcccaagagtcaactttgaggatattctgtaggtatttttagcaccatttatagtgtaaccatttaaacctataaaaaccactctcagctctggggccatggaaaaacaggtggcaggacagggatggcccacaggatgtggtttaacggtccctgatttgtagggtaatttgaagtttgagaattccaccgcatatgttctaggtggagatctctatttgaaggatactgtattttacctcctatagtggcctgaggcttttggataagaacatacttgtatcatctatttaattggatcttgggtcttcccaggacagccctgtgtcacagtctcatgtttttcatctcatccatttgctctgagttttcagaaagctttagtatatcagaaatagactgaccctaggtggaaaatcagaggtaccgggagcagcaaatggtcagggaagcttgcaccaactctggaataaaccagtacaggctcagagaaaaacatcataaaatcagcattgtagctgaaaccaaaaacatgcatgatctttgaagttctggggattataaataaataaatgaagtttaaggtttaaatgtgttgcaaatttacataaagcatgtagattttaaaactcagaatgcagcaatgaaatatggaagcttgagattttaagctgttaaggccctacaacaaattgccaggaacagaacaggaacttgatagtcataatgtcttatgctggaaattatcattttctctaaatgaaatttttttcccttttttcttagacataaggaaacatctcattgaacacccttcttttccactgtcaaacacccttacccagaaaggaactgtaacattaagtaggaaacaactgctttttttcataactattgagagatttctttatttgcacatcaaaatgttgattgtcaatgctaaaattggaattagtagtttaatatgcacacaagagattaattttgtttggattatcccatttctgtctattatttgtcttagttaactcagacatattctgcttttggtattttttgttttattttctttgccaactacatgtaaaccaaaaataaaattctaatgctcccccaacaaccccaccatctgagtggactctcttctcttggtgggggcactccaaagttaatctgaaagactggttcaggccatggcagaaaaggggtgtcagacatgtctcattaagcccttttcctttttggaattcaggaaaagccaacctgcacttaacatcaatacaaatcttaagtctgataagaaacatttacaatctattctctctgaagcctgctacctggaggcttcctctgcatgataaaactttggtctccacaacttattataacccagacattcttttctattaatactttcaaccaactgctatcagaaaaatttaaaatctatctataatccagaaggccccacaaccctgcctcccatcaccctcttgttttgacttatcctgcctttctggactgaaccaatgtatatcttgaatgtatataattgatatatcttgtctccctaaaatatataaaaccaagctgtgccccaacctccttgagcacaagctctcagggtctcctgagggttgtgttcaccagtcatggtcactgatacttggctcaggataaatatcttaaaatattttacacagtttgactctttgtcaacatatggctcttttcaaaacaccatttgacacccagacataacccgctgctaatgattacaaaattcaattttattagcatttaaattattactttaaattatttcaagaatgcatggatgtgatttcccccacatctaactcacaaatgttgctgatgctgacttgctcttttctttcagtcttagcaaataaagagggagtttacttttcttgataccagaagataacaggagaaagtaggtgaaactcccgaaagctgttatcgtttccaccctcaggatgaatcacacaaggagtcacctgcacttcatttggatgataaataaatgagatggatcttagagttggtgctgatctagtcaatgatttgggatgttgggctgaggtgaatgtgtttcacaggtgagaaagacatgagttttagagtccacagtgtggagggttattggctgaagtgtgcccgagaattcatacaatgaagctctaatcacagtgcatgaatgaattggaacataggtctttaatggggtgattaagtgaaaatgaagccagtaggatgggttcttttccatctgacaggtgtcctctgaagatgaagaaatttgagcacacagaaatgagacaccatagatgagcatgcagaggaaagatcacgtgaggacacagaagaagggagtgatttgcaagccaaggagatgttacagtagataactaggcagacgtgacagggcaggagaccccctgccccaggaatgtcacgcaagcatcagatgatggtcaggtagttgttaaactgtctctgtgaattaataattagtcacagccggcaccaaggaaaggcggtctcccaatagatagaaaatacctgaagctggtgatcagcagctttctgataagatctcaggccttgggtgagtgggctcaagcaggcaaactaaaaggcaaaacagaggccaggcatggtggctcacccctgtaatcccagcactttgggaggccgaggtgggccaatcacttgaggtcaggagctctagaccagcctgaccaacatggtgaaaccctgtctctactaaaaatgcaaaaattagccaggtgtggtggtgcatgcctataatcccagctactcagaaggctgagccaggagaatcacttgaacctgggagatggaggctgcagtgagccgagattgcatcactgcaccccagcccaggtgacagagcaagggtccttcaaaaaaaaaaatgcaaaatagcagagtttaacctggatctgagactcccatgctgcccttccctccagccctacaggcaggctctgcagagagtgaatcaccagtaaatacacaaacaaatatgattacgttccttttgtttaagaagtagaggaatgattgaatatattaagtgaaaataaggaataccaacacaaagaaaaatttaactgtaagtatggttaaaaatacactgggtgagatagacaagttagatgtcgcaaaacaagagattagcaaactgtatagtgtaacactagaaactattcaaaatgaaacacatagcaaaaaataacgataaaaataaacagcatcaatgagatgtaggagaacttcagacaggctaatatacgtgtaattgaagtcctcagaatagaagatggggtaagaatgaaaagaaaaaatatttgaatgaataatgacaaaatatgttccacatttggtgaaaaccataaactgatataacccagaagctcgataaaacttaagcataggaaacacaaagacaacaactccaaaacacatcataatcaaattaataaaatctagtgatgaaaagtagtcatttaggacaaaactacaaagagcagatttctcattaggagcaatgcaagcaagaagatagtgaagcaatgtcttgaaaataataacatgcaaaatccaacaaccttgaattctttatccaccagaaacatctttcaaaactggaggcaaaataagactttttcagacatgtgaaatcctacagaattgatcaccattagactctcgctattagaaatgataaaggacacccctaaacagaaagaaaataatcctacattgaaatgtggtttgacacaaagaaatgaaaaatcagatatggtagctacctggatcaattagaaacctctgtattatgtaatgtctataaaaagaacagtaatgtctataaagagaactgttcagagaaaaattaataagaatacactatgatttgtaataaaaataaaagcaaactatatgacaaagcagaaaagcgaaggtgggtgaagaacatgtaataatggttttgtactatatgtgaatatataatagcacctgaaggtagattttggtaagttatgtatttactgtataccctaaaacaaccattaaaataaaaccctcaacaaaaaagaaatatggctagtacgctatattagacttgtccaccaaaaattaataggatatgtatggatatgaatatatatgtataatgtatctatatggtgagagagacagacagaaacttattttaagaagctggttcatacaatagtggtggctgatggacaaaatctgttgggcaggctataggctggaaatttaggtaagagttgatattgccgtcctgagttcaaattctgcaagaagctaatgtttccccaagacagcatcagctgttattatgcacactggctccaaatcgaggaaagtgtcccccctgaccattagcagagctcatgccaagaacaaggctgatcattaacatcaatcactgggaaacttcagtatttattctaaaaaccttgaactcattaatgagactcacacacattgtggaaagtagtattgatacaggagacagaaattatttaggcagatagtgagggtgacagggtcctcagcagagcttctcatctaacaaaaagcagccctaaaaatcatttcttttataacaaagagcagcctgaaaaaatcgtgctgcaaacatagataagcaagctggaagcttgcatggggcaatgccagcagctatgccaatagaaaagtactacctgggggtcagccatgtccaacatggaggctccatcttccctttttttgtcaccatgtgtatagcaatagagaaatgggcaacatggagcagctcaggcagataacccacctgcgtaataacagattagggcagggttggccagaaatgtgcaccctatgcaaatggtacacctagtcctaatcagtttttcatgccctgtgcaagtagcacacctggtctaaccagtctttgacacccaccttatgtagatcagatactgcctcctcaccagctcatctataaaattccctacatttcactgcagatccggcaacccatttttctgggtcccctctctgcagcagagagctattatctttctttcacctattaaacttctgctgtcaacctcatttgttgtcagatcatgtcctagttttccatggccctgagacaatgaactttgagtattcaccccagacaatgaggctatttcaatatgcttatacaaagtctactggtttgaatatttatcacatttgaaaaatatcttcatgacaatgtctacactggtgcttaacaaaatcaacctggtaccatgtcttagccaatctgacacttaaaattcaccaccacttaagccaggagctaaagaaaaccaatttttaaaaataaatttcaaaagagagaaaaaggaaagaggaacaatgaacatataagacaaatagaaaaaaagagcaagatggtatattttaacaaagtatattcctaatcacattaactataaatggtctaaataccacaattaaaaggcaggtattatcatctatattctaaaggagttcaggtagggttggtatgctttcttccataaaaatgtgataccagtgaagctatttgggtataggtgggcttttcttagcacggagattttaaattgctactttaatatctttaagtgtcatagacttattcagattttctatgtattcatgagtcaattttcataatttatgtctttccagaaattttacttcatttatctataattttggcatttactgttcataatattccctataaccattctcacccttttagtgtctatagtgatgtcattattttagccatggttttggcaacttgtgtttctttttcttttttttatcatggtcactttacctaaagataaaaatctattgattttattaatctttttgaagagccaagtgttttttttttttttttttgaggttttctattgttttcctattttctatttcatgaatgtttggctgtgatccctattattaccctctattcacttagaatttgaatgttcaccttttttaggtttatgaggtagaagcttagattattttctttaattctttcttctttccaatactaagcatttaatgccatagtttttcttcaaagcagacttagctgcattccttaaattttaatatgttgtgtttttatgtttaaaaaggttcagtatcttctaatttatgttgtgatttttctttgattcatggattacttaacagtctgttctttcactttcaaataattgaagatttcctatggttcttccggtattaattcaagttaattagttaattctgcattaaattatatcttctatgattttcatcctttcaaatttatcaatatttgatttatagcctaaactatgaactatcatgaaaaatgttccatatgtatttgaaaagataacatgtattctgctgttgtgggtgcagttttctacaaatttattataattaagataacttggcaaatggttcaaatctatattcttactagatttctgtgtagttattttgtagatctctgagacagagctattgaaatgaacaacacaaactgtagaatttcccaatgattattttgagagagatcatttttaaaatcatggatctaaataatttattctcctcacaaaatgtcttctatgatttccaaatactaatcaagggaagaaggcagagttaaactcacacttgtagataccacgggaacagtgagtgatcatgtgatgtgcctccagaggttaggctaatgtagttagagtggtttatatttatttatttatttatttatttatttatttatttatttagacagagtctcgctctgtcacccaggctggagtgcagtggcgctatctcggctcactgcaagctccgcctcccaggttcatgccattctcctgcctcagcctcctgagtagctgggactacaggcacccgccaccacgcccagctaattttttgtattttttagtagagacggggtttcactgttagccaggatggtctcgatctcctgatctcgtgatccgcccacctgggcctcccaaagtgctgggattacaggcgtgagccaccgcacccggctggttttttttttttttttaaacacacagttgggctaaaatatccatgaaaaaatttgaagcatgtaccttgaataaaatatgaaaatcaaaaaagttaattgcacacgtacaacattgttaccacggtgcctgccgcatgggaaatgaacaacaagtgttattaattcaattctattttcttacacattcaatgaatatgtattgaaacaaattcactgaatggtcccagatactgaataggtccttgagatgtactggcaaacaagacaaaaaaaaaaatacatgttctccgggtggcctcatggaagatggtggagtaagaagctccaagaaatggtccctcctgtgatataactattgaagtggcaagaaccatcagcattcactctaataaaactatggtatctcatcccatatttgcagcatccagggaagagctgaagaagaaagagacaggcttaaggaagtctctgtcaggtagatctctgaccacagagataactgaacagaaatttcgtggatcactctgacaagaaaggtagtccttgcgaaaatattcaggaaaagtcacaacacaaataaacaactgcacccctcagatgaacaactgcacaatatcagccaaggggcataatctgataatctgatcctgggagttaacaacatcacaatattcaaaatactcagatctcaacaaaaatttgcacagcatacaaagtcacaagagagcacgactcattcccaggaaaataatcgactgaaaatcttccttaagaagcattcatttgctcccatcttctcccttggttatataacacgtccttccacatatacttgattagagcttgtgccccacaaacatgcctggcatgtacattagtgacttctgagagggaggtgggggcaggaaacagtccctctggatacatttcgcatcacatgaaccagtgaacacatctctgcaaggtcctgcattctaataaacaagatttttctgtttaaaagaaaacttaagtctttcagaaaactgcatttcaaaagggaaccttgtctctgctgcttgggctgcagtgaggacagatttactaagtgctggttgctgtgttttgtcttctagtgtgggtacacacatctagaaaagttttaaagaagattggggaacccccacccagcactggtgggactttgagtttgctacggttgtgaacagaacatggaacagaggacaaggtggcccctcctgaagatgagagttttgcttcttgctggaagtccctggactcctggagtgttctcaggggacctcttaacaggatctcaagggaaagaatccagggtactggatccacacaatcaacctcacggatttctgagtaggtcattaacctatcatgcctttagcgttatctcaaattatacatggtatcatctcaactaatgtctaaaacaatatacggcatagatatctaaagaactagtggtacatggaggatggctttctacctctgagccctagaagggactgtgggccttggtttggggactctaatgactctaagtcccctggtagtgctcaagtgcaaagggaatgactgacgctttttttgaggccccttctattgtgtaaaatttattctgtacttgtgacacccacctggtccttcttctgaacatgggaaattgccaagatgaagtctccaggctaacggctcagacaggagctcagataaacatgctgggaagtggagagcaaattgacattcaaagctcctcccaacaagcttcaagaagagggtaacacaagaagtccttgtaaccaggttccacggggcagcctcaagcagagctcttggaagtccctcccaccacggtctgggtctccttctacctcctgcccttcattttctccacaggtcagaacatccagggaattcagggaaaccctttcactgctatttctccacaagctccaatcctcaggggcattctttccagttctcccgagcattcggcatcattcatgaaattctatgtttccaggtctctgtgctctggctgtgctaactcagcccccgtctgcatctgcctcactgggagcctcagtcaagctcacctgcaccctgagcagtgagcacagtacctacatcatcaaatggtatcaacagagaccagagaggtccccctagtatataatgaagtttcacagcgatggcagacacagaaaggaggacaggatccccaattgcttctcgggctccagctctggggctgactgctccctcaccatgtccaacctccagtctgaggacgaggctgagtatcactatggagagagccacaagattgatggccaggatgggtgagccacacacagtgacacaaagggaaagtgaggccaaaaccccccacctcccctttctcctcagggactcagagtcagcagtcacatgtccccttccaagtccctgagacttctgactctcctcctgcagagacacccctaggcagaggcagatgcaggccatgatttaggccattttgacaactcatcattctgtctcctcaacaccagtctgtggggaccatactaggagagaccagagcagcccaggcagaaggaccctgagagagtggccaggctgagatgaccgtgtcccagtgtctcactgtgccctgtgctcccttaccgggctctgccccaggaaaggacatggatcttgacctgtcaccccccatttatgagagttcaatgtgtgtgcatcctcgttagcacttgatattgtcagtttttccttaaagtctttcagatagagctgtagcgatatctaattatgtttttaacttttatttctttaatgacttattatgctaagtatcttttcaggtacttatctgtcctttgtatgtcttctttggtgaaatatttaatcaaatctttgcatttttaaaattcaggtttctcaggttcacatttcctcatgtatttgtatgagtttatatgcatgcatgtgtgtctatgcattccattctgtgtgatttcccaacatgtatcagcacaggtatccaccactacaatcaagacacaaaccaggtccatcacaacatttcctggtgtttccctttgataatatctacctcctcccacccagttccctcccttgcccaaccctggcaaccactgatttggttccctattcctaaaattttgtcttgcaaaaacgtgatacaaatacaaccctattgtagtagacagactttggggttggaattttttacttagcatcattccctataaagtcattggaaaggtgtgtgtatcaatagtcagttcctttcaattgctgagcagtatctcttggtattagtttaacaaaacctgatgaattactcacccaccgaagggtatctggattgttttcagtttggagctactacacctgagggtgctacgaacatcagtttgtatgtttcttgtgaacataagtattcagttctttgaaatgaaggtccaatattataattgctgtgtcatacactaattaggtctttagttttctgagaagctgacaaactgttccctgaagtgaatgtaacatttttttctggccagtaatgaaggaatgatcaaatttctctgcttctttgggaattgtgtgtttttactctttttttaggtaactattgtgataggtgtgtagtgatattccattttttaaaatttcatgtctctgatcgttaatgatgatcaccttgtcctgtgcttatttgccatctgtatgtcctctttgatcacgtttgtgccctttgcacattttctaattagattgtcttttgttttgctcttaactggtattcagtgttgggtgttttgtttttttgagacaggattttactttgtcattcagcctggagtggagtgatgcaatcacagctcactgtagcttggactttcctgactcaagcaatcctcttgcctcagcctcccaagtagctgggacaacacgcacacacactgcctcactaatcgtttacagaattttctttgtagagacaagatctccctatttgcccaggctggccacgaactccttaggctcacgcaatcctccctgctcaacctcccaaggtgttagaattacaagcatgagccaatgcactcggccagttttcactgttctttatgtattttttatactagtcatttactggatatgtgattggcaaatacttaatgccagtctgtagcttctgttcacatcctctcaagagagatttttgcaaagcaaaaattgatggttttgttaaggttcaatttatcagtctttcatttcatgacttgtgtacttggtgaagtctaagaattctttgcatagacatagatcttgaagattttctccttttttttttctttttttttgacagagtctcgctgtcgcccaggctggagtgcagtggcgtgatctctgctcactgcaagctccacctcccgagttcacaccattctcctgcctcagcctcctgggtagctgggaccacaggcacccgctaccacactcggctaatttttttgtatttttagtagagacagggtttcacagtattagccaggatggtctcgatctcctgacctcatgatctgcccccttcgacctctcaaagtgttggtattacaggcgtgagccaccgcacctagccgattttctcccatttttaatataaaaataatagtatcgctgggcacggtggctcacgcctgtaatcccaacacgttgggaggccaaggtgggcagatcacaaggtcaggagattgagaccatcctgacacggtgaaaccccgtctctactaaaaatacaaaaaattagccgggcatgatggcaggtgcctttagtcccagctacttgggaggctgaggcaggagaatggcgtgaacccgggaggcagcgattgcagtgagccgagatcgcgtcactgcactccagcctgggtgacagagcgagactccgtctcaaaaaaaaaaaaaaaaaaaacagataaataaaaaataaatctgagagatggctgagcaatttcactgagtttcatcatggaattctggcctcccaaacaccagcatggcccctgttcctacaatctcctgcttcaagatcaacccaaccctgctacccagaccagatgctagatggtcaagacagggctgtgagagctaaagaatcttcagggtccacgatgaatttacattggagcttccttttccacggatattcacatcaatagagaagatgactgagttcttgcctacctctgtgaatacctgagacatgaactgagatgtgtgtgtgcatatggtgcgggcagcacttcctcactcaatactagggagagtgtgaggaaactggatacagacctggagatagggcacatttttacactctctattaagccctgtccttctgtgctcaccaaggagtcacccaacaaggccacaacaggaagagaagcaggtttctatgaagagacttctctttttgtgatgagggcccaggaagtccactgtctagctatgaactcagaggcagaactctgatgcatctccaccatgacctgaatccctctcctctactcacccttcctgctgtcggcacaggttctgccttccagggctcagccccataagactagggatcagcctggccctgaccttcagctcagcacagggagtgacgcagtgtgtggggctctgagaatgagaccctcatcttcagactcacctctcctgtcctatcttgtaggctcagtggcctcctctgagcggactcagttgcctgcagcgtctgtggctttgggacagagggccaggatcacctaccagggagacagcatagaatacttttatgcaaacttttgtaccagcagaagctaggacaggtccctgtgctggtaatctatggtgacagcaactggcactcagtgattcctgaacaactctctgactccatatcagagaacatggccaccctgataatcaatgggccccaggctggaaacaaggctattactgtcaatcatgagacagcactgatactcatctcacagtgacacaggcagacaggaaagtgagacacaaaccccttcccacctatgtcaccctccccctccaacctcaggaggacagtggtcagagctataagcaggtctggcccagttcactcagatttgagacccccaggctgcccttccctccagccttccaggcaggctcagcagagtgtaaattaagagtggatacacaatgaattattagaattgtatttcagtttttcaagaagtagaggaatgattgaacatgttaagtggaagtatagaataccaaaaaaggactaattgagcttgtactgctaataattacagcatctgagacattaaaaacacactggatgtgattaacaacagatgatgcaacacaaaagattagcaaactcaataatgtagcactagaaaatattcaaaatgcagcacataaagaaaaaataatgatgaaaatgaagagagtgttacagtatatttatagaaaaaatgaagagtgagttataggacaacttcaaacagcctgaggttggctgggaggggtggctcacacctgtaatcccagcactttgggaggtctcggagggagaatccttttgagactagaagctcaacaccagactagacaacataacgagacttcatctctacaaattttttttaagaaaattaactaggcatcatagcctgcagctgtagtcctacctacttaggagcctgagacaggaagattgcttgagcccagaaattcaagatggcagtgagtgaggtacgatcatgccactgcactctaacctaggacacagagcaagttcctgggtctcactctgtggttcaggctggagtgccatggtgcaattacagctcactgcagccttgacttcccaggcccaagagatcctcccagctaagcctcccaaagtttctgggactacaggcatgcatcacatgcctggttaattctttgtattttttgtagagatggggttctccctatgttgcccaggctggtcacaaactcctgggctcgagcaatcctcccgactcagccccgcaaagtgttgggattacaagcataagccacgccacctgatgtgaagaaatatttaaatacaacaacctaaagtatgtataattgacatccatggaatagaaaagatgaggtggagggtcagtagaaaatatatttgaataaataatggccaaatatgttccacatttggtgaaaaccaaaaattggtatatccaagaaggtcaacaaaactcaagcacaggaaacatgaagaaaacaactccaaaacacatcataatcaaattataaaatctagtaatgaatacccactttaaagtttaattccaagagcacatctctcattagaagtaatgcaaggcacagtggaacaatatttcgaaaatgctgaaaggaaaaacttgtgaaccttctgttatttatctaacagaaataacattcaagagcggagggtaaataaaatgttttcagacacataaaaacttacagaattgatcactatcacttttggcattagaaatggtaacagacatccatagacagaaggaaaatcatacccagttgaaaagcaaattcacacgaagaaatgaaaacttcagatagggcaatgacatggatacctatagaaacccctgtattatgttaacatctatgaaagataactgttcaaaggaaaattagtaaaaaaatcactgtgatttattgtgaaaacaaaattaaattatatgacaaacagcacaaaagcagagaggagtgaagaacatgttataatggtcttataccctgtatgaatatctaatcacacttgaagacagattttggtaagttatatatgtaccattaaccctgaagtaattattaaaataaacccttttaacaaaaaagaattatgactagtagtaacctgtattaggattctccacagaaacaatatcaatcagatatgcgtgtgtgtgtgtgtgtgtgtgtgtgtgtattgagagaaaaaagagtgaaagaaatgtattttgaggaagtggatcatatgattgtagtggctgacaaggattaaatctgttgggcatgctgaagtctggaaattcaaataagagttaatgttgcggtcatgcatgcaaatttagcaagccagcacatcaggaaatctccatatttgttctaaataccttcaactcactaatgagtcccacctacattgtgcagagcaatctgcttatacaaggtcaactaattaaaatgttcatcacatctgaaaagtatcttcatgttaactcctatactggtgtttgacaaaatcaacctggcccatatcctagcctatctgacacttaaaattaaccatcatttaagccagaaagaaaattttaaaaatatttctaaaaataaatcagaaaaggaaacaatagaaggggaaaaataacgaacatatgggatgaataaaaaatgaggagcaagaaggtatatttcagtaggattatattactaatctcattaattgtaaatggtctaaatatcacaactaaaatattgtcaaattgaaattaacagcaagactcaactatatatgctacctagaataaacctacttgaaattttagaaccacaaaaagccaaatacaaatcaacgacaatcttcccaacccctggtttcccaacaaagcattacaaaccgaattcacagggattaacacatagttaaaaaatatgtctcacttccaccaacactcttacctctcttcagcctctaatgcctagatcccagtaccagagttgcaagaaaacagggcacacaaatgttaaatcaaggttactaagggtcaccctcaagaggtaggtgaaaagagaatgagggaattgaagccacaagggtcccacttgcatggggcagctcctgcatcacaatgttgattgatacattattgatgagtttttgtccatgttcatggtggacataggtctataactttcttttcttgtcatgactttggctttggtattggagtaatgcaggcctcaaagagtaagtagaaaaatgtttcccctgctgtataatctgaagaagttcttgtaggattggtatcatttcttaattaaaaatttgatagaaatttactatttaaaactgggtgagcttttcttagcaggaagacttttaattgccaattcaataccttcaaataccatagatctatttggattttccatttcttcctgagtcagttttgatcatttatgtcttttaaggaatttttccacttaagtcatttatacttttggcattaattgcttgtaataatttccctaaccattttaacttttgtaaggttggtagtcatggcactcttttatcatggttttagtactttgtgtcctctttcatgttttcctagtcagtctacctaaaagtaaaatcaataggttgtatttatctttttgaagagccaagttttgttttttagaggctgtctattgtttttttttgctatttcattaatatttggctctgatctttcttattaacttttcttttttttgctttgaatttaaatgctcacctttagcctaaatttatgaggtacaagcttagataattcattttagatctttcttctttccaacattaagcattaaatgcaatagatttccttcaaagcactgatttaagctgtatttcttaagttttgatatgttgtctttttgtgttttaaaggttcagtatcttctaatttatgttgtgttttttctttagctcatggattacttagttgtgttctttcctgctcaaataattgaagatttcccatagttcatcaggtattaatccaatttaattaattattttggcattaaataataccttctatgatattcatccactgaaatccactaagatttgacttgtaacctagaacacagattatttcaaaatcatttaaaaatgtgctaaatgtatttaaaagcataatgggtattctgctctcatgtttgaaagtgtaatgggtattctgccattgtgggtgtagttttctacaaattcaattaggataaattggctatttgggaggctgaggcgagcaggtcatctgaggtcaggagttcaagaccagcctggccaacatggtgaaaccccgtctctactaaaaaataatacaaaacttagccaggcgcggtggcaggcaccttaatcccagctacttgggaggcagaggcaggagaatcgtttgaacccaggaggcagaggttgcagtgagcctagataaagccattgcactcaaacctgggggataagagagggacttctctcaaaaaaaaaaaaaaaaaaaaaaaaaaagataaattggctgatcattcaagtctgtatcttgattgaatttctgtatagttgttgtgtggatcaatgtcagggagctactggaatgatttaacactaattttagaatttctgattgattttttgagagaggaaattttcatgggtctaagtactttattcttctgacaaaaggccttttatgatttcccaagactaatctaggaagaaaaggcagagttcaagccacagttggtgataccatgggagcactgaatgatcatgtgaggtgcctccactggttaggtgtatgtaaatgaagattttttaaaaaactaattgggaggccgggtgcagtggctcatgcctgtaatcctagcactttgggaggctgaggcaggtggatcatgaggtcaggagatcaagaccatcctggttaacacagtgaaaccccgtctctactaaaaatacaaaaaaaaaaaattagccgggcatggtggcaggcacctgtcgtcccagctactcgggaggctgaggcaggagaatggcgtgaacccaggaggcagagcttgcagtgagccgagatcgtgccactgcactccagcctgggcgacacagtgagactccgtctcaaaaaataattaaaaaattaaaaaatacaaaacaaatctgggctaatatgtccagaaattttgagaaaatgtatgttgaataaagcatgaaaatgtaaagcaaggtgattgcatatgtataacattgctaccacaaggccaacctcatgggaaagaaacaaaaactgttagcagttcattatgtttacttacacactgaacaaacatgaattgaaaccaattcaatgaactgtcccagatactgtttaggtacttgagatgtattggtgaacaaaagagacaaaagtacctgatctcacagtggcattatgaaagatgatggagtaggaaattccaggaaatggtcctttctgtgaaataactactgaagggtaagaaccatcagaattaaccataataaaatgaggaaatctagtcccacattcgcagcattgaggcaagtactgatgaagaaagaaacaggcataagaaaatctctgtcaggttaatttttgcccatagaagtaactgaacagaaactttatggatcactctgataacaaagtccttgcaaaattattttggaagagtcaactacacaaacgaataactgcacccttgagcagcaacatcagccaagaaggagtagggagacaatctgattttgagagttacaacatcacacattcaaaatacacagatttcaacaaaaacttaaaaagcagacaaagttaaaaggaagcatgacccatttacaggaaaaagtttaatgaactgaatgtactcacaaggaagcaaaggcattggacaaatgacacaaatacttcaaataaccatttacatatgttcaaaaattcaagaaaaccatgcgagtaacaaccaaacaaaactggaagaataatgttagaacaagtgaggactatcaataaagaaaaagaagttataataaaagaacccaagcagattttctagaactgagaagttcaatagctaaaatcaaaatttcatcagataagttcagcagcagtttgagcaggcagaaaaataatcagtaaacttaaagatacattgttgtaattacacagaatgagcataaattttaaaagaataaataaaatgagcagagcctaagagatacatgggacatcatcaagcatatcaatatacgcattgtgggagactcagaaggaagagaaaaaagaaagtataaaatacatgtaaaaataatggctagaaacttccaaaattgatgaaagatatgaatctatactttcaaggagctcagtggccttcatcaggttaacctgacacagactcacagtgaggcacaatatgctcaaaccatcgaaaaccaaatacaaaagaaaaatattgaaagcagcaagagaaagagactcatcacaaacagtagattctcatgaaattaacatttggtctttgatcagaaacaaaacagtccaaaaggcagcacaataatctataaagtgatttataaaaatatattatctaccaattctgcatttagtcaaacaaatcttctaaaataaaaaataaaataagataatcatagataagcaaagtttagtagacctggtagatctgccctaccagaaacactacaggaagtccttaagtctgagaaaagacactacataatttgaatacatgtgaagaattaaagatctcttttaaatataaagctagtgctgttgtattgttggtatggagctgctgtgttttccatgttatttatgagatatatggaaaaaaatcaataattataaagccatgtacataggcacaaaatgtttaaagatgttatttgtgacattaacaaggtctaaaaggagaggaaatggaactggataggaacagaattaatggatattattgagactaagttcgtagcaattctaacaattttaaaacattaatcgttactccaatgataactagtaaaaactaaattgagtgtataagggaaagaaaatgaagaaggaatccaaatggacccagaaaaaaattaatagaacacatgggaaacaattattggggtaatttaggaacaacaacaacaaaagataaaagatatgtagaaaacaaacagcaaaatgacagactttctttgttatcagtgattactttaaatataaatggattagattcaccacttgaagcaaaataacaaaatgaaatttttaaaagtaaaaaaaaaaaatagaatccatgatctatctacatggtgtttatggagaaccaatttagacccaaagacacaaataggttgagtaaatagtaacaaaagaactggtgtggctgtcgtgacatgatgcaatattgacgttaagtgaattatagttgtaagtgagaaaaaagggtattccttattgataaaatggtcaattaatcaagaagatataatagttatacacacgtatgcaccaagcaatagcacttcaaaatatgtgaaggaagacacatttaaaataaaagctagagagatctataatataaattggagacttcagtaccccactttaaaaaagaatagaacatatgaacaaaagattaatagaaaatgcagctattgaacactataatccagctagacctaacagatatatacaaaatactgcacaaaacaaaagcagaatacacatctactcaagagcacatggaacattctccagaatggacgctattttaggccttaaaacaattctcaacagttttttaaaacttgaagtcatacagggagtcatctaaaaccaccaggaaacgaagtttgggtaggggaggaacaatatttccttctactcaacttagatttattggccagcagtccctatcacacaagacagattaaaaaataaactcatgcacatttattaaatataatttttacttggcatgggagctttaataaggaaatgaaaactcagagaaatggctgaacctgaggactttacatttaggtatgatgaggagaatacaggtgtggagaaatatgactaagaatgaagtaaatgcagtaaatgggggaaagagcaaggcctgtgttcattcttctcagcacaccttcattttagaggaaacaatgctctcttttcctcttctttctaatcaacaactcaactttacagctcatggaacaagaaagagaaaagcaaacttaaaccaaagtccacagaaggaaagaaataagaatcattagaccagagattaaagaaatagatgagaaaaaaaactataaagaatataaatggcataaaaagttcctacttggataagaagaagaaaattaacaagctgttaggcaaaccaactaaaaccataagagagaagacacaaataacaaaaataagaaatttgggataatacaaccaacgttatgggaattaaaatgattataagagaacaccataagcaactgtatgtcaaatctagaagaaattgacaaattcatagaaaaatacaaattaccaatctaactgaagaagaaataaaaaatcagcataagaaatagattaagtcggcaattgacaatttctctaaaaagaaaagcccagagccagatgtcctcactggtaattctactagagatttaaggaggaagtaataccaatcatactcaatctcttccaaaaatagatgaggagggaacactgcctagcacattctagaggccagcattagcctcgtagcaaaaacaaacaaggatactataatacagaaaactattggctaatactcctgaagaataagcatctaaaattcctaaattaaataagagaaaaccaagtctaactacacattaaagagaacacatggaatgaaaaagcgagatttatcccagaattgcaaggatggttctacataagcaaatgaatcaacgtaataaacaatatcaatagagtgacaagaaaaagcatatgatctcagaagatgcagaaaaagcatttgacaaagttcatccactttcaagacaaaaacacttagcaaactaggaacagaaggaaacctgcacaaattgattaaagaagggcctttatcaaaatccacagtgaatctcacagtaaatggtgaaagagtgaaagcctccccacaaagatcagaagcaaaacaaggactcctgctttcacagctgctattcaacattgtccaagaagtcttaaatttcattaaaacaaaaaaggctagtgctacctcccaccacaagcatggatcagcgttaggaaattaaaataatggtaatagaaaaattataatgacagtgatgatggtgatggttttttaagtacacaactgaggtttagtggcagaaatccggtacttccaattacagtgcagctgtgcttattggggtgacggaatcaatctcgttttcagtatacatgggaagcaggagtacatgtagggtacaactgcatttctctggaactgtttttcacagaagagctacagtttatcctgcactctccattctgtgatcaaaaaccatgaaacagagaaaagcacttcaacctgagactcagtcacaagaactgcacctgccccaccttcccgcaactatatatgccacctctctgtgctgaaccatgaaggccagaggggttcacatgtggcacagacggaggctggactccctggtccgcaccctcccaggtgacgggtgctctgggatcacctggagaaggcaagtgcctgggctctgtcttttccaccagcagagggcagcagagctgcagccagaagagaggctggggctgcccaggaggagcctatgaaggaggccagcctttgtggggggtggtcaacaggtgttcaagggatcagtcctcactttggaagtttggtatagtccctcctgtcacctggggctgcagtgttcatattctgagggtcagacacacagcatcacccaggatactgacaggggcccaggcacagtgacggcctcagctgggaaacacaactggaggcacctgggccctggtgtcagcctgggcagctcccatagggctaggatttcctaagagacgctccgaggtcaaggtgctctaggagggggaacagtgtgaggggacagggctcccggggctcaagcccttcacccaggatggctgcctgagcctcctgccattctaagggtctcattcctccgtgtccagcagcatcctggggagctgagccctctacacttggcacttccagagacaccctaccaccccctccctctccctctccttccagctccaggccgactctgactcagaggcagctcctatgctcaggggattctcaggtgggtggcgtgggacatttgggatcctggtccctggatggggcattcccagcctccttgcggagatgctctccagagggaagggaatgttcacctgcctcaggccacagctctgaccatgggactatcctgggctcagtgacaagatctgtctggctggagggaccagggatcccccaccctccagagctcatgggtgttcagagaccacgacgctggaaccctcacagagaccaaataacctaaagttagtttctcagtcaggtctgggtttctggtgctttttacacatttatatgaaacactgatgagaaaaaataaagaatcaaagagcagaggatggcaatttctagtctattagagagatggggggtgtcatacaaggagcaactcaggtgagaaacgagactagactgtgtaatgaatccacatgagttgtggctgctcaaaggaccaaaccatggtaatggaaatcaagtttaggatataagtatcctaaagacacagaaccacattctaattaaactaccaggacaggaccaagtgagtctgggaaacccagagctgacttggaggaggaggaagatgatgggttcctggcccacctgctgctgagtcaggtgtcattgatgatctctcagcacggcccagctcagccccatggccaggctcctggaaggtccacagccctgctgagcctggcctaggacacagcacaggccaggatggtataaaacagtggtcatgtggccaaactccaggaggtgactgtgatcacaggccttcaaggatggagtctgatcttctgaccagagaagcagataaagtgagctgggacccacttcttcttcctcagtctgctgtgcttcccacagagctggtttgagtgacatccttcagtgaggagtcccagaggatgccgatttgcatcaaacactcactgcctcaaacggcctgagaggcaataagagagagctggtgagcccagctgtgctgtgggctcaggaggcagagctctgggtgtctcaccatggcctggatccctctcctgctccccctcctcactctctgcacaggtgctgcccccaagcccttccttcaggctcagaacccataggatcctgagctgggcctgcccaaacatgagttcatcccaggcacaacctcagggtgggaccccctgggaacagattcatcatttacaagcctcctctcctgtcctctcttgcaagctcctatgagcttacacagccaccctcagtgtcagtgtcaccaggacaggcagccatgatcacctgctcttgagataacctcaaagatgagtatgtttactggttctggcagaagccagaccaggcccatactggtgatatatgaaggcagcaagcggccctcaggaatttctgattttctgagtccagctcagggaacatggccaccctgaccatcagcagggctcagactgaggacgaggctgactattactgtcacaggtacaatagaaacagtgatgagcccacagtgacacaggcagattaggaagtgagacacaaaccccttcccaatctgtgtcaccctctttctccagccccaggatggctgtggacaaagccatgagcagggctggtccagttcacccagttctgtgacccccaggctgctcttccctccagccctccaggcaggttgtgaagagggtgagttaagaagagatttgaggctgtgtgacaggctatcctggggtttttctggccaaggataaagctggtgaaagagagcctgaatggacgggcagacagagtggcccatgcacgtagtggcaaaagacctgggtttccacatgccagcccttcaggcaggctctgcagagagtgggttaggaggagatttgaggctgtgtggacaggctgttttggggttttctaacccaggataaagctggtgaaagagggcctggatgaaaggacacacaaagcgtatctttcatctagtggtaaaggatgtgagttccatatggtgaagcctgggtcaccccttggcccagacgtcctaggttagtcctcagcatttccctagcacttaagttcctgaatctcctggcagccttatattcaaaacggtgtaagctggagtggacgctgtggggtccacctagactccacgttaaggtcgacccacacactctcagagcctacgagtggatacccatgctgtggggcacatgtcacctgacagagtggctgaccacccctgatctcttctttctgaccacttgggtgtttggcactatgtccatcatggacactctatgggctattaacctatgattcaaagtttcttctgtgtggtgcccgtgcccaaagaccacccacaggcttctgcccatactccacttcccccatttccaagtttttctcttgcagtccctggaacacctgcccaggtcatttcccactgccctaagcccctatctgccctggcatccggccactcacctttcctcacaaaatgaatgaccaggcgccatgccctcatgcaggaaagatgtcccctctccattgtctcttaatgccaccccttagtacacccatatagtgcagctgtgctctacttcatggtgatccagttcattgctgggctactctggaaatttttgctccatcagctgagcagagggactgctacccacacaacgtaagtgtaaacccagggagcagtgctagagcaagagagatgcaaacttggctgtggaccacccacaggttactcagctctggggccctgctcctgctccatcctagctgtgtcacatctgtctcaccagggatcgctgctggggtctgcctgagcacacgacgggggaatctggcagttctggctgcttggtcactgaatgtccgatgctgtcctgtatctaccagggaacaagagcacatggggagagttgttttccaaatgaatataattctctcttgtggatgacatggaattgttccaaatcccatgggattggaatcccattgggaaaatctcatgggattttcccatgagagattgcgtaaacatgagttttcagttcctatcataaattcttccattcctatcaccaattctgtgactatggtagagtctgctggattctgtggtcccaacagcaggacactcatacccctgcctgaacctggtgcagaacctccctgctctgggctccaaaacagtgggcgatgttcatggctcctgatatatgagttggagccacatccccaagggttaaatatgctgcctctagacaccagaatgaccttaaagctttgtgtttctttctggtgggaattgtaagatctaataacgtgctctttattttgtgagagatactaagctgctccagagaactcaatcctaaacatttcagctactacacaggatgaatggtcttagggcttgtttcgcactctcaggaatgcgtgggtctcaccaaagcttccaatagacagggccccctcatgcacatctgatccaaatacagaatagagccctaggaggttctcctgggtgttcagatggtcaaagcccctatgacaatatcatgaaaaagaagggagagttaatgaagttgaaaaaataaaagtataaacctatactgctgtctactccttgtatgcacaccgtttctgatcctgttctgagaggaatagaatgagtttctgcattgatggtgcctgctgtgcacctgtagccatgcatggtggtgtgttctatcagggtcttcatctggcacagcaatggcagatggaactaccagctgactgcgtctgtagaaatccacttccatcttccaggatccattcaacaattgtaggaatcatttcagtaaaccaaacacaagagcctcaactataactacaagtcctccaggagaggagaacgctgtctcagagggtgcattcctactggaatttctcttctctttgggacaaaccagcccagaggaggcacaggggctgtgtgtcatctggtttcctagatgaggtgtctcctcctcactgtcctgagattttgaagaaactggggagattggtgcagacactccttggatccttacaggaaacttccttcagaccacacactcctcaatttgttcccaagctccaaagtttctaaagtcactgtctaaagggcccacagtgtttttgtggagtggtggaaaagctctggggatggaaagtggtggtggttgcaaagcattctgaatgtacttactgttgctgaatgcacacttacaaatgattgaaatggtttaaaaattgttcattttgccataataaaaatactgcacactctggaggaaagtaaacctagtttaattttgaaattgttcaatggataccaatcaaagaatagtgtagcaagcaccatttcccctctcgctatagcagcaactgatccccttgtgctcttttggactctctcccctgctctctctctctcaataataagcaatgctcttctctccagtccaagctcacacttccccagttgtgcaggaatgcctattgtaactgttaatttatttccaggcagagtcctcaagattcctctgctcatattctgttctcagctgtctggagccagcatgacaagtgagccaagatcacttgtcatgagagacttgtggaaggttttgcaaaaagttccccaagaaaaaacaatgctcattgttgacagcaggtccatttccacacagtagggccatgctgggtgtgcagtggggctgtgcacactgtgcccacaggccaggctctgcactgctgactctgatcctgtgcttggtaggaccttgtgcactgctgagtccactgcagactcgaccctgaatgggaaggtggttcctagctgctgggcactgagtctcatagagggacagatggtattgaggatgcccggcccctgatgtacataaggggacaaggtctgctggtagaacaggaagatgaaggaacctgtggctctaaaggtggggtctccagccctcagtctcagctgcccatggcctcatctgtgtgcaccttgtcaatccagaccatgtgaattagaggtgaagggaattgaaggactttcccattttctcccattttctctcttggttacagaacgcacccttccacatatactgtattagagcctgtgctctacaaacatacctgacactaaattagtgacttttgaaagtgcagataggtacagcaaccagtccctctggagacatttcccataacatgaaccagtgaacccatctctgaaagccctcatgttttaaaagacaagatttttgaatttcaaggaaaactaaacctttgaaaaaaacatgattcaaaagagaaccttgccactttccattcctgcttgggctgcagtgaggacagatgcagcaagtgcttctgatgtctgtgtctgttcccctgtgtggacgcacatatccaggcgagtttcagtgaggtaggagacttcggcagcattggccgggctctggtttgcttctggtgctaacggaacatggaagagaggacaaggtagcgtgtcctgaagatcacatatttcctttttgcaggaagtgcctgggctcctggagtgttctcagggctttgatccaggccaccggctccgcaatcaacatcactgatatttcagcaggtcattgacctaattccattttagtgctatctcaaatggaaacattattttcttgtaactattcatatagcaacatagcacttaaatatctaaataacacacacagaaacagtagtctcaaatgcaaagctgtcacctccccacaccacacactttctcacccgagcccctgagcccacccttccctcggccccccctctcctgtgctgttagaaatctctgtcttctaacagggacagtgacacaaaacagccccccctcccgcccagcactcacaccgcagagcccctagtccatctcctgagggaacgtttacgtttctattctgacagagagaagtcgccgtgaatggagtctttaccccaaacccaggagtttctgaggaacacatggggtcagccactgtctgtgtggggaggcttcacctcagggaggcgcccggctctgggctgagggggactcaacgtgcactaaaaggcaggactaaggcaagtcccgggtcacagtgtgagggacgcacgcgccctgaggaggggtccctggtgctaggcctgacccaattctaaccccaggcacctttcctcagctcctgtggccctgggacacctccctaccctgcttcccatgaggctggtcacagctcttgtgagcaccgcctcctccatgtcacactttttctgtcaacattttgaggagccagttggttttctcctcattccatgttcctgtcccacctgcctgctgggggtggatttatttcatgtatgaggtttcctcagcctgagccacagctgcctcaaggacaccaaccctgtgggacactcctctgggaaaagcaaacaagtgccaagaggagcatctgaagctctggtgtgggagatgtcctccaccctgggtcaggggagtctggaggggatgagaagggaccaggggcctgggattgagctgtgaagggaaccaaaaggcaggagggacagggcaggggctgtcagctatgactcaggggaggttcctgggcctcaggatcctccctctgaggccaccagggggcgggggtggcacatgcctggacctgggaggtccctgctgggcttcaccctgggtgggtcctaggagctccttcctcctaagtccccctaaagagacagaggcattctggggtcctaaatctgtcatgcccccataaatgcatttctacgagggccaataaatgaactccaggtttatccaagcagcagcttcaggcgtctgcagacacagagcggggaggaattagccaacctgaggcaccctagaagggctgaagggggctgaaggggactgaagggtccctgtggggcctgtggtcctggggaggggagagctggggtgtctcccagccactctgggccctgtcctgacacttctcccacaaagaagggaagggaaatcctgggaccccacagccaggaccaaccgtgaaccacaggacaggaaggacagggacccccaaggctggctccatttcccaggcactgtcatgggctgagtctcaggaaatccaagtcaaggagtttcaatccccctggctgagccccactgtccaaggaaacagaagtctacgggcccaggcccaggtgagggtggggtaagaagaggagcttaggatgcagatttgcatggaggccccgccctcctctgaggcatcagggtaagacaaggctgggggcaggcccagtgctggggtctcaggaggcagcgctctggggacgtctccaccatggcctgggctctgctcctcctcacctcctcactcagggcacaggtgacgcctccagggaaggggcctcggggacccttgggctgatccttggtctcctgctcctcaggctcacctgggcccagcactgactcactagagtgtgtttctccctctttccaggctcttgggcccagtctgccctgattcagcctccctccgtgtccgggtctcctggacagtcagtcaccatctcctgcactggaaccagcagtgatgttgggagttatgactatgtctcctggtaccaacagcacccaggcacagtccccaaacccatgatctacaatgtcaatactcagccctcaggggtccctgatcgtttctctggctccaagtctggcaatacggcctccatgaccatctctggactccaggctgaggacgaggctgattattagtgctgctcatatacaagcagtgccacttaaccacagtggtccaagttcttggggaactgagacgaaaacctgccctgggctctcaggctccctttttgctctgaagatgtttcctcacccagtgcaacgggcttcctgaagcacagccttgagaattcttctccctcagcaactctcttttcccaccatgaaatccaaaggaaacctgctctgtggtttctcatccaggacagggacagcttccttttgcttgtgtgttgtggtccctgagtgggtgcaactcttcctagctttttaaattatgggagggtgacaatgagctccctgactggtgcagtccctgctgttttcaggaacatcctcatcctaaatgcatctgaatctcccactgtgtgcagaccaatctggacagatgttattagggggagtttccagaagccacatcttactcaactctgtatccaccacactctggtgaagatgcttttttggtgcccatcctcttgggtaaagtccactctctactcatgacagccatgtgtcccatcttctgaacttgggaaattgccacaccaaaccctcaggctcagggcccacataggagctcagaaagacgcactgggaaatggagaagagatctgcatccacccctcagtggagagacacctaactagataataagataaggaagtaggtttgcatgatgagtctccccttcttatgataagagagacctagagacccccttctcaggtgtgcgctcagaggcagaactctgaagcatctccaccatggcctggacccctttcctgctcaccctgctcactctctgcacaggtgctgcttcccagggctcaacccccacagcaccagggaacagcctggccctgactttcagctcatcacggcagtgatgcagggtatggcactctgagaatgagaccctcatcttcagactcacctctcctgtcctcgcttgcaggttttgtggccttctctaagctgactcagctgcctgaagtgtctgtggctttgggacagatggccaggatcacctgccatggagaggacttagaaagctattatgcacactggtaccaacacaagtcagtccaaacccctaatctcattgtatacaatgatagaaagctgtgctcagagatcactgagcgattctctggttcctgctcagggggaacagccacactgaccattactggggctcacgttgaagacgaggctatttttgtttttctggagataaaaacacattcatagtgacacagacagatagggaagtgaggcacaaaccccatcaccatctgtatcactctctttcttaagccccaggagtattgtggacaaagtcgtgagcagggttagcccagctcagctggatgtgtgaccccgaggcacctttcactctagtcatccaggaaggctctacagagggtgggtcaggagaaaatttggggctgaaaactaagctgtcctggtgttgtttagctaggtatgaattggcttaagatgacctgactggtaggacagtcacagcaagataaccattgagtaatcatgttgcctggatttccttttgtttaatgaccaaacctaaggtagctctctggtccaaaatgccctggattagtcccctggactcctcattctttaactgagacctttgatcccagctgtcatggcatcatgatgtcgtgaacagggaagtccattgtaatggcaactgtgacatcaggggtcatttacccactatctacccaaggccgcagggaatccttggcttctcacagctttttctcaccggaaaatgccattgagtgcagagtactgtgtcttccaaggatgtgccccctccataatgtggtttgggagcaatgattgcctgatgcctagattccaaagccatgctttaattcaggatgaccttgaagtgcctcctgctgagtgctcaattgtaacacattcccagaagagcctcccacacttattttctgggactatatacccgaaccctactgcatggaattcaacctctcagagtaactttccaagaaacccaaaaattaaaaactaaacaacaacaagaaaacaatatagagagaagagtatcaaagaaaagcaagttgtacaaagagagaactctggagtcttcaaatattaataagcatcaagcagcacatgtgtggacggaaactccattttcagacaaacagcagtccaaagacactcgcgggaacactccacagagcattctttctctctctctctctctctctctctcacacacacacacacacacacacacacacacacacaaacacaaaatatgaatcctgcttgttcctacagtcacagaggaaaggcctgagttaaggagcatgaggtcgaatcctcggaacagctttgcctcagtcctggagaaaatgtcagcctagacaataggctggtctggtctcaactaagtaagttaaaaagcaagttttaaaaagtaccaagtttccgagtaattatactaaatccaagaataaaagaccaaatagacagagaagtgcaagtatattctaaatccaacaaggaaaaactcaaaatgtctagcacctatcagatttccttgcaagaaccaagaaaatacatgctataaaaagcagaaaagttcatcagtccaaagtctccctgaaattgcacagatgatagactttgtaggaagaatacaaaagcgatacttataactatcttccacttgctcaagagggtacgggattgattgaacatgttaagtggagacacggtagacataaaaagatcaaagttgaacttacagaaattacctctaaaatgtccgcgataaaaataaatacataaataaataagggccaggcatggtggctaatgcctgtaatctcagcattttgggaaatcatggtagaaggattatttgagcccaggagtttgagaacagcctgggtgacacagggagaccctgtctctacaaaaaaataacaaaatcagatagatgcatggtgcacacccatggtcctagctacttaggaagtggtggaagaattgcttgagctctgtaggtcaggatggcagtgacctgtgatcatgccgctgaactttggcttgggtgatagaatgacaccgtctcaaaaaaaaaatgtctgagaataattgtagattagctcccgcaaaataatagattactgaacctgaagatataacaatgaagctcttcaaaatgaaacaccaaaaaagagaagataaaaaattacactgagcatcaatgagttttacgacatcttcaaggagccttaattgtataattaaatgaactaaaggagacaagattggtggagggagagggagggtacaaaaaccacttaaagaaataaggaaaaacgtgcaaaatttggtgaaaactataaacttatgatttcacatagtttaacacaacccagacacccacacacaaacacaaacacacagacatcatatacacaaaaaaacacacacataaagaaaacatcaacacccgccataatcaaattgcaaaaaaaaaaaaaacaaaaacaaaaacaaaaaaaaactgtgatggagaaatgctcttaaaagcagccagagagaaaagacatgtttgatgcaggtgaacaccataatgatgagagtagctttcccattagaaacaatacaagcaagaaggcagtggaggtacattcataaaactttttaaaacttactacgcacagcattgtacatattcagtgtaatccctatcaaaacaccgatgtcattcttcacagaaatagaaaaaaaaaatcaatcttgaaatttatatggaattacaaaagacactgaatagccaaagcaatagtgagcaaaaagaataaagctgcaggtgtcacaccacttgttttcaaaatatgctacaaggatatagtaacccaaattatactatactgttttatagtataaaacagacacagaccagtgtaacagaataggaaacacagaaataatccacatatttacagacaactggtttttgtcaaaggcaccaataacatacattggttaaaagacagccttcttggtgctgctgagaaaactggacattcacaggcacaagaattaaaatagacctcgatctctcaccacatacaaaagtgaattcaaactggattaaagacttaaatgtaaaacttgacactactaaactactagaagaaaacacagggaaaatagggaaaatgcttccggacttatgtgtagacaaagattttatacctaagctttcaaaagcacaggcgacaaaaacaaacatagaccaatggagctacattaaactaaaagtttctgctcagcaaagaaaacaataagcaaagtaaagagacaacttgtagaacaggagaaaatatttacaaactgttcatctggcaatggattcacatacagaataagacaataagacaagaaagcaaaacaattcaacagcaaaaaaaaaaaatgccaaataataccattaaaaagaggtcaaagaatttgaatagacatccctcaaaagaaacatacaaatggccaaagggtgtattttttaaaatgctcaacatcactaatcatcagggcaatgcgaatcaaaatcacagtgagacatcatctcaccccagctagagtgactaatatcaaaaagacaaaacataacacattctggcaagaacgcagtgtaaaggaactcttatacactgttatatactgttggtgagaaggtaaattttaaattaatacggccattatgaaaaacatgatagtgtttcagaaacactaaaaatagactatcatcatacaatgcaataatcccactactgggtatttaatcacaggaaaaaacgtcagtatatctaaggaattcctgcactcccacgtttactgcagcactattcataatagcaaagctatagaatcaacctgttttcatcaacagatgaatgcataaggaaaatgtggcatgcatacacgatgaaatactttccagtcataaacaaaagaatgaaatcttatcctctgcagcaacatgatggaactggaggtcattatgttaagtgaaattagccaagcacagaaaaacaaatgtcacatgttctctctcatgtgggagctaaaaaaagctgatctcatggaggtatagtgtagattaatagttaccagagaggctgggaagggttaggggttgtggggatgaggggtagttggtcaatgggcacaaacatacggttacataaaagcaataaggtctattgttgtatatcacacagcagagtgaacatagttaacataatttattgtacatttcaaaatacatagaagatttgaaatattcccaacatatagaaatgacaaatgctcaaggtgatggatatcctaaacactaattcgatccttacatactgtattcatgcatcaaaatagcacgtataccccataaacatatacaattataatgtatcagtaaaacatgttctttaaattaaaaaaaactgtcaattctgaattctttactcagtgaaaatatctttcagaagggaaggcaaaataaaatggttttaaccataaatatacttgcactattcatgacctgcagacacacactatagaaaataataaagaacacttctcagatagaaaatcatactaaagatgtgactctgaataaagaaaacaaaaacatcaaatatagtaactacataaaaacatatagaaatggtaaataaacatagatataaacgacttaaattacattacaaaacaactagacttaatagacaactatagaacagtccatccaacacagcagaatacataataatctcaagtgcatatggaacactctccagggtagaacctgcaaaaaaaaaatgagtaccttaaaaaaatagaaaatctataaagtatattctttgtgttacttcactcttgtattgctataaagaagtacctgagcttgggtaatccataaagaaaagaggtttaattggctcatggttatgcaggctctacaggaaatctggtgccagtatctgctgctggtgagggactcaagaagcttacaattatggtggaatgtgaatgaggagcaggcatgtcacatggtgagagtaggagagagagaggtggaaagtgccacactcttttaaacaaccagtctcacatgaactgggagcaacaactcattgtcatgagggcagcaccaatttattcacgaaggatccacgtggccccatgacccaaacacctcccactaggcccacctcaacactggcagctacatttcaacataagatttggatgggacaaatattaaaagtatataattccacccctggcccaccaaatctcatgcctttctcacattgcaaaatgcaataatcccttctcaataatcccccaaagttctaagtcgttccagcatcaagtttaacatcctaagtctcatctgagactaacctcctgtcacctatgagcctgtagaatctaaacaagttatttacacctaagatgcaatggtggtacaggccttgggtaaacattaccattccaaaagggagaaaacaaccaaaagaacaggccccacacaagtcctaaacccaatggtgcagtaattaaatttcaaacttccacagatctctagggcatgaaaagaattcagccaagctttttactaaggcatcacaagggtgaactttgctccagttcccaataactatctcattccatctgagacctcagcagcctggacttcactgtccgtatctctatcagcatcttggtcacaaccagctgaccagtccccaggaagctccaaactttccctcatctgtctgtcttcttctgagccctctaagctcttcaaacctgtactttttacccagttccaaagctgctttcacatttgcattatccttacatcaacaatctacttttggtaccaattttctgtgttctttcattcttgcatttttatagcacctttatagcaccgctataaagatgtacctgaggctgggtaatgtataaggaaaagaggtttaattggatcactgttctgcaggctgtataggaagtatggtgccagcatctgcttctggtcaggcccttaggaagcttacaaaaatggtggaaggtaaagtgaaaccaggcatgtcacatggcaagagaaacaaaaagaagaaagagagaaaggaaaggaaaggaagagagggaaggagggaagaaagaaagaaggaaagaagcaaaaaaggaaaggaaagaaacaaaacaaaaggaagaggaaggaaggaagagagagagagaggaagaaagaaagagagagagagagaagagatgagacgagacggggggggagagaggcagggaaggagagagggagggaggaggaaggagggagagagagagagtgaaagaagaaagagagaaagaaagaaagagagaaagaaaaaaagaaagaaagagaaagagagagaagagtggggaagtgccacactcttttaaacaaccagatcttgtttaaactagtggttagaattcattcgttattatgaggacagcagcaagccaatcatgaagggtcagccctcatgacccaaacacctcctactaggcccacctcctacagtggagttcatcttccagcatgagatatggaaggaataaacaatgatatcatcctctgaacactgatattgaaaaataaaaggtattatatgagaacactgtgaaaagctgcataccaaaaattagatgaaaagaaaaaatccctaaaaacataaaaactactaaactggctcaaggaggtatagaaagtctgattaacactataacaagagtttaaattagtcattgaaacctcccacaaagaacggcccaggcatgaagggtttcattgatgaatattatgaactgtttaaggaattaataataattattcataaacccttccaaaaatataagaaaggggaacatgagcagctcattctatgaggccagaagtatgctgatacaaaaacaaaagacatgaaaagtgaactggagcacaacagcctctatgaaaacagatgcaaaacaaccacacttcaacaaaatactagcaaaatataaaaaggattaaacaccataactaactagtattcatccccaatattcaagggattcttaacctatggaaattaattattttaatgctccctattaaagaataaaaccacatggttatttcaacagtcacatcaaatgttttcatgtacgcagacaggacttcctgttgttttcccattcctgttaaagcatcataaaaggcacgatttgtggtgctactggatggggtgctacttcatgcaaactggatatgtcatgtccaaccatgaatatacttagccataaatgctaaaagattgtaatttggtgtcagagacttggtggtcagtgaccacttccttggcaagtggtaagtacagacatctgaaaggataactaggatttaggtaggtattggataaggaggtgagttacacacagaaaaagtttcacttaaaaactcatagacgcttgaacacagaagatggctcaataggtctgagaaataaacaaagtccagaataactggagctgaatggaaacaaggcaaatgacatgaaccatctgtttctctctcgacaactcactggggcattgtctcctccctataccacccacgtggattgtaaaaacatctgttcttaaaactttcttgtgcatcatgacagcatgtagcacctgaatccagctcagttaaatgagggcaggacagtcaaccacaaaacccaggtggcccaggaagcacatcagggagacaagaccttgctgtcaaaagcagaggaagtgagattttccattgtggctaagcccagagcatatgaaatttcaatgggtacacaaaaaccatatagggtttggttaagctgcagatgcagtctttgcaggtttgaatggggccccagattctccatggcaaatagcctccagttgaggttgattgatgctggtcctccaaggaacacactttgggtggcttagctcctatgcaccctcctcactcatgcacagctgaaactcacctacataacgcaccttctgagaagcataagtgacctatttctcctccactaatgtgtctcagtcccttttactaaaaaggaatatctgaagttgggtaatttgtaaagaagcaaaggtttatttgggtcatgcttctgatgtctgtaaagttcaacagtgggcatctgcatccagtgaagacctcaaactgcttccactcctgacagaaggtgaagatgagccggtgtgtgcagaaatcaattggaaacagaaagcaagttctttcctaaaaatactgcaggagtttaatgatcatatttacaaagtgtttaacacagagcctgacacaccctagctgctcatgagttggcagcaattattgctgatgtcattcatgaaaattggacctcagatggagaaactgcagtgcagagagtttgagaagtttagggacaagaaagacttagtgacttaaaatcgagttctaggaactgaggagagcatccctgggcattttactgccatcttttccaatgtctcagaaactgtttcaatgtgacgtcaaccagagaggaaagcagaggggtttgcagaaccaggggctacaacttcatccacgggagagtgatgtagtaagcgggtgggaaggggcagctgagctcatctgaagggtgtttaaggttttctggcccagggatctttggccatctctccctgcccagggcctcattcttccactgaccggcaggagctggagagtggcttctgagtctggttagagatcccagcagcacccagagggggaagacattggagagacgggtctaaggtcactggagacactgtttgctgcctagagggctgcgacaggctccttgaaaacaaaattcagacactttaggggaagaaaacacaggatgggaaggctcctcaccaggggattgtggataacagagaccaaagcatctacaaggagcccagccctactggaggtgccctgaacacagagatcctaggggtgtctgtattattttgccagggctgccatagcaaagtagcacagccctatggctcaaagaacacaaatgtattttctcactattctgcagatgatgttagaatctaagatgaaggtatctacagggttggctccttctgagcactggagaatctgttccatgcctctcccagcttctgctggctgcggaggtgtttgctgttccctgccatggagggaaatcaccccaatctctgcctcacattcaaatggagtattcctcatgtgcgtgtctgtgtcacagtttcccctttttataaggacatgagtcgtgttggattgggtacgtactctgctgcagtatgaccttttcttaactaatttcaactgtaatcaccctatttaaatataaaatcccactctgaggtccttgcagtgaggacttcattatacaaatttgaggggactgaaattcaaattcctaacagtgtgtctgccatgactcaggcctctccttggggctctgcaggtgggatgtgcaccaccaacctctcaggtggggcattacctgacagcccagaaggaccccaggccctctgaaaaatgacgtctctttcatccaccttgagggacatgttttctggctgtccttctcatcctttgcatgctgacatgggagacatcatcctctgctttttaaagaaggactccttcaccttcccaatcaccccaagtagatgcccatgctggttccacagaatcaaaccacggtgggttacgagttatattagccaccagctgacaatattccctgaatgtccaggatccacccatgctctctgaccatcaccagagtgagcaaatctctgatatgtgggtaagagtttctcccatgggctcccagccgggctgtaagtgaggcaagaccccttcttcagtgcacggggctcagtgcagctgcctccctgaccaagtcttcctgggacactaagcttatcagtttctctcccccagggacagtttttggttgtcctaagcctagctcagctctgctatgaactttgcatcctaagagcccattaaacacccccttgtgcctcaatggaataacctggagtaaatagtgtgaggtgcccctgctttctgctcccagggcctcttctcctcggtggcaccagcactgccctattgaccagcaatcctcacctgcccattcaggcctctacactgcctaccgtgaacagtcacagatcacaaactgattgccaaatttgtgcagatcatcttgacagtttctgtggaactgggtgccttctcatagaaccaggaagtcacaagccaggccagctctagagaagcaactgggggagtaacatgcatcacagcgcctggacacaacaaagggattttgctgtagtcctactaggacacatcctagtgatgtctctgagaaccagtcttggtccctgcaacagaaagcctactaaacaggacagtaggctgcaaggttgggcacaatttgtgccgtgtgtgagccatgtagattgtgcatgtgtgtatgtgtgtacatatgtgtacatgtgcatttagtgttgcaaggaagggttgtgtcaaatgtcccaactcaaaacttttctgttttcctaagttatctgcttctatctttactacctttgtactatcataagaataaggataatgattagggttgaaataggagaaggaataatgtttaattattcattcttatgtgtttaatacatatcaagcactcttcaaaacaattcatatttattaaatcactcaatacgaactactccatgagccaaatattgtcattatctctccatttccagttggagaatctgtgatacagattttgacacatgggaaagctaaggcaaagaaaggaaaaggactttgcccgatgtcagaactagaaagtgcctgacccaggagcagaacctgagtcttccagtcccagagaccctgttctttaacaacagcctgtgggcctgtcactgtgctttaaggtaaagcactgacatctccctaagactccagaaagttctctgtactttttgaatcaagtaactcatacttgcagtgatttccaatgcagtaggaattctctggtgctgaggagtctactaggaatataatttcaatgcctttaaaatttttcagtagccacattttaaaagtaataaagaacgggtggaagcaactttcgtactatattttctttaactgagcttacccaaatattatttcaatatgtaatcaacataaaaatattgagatattttatgttattttcctacaacctttttgaaatccggtgtgttttacccccacatcacatcttaacttgaactacccacattttaaggactcagaagctccctgggactcatggttgctatactggacagagcagatccacatgaatgatgatccatttggatcacagcccctgcagtacttacttagaaccatcttggggcaatggagagtcctatgacccagagggcctccttagggaagaatggctgttccattttccaaccaaagtagaaatatggcgggctctcagaaaccagggaatttttacaatgtgtttcacacttcttcccttctcaaagacattgactataacttccagttcgaagataaatctgagccatcaaaggcatttttttctattggtcagtggaatgaatggcaatggtccctgtggattgtgctccaaggatccctttctgtgggaagattcttacaataaaaccaactaaaagtaggaagttattgtttatatgtagatctagatgaaagggggctgatcatgaggaatatagtattgaaggtgagtgtgttgctattcttcacaaagggctatttttgcctaactcacaagcatcaatcatttttatgaaggtgtattttcccagagtggtcttagcaagttacatccaacgctgtatcaggacccacaagcaagggtgtcagaactgacctgcctgagcggtcagcaggaaccaatgtggagactctgaggtctccacaccaccaaccatgtccaacctccagtcaagtgacaggaggagtggaagcattggttgggaagggcttggaggagctgcagtgacatgctcagccaagtacaggagcaggcatattggtgtcatgtgacctcatcttatctcagttatctcttttcaccaaactccaaggtgcaatgtgtggaggcatctgtctgtacccatggacaccttgggcttcacacattatttctatttctaatgaaccagtgttttgttaatgaattcatttcatcacatccttagtacttctaggttggaaaagcaatacatgtctctaagatattaggtaggaaatattctcccgccactcgtatttattaaagttaaaatgcttcagtatctaatgtgacagttgtccaaattcaatacccttcaccttgttagaaatggaatcctgatcctaacttgtctggagaggaggctggcatgaggagcatgaccacacatctggatgtccccagtgtcactgctaacacacgctcttttgttacttgccgtgaagggagcagagggagcatccacacctttgtccaaaggacttggaggacagtgcacctgattaaaaaatgcagggctgtgataagtgggttccgggtcctggatgagggaagagaagatgaggaggcatggggtaggaggcagggcagggaggagctgtaaggtcaggctctgagtatgggtgaaatcctgactccactcactactctctgggaggatttgataaatcttgtaacctcctgatgttggttctcccatcaataaactaaaggagaggtcgtgtcttaagcgtatgcttgctgtggggctactgtgaatgtgtggttgaggtggtgcctgcaaaacactctccaaagggcctggcacgtattaatgtctcaaaggagtcattctgcttaagctcgtggaggatgactttcctcctgtgtgcactagagggccttgttttgaggaccccagtgacttccctggtagggctcaagcacaaagggcatgactgatgcttcctctgaggccccttctattgggtaaaattcatgctccactcatgacacccacctggcccttcttctgaccttgagaaattgccaatatgaagccctcagactcagagctcagacagtacctcagacagacatgctgtaaagtggagagcagatttgcattcaaagctcctcccttcttgagcttcaagaagaggataagacaggagctcatagtgtccaggttccactgggcagtctcgaatagagctcttggaagtccctccaaccatggcctgggtctccttctacctactgcccttcattttctccacaggtcagaacatcccagggaattcagggaaatgttttcactgctattttcccatgagcaccagtcctcaggggcattctttccagttcttctgtgcattcagcatcattcatgacattctgtttacaggtctctgtgctctgcctgtgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcggttgagccacagtgacacagatgaaggggaagtgaggccaaaacctcccacctcccctttctcctcagggactcagagtcaacagccctgggttcctctccagtaccctgagacctctgactctcctccctccaagacacccctaggcagaagcagatgcaggccatgactgaggccattttgaaaactcatctttctgtttcctccacaacagcctgtggggaccatgctgggagagaccagagcagcccaggcaggaaaaggaccttgagagagtggctaggatgagatgaccgtgtcccagtgtctcattgtgccctgtgctctattaccaggctctgccccaggaaaggacatggatcttgacctgtcagccatcatttatgagagttcaatttttacattttttaaaatataaaaactacaatctccaagatgctaggagcaatttcactgagtctcatcatggaattctgacctcccccagcatgtcccctgttcctacaatctcctgttcaagaccaactcaactccattacccagaccagctgctggatgatcaagacagggctgtgagagcctaagaatctttaaggtccacgatgagaacacgtcaagaaggatttatgttggaacttccttccccatggatattcacatcaacagagaagatatctgagttcttgcctacacctatgaatacctaagacatgaagtgtgtgtgtgcatatggtgtgggcagcacttcctcactcaacaccagagagtgtctgaggacactgggtacagacatggagacagggcatatttttatacactcaattaagccctcgtccttctctgctcaccaaggagccacccaacaaggccacagcaggaagagaagttgatttccatgaagagccttccctttctaagagtcctggaaacccactgtctagttgtggaatcagaggcagagctctggggcatctccaccatggcctggaccctcccctgctcaccctcccgactctctgcataggtgcttcctcccagggaataagccccatggaaccaggggtcagcctggccctgaccttgagctcagtgcagggagtgatgcagggtgtggggctatgggaatgagaccctaattctcagtctcacgtctcctgtctcctcttgcaggctgtgtggcctcctctgagctgactcagctgcctgcagtgtctgtggctttgggacgtacggccaggatcatctgccagggagatagcataggtgactctgatacaaactcgtaccagcagaagccaggtcaggtccctgtgctggtaatttatggtgacagcaaccagccctcagtgattcctgagcaattttctgactgcatatcagaggacatggccaccttgattattaatggggcacaggatggaaacaaggctattactgtcgctcggaacagcactgcttctcatctcacagtgacacagcatacagtgaagtgagatgcaaaccccttcccatctatgtcattctctcccttcaaccccaagaggactgtggtcacagccatcagcaggtctggcccagttcattcagatttgagacccccaggctgcccttccctccagtcctccaggcaggttcattagatggtaaatcaggggtggatacacaactattaaatatcatcatgttccaatttttcatgaagtagaggaatgattgaacatgttaagtagaagcacagaataaccaaaaaaggactaattgagcttgtgtacagctaataattgcaatgtctgtcaactttaaaaacatactggatgtgattaacaacagattagattatgtaaaacaaaagattagcaaacttgatcatgtagcactagaaaatattcaaaatgcagcacataaagaaaaaacaatgacaaaaatgaaaaagcattatcggatattcataaagaaaatgaaggtgagttataggacaacttcaaacagcctgaggttgactaggagtaatggttcacgcctataatcccagcactttgggaggtctaggagggaggatcttttaagactaggaattcaagaccagactaggcaacatagctctataatttaaaaaaaaaaaaaaaacttaaaaattaactgggcttcgtggcttgcacctgtagtcgtacctacttataaacctgaggcagtaagattggtagagcccagaaattcaagactgcagtgagtgagctatgatcatgccactggactgcagcctgggcaacagagcaagttcctgtctctaatatagggtctcaatctgtcattcaggctggagtgcagtggtgcaatcatggatcactgcagcactgacttcccaggcccaagtgatcctcccagctcagcctcccaagtagctgcgaatactggcgtgcaccaccatgcccagctaatttttgttttttctggagagactgggtctccttatgttacctaggcttgtctcgaactcctggactcaagcaatcctccagcctcagcctcccaaagtgttgagattacaggggtgagccgctgcacctggcctaaaaaaaaattttttttaatacaacaacctaagtatgtataattgacatccatggaatgtaaaaggtatgggtgggtagaaaagaatatttgaataaataatagtcaaatgtgctccacatttggtaaaaaccaaaaactggtatatccaagaagttcaacaaaactgaagcacaggaatcatgaagcaaatgactccaaatgacataatagtcaaattagtaaaatctggtgatgaagagccacttaaaagtatgattctaagagtacatttctcattagaagcaatgtaagcaagaagacagtggagcaataattttaaaatactgaaagaaaacagctgtcaaccttaaattctttatccaacaataataactttcaaaagtggaggataaatataatgttttcagacatataaaaacttacagaattgattactatcactcttgtcattagaaatgacaaaagacacccctagacagggggaaaatcataccaaattgaaatatgaattcacacaaatatcagataatgcaactccatttgaatatataatcacatttgaagacagattttaataagtgatatatgtatcacaaagcctaaagtaaacattaaacttttttataaaagaattatgactagtaagctgtattaggattctccacagaaacaacataaatcagatatgcatgtatgttatacgtgtgtgtatatatatacatatgtgtatagtatatatatgtgtgtatatatatacatgtgtatagtatacatatgtgtgtatatatacatgtgtatagtatacatatgtgtgtatatatacatatgtgtatagtatatatatgtgtgtatatatacatatgtgtatagtatatatatgtgtgtatatatacatatgtgtatagtatatatatgtgtgtatatatacatatgtgtatagtatatatatgtgtgtatatggtgagagaaaaagaacaagagagaaactaattttgaggaattggatcatatatttgtggtagctgacaaggatgaaatatgttggtcaggctgaaggctggaaattcaagtaagagttgatgttgcagtcctgcatccaaatttagcaaggcagcacttcaggaaacctccacatttgttctaaaaacattcagctcactaaagagtcccacccacattgtgaagagaaatctgcttatacaaagtttactaattaaaatgttcatcacatctgaaagttatcttcatgtcaactcctatactggtatttgataaaatcaatctggtgcatagcctacccaatctaacacttaaaattaactatcacttaacccagcaaggaaataaaaagataatttaaaaaatcaatcaaaaaaggagacagcaaaagggaaagaaaactaacgaacatatgggacaaatataaaataaagagcaagaagatccttccagctcagcctactgagtttctgggactacaggaaggtttgtagttctccttgaagaggtccttcacatcccttgtaagttagattcctaggtattttattctctttgaagcagttgtgaatgagagttcactcatgatttggctctttgtctgtctgttgttggtgtataagaatgcttgtgatttttgtacattgatgttgtatcctgagattttgctgaagttgcttatcagcttaaggagattttgggctgagacaatggggttttctagatatacaatcatgttgtctgcaaacagggacaatttgacttcctctttttctaactgaataccctttatttctttctcctgcctgattgccctggccagaacttccaacactatattgaataggagtggtgagagagggcatccctgtcttgtgtcagttttcaaagggaatgcttccagtttttgcccattcagtatgatattggctgtgggtttgtcgtagatagctcttattattttgagatacgtcccatcaatacctaatttattgagagtttttagcatgaagtgttgttgaattttgtcaaaggccttttctgcatctattgcgataatcatgtggtttttgtctttggttctgtttatatgctggccacttctcaaaagaagacatttatgcagccaaaaaacacatgaaaaaatgctcaccatcactggccatcagagaaatgcaaatcaaagccacaatgagataccatctcacaccagttagaatggcgatcattaaaaagtcaggaaacaacaggtgctggacaggatgtggagaaataggaacacttttacactgttggtgggactgtaaactagttcaaccattgtggaagtcagtgtggcgattcctcagggatctagaactaaaaataccatttgacccagccatcccattactgggtatatacccaaacgactataaatcatgctgctgtaaagacacatgcacatgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggcgagggatagcattgggagatatatctaatgctagatgacgagttagtgggtgcagcgcaccagcatggcacatgtatacatatgtaactaacctgcacattgtgcacatgtaccctaaaacttaaagtataataataataaattaaaaaaaaaaaagaaaagaaaatgtctctagacagcttggttcctgagctgggaatcaaccgtcttttctctccctttcaacccagagtgtggcaggcgcgccccctacaggcagctaaaagagctgactgagatgccgtctccatagggagggatttgggctgagaatttgggctgaggattttcccatgccctccctggcaggctggtcccaggacactcagaagacttactgttacaggtccagagcatttctcgtcttccttttctctctccttgccaagtgaccttggaattgttcctccccatctcagccccttcccttttgtgttaagtgcagtttgcagattttgtgttcctaggtcctgtatctgtagaattttagggaaagcagtgctggtcacccacatggaattcaagacagcgagcccaggaccagaaacacagacagcagtgggggtccccacagagcagcatggtgggcaccaggtggaggtaagaaaccaggaaccactcccctgagtgtcttcagccccaggtgaactagggaggggtcagtgggctgggctcaacccaccggggactctcctgtcactgccccagcagcaccatcctggaagcccctatatgtgctaagcagctgccaaagaacttgattaattacctgtaaatttcccttcaccacacctgaccacacatgactcctgcccccaaattactaatttattaaaatggcacaattagccgaaatggcctgaatccaggacccctttcaggtttgccgctgacctctcaggtcctcacacatgccagactctttccacaggggcctgactccactgtttccaacacaaatcccaggactcatttttctctgtcagtcctgacagcagttccagagacacttccccattaagatgtccccaggctcttataatacaacctgtctgttattttctgcctaaatctttttaattatccccatagcatttacaactgtaggaatctttgcctattgttaattttattaattgattggtgttaaatatttacttaattggtcatggatgcttttttaccacagaatcacacataaaaaacagacacaaacagctaagggtgtatttctcgctgcaataatacccaccactttcacgaagacaccagggtctttctcactttttgtcccaccatccctatgatattggctttattttcatccctgctgatgtgtgacctcagggtggctgctgcagctccagctatcactcccatattcaaggagaaaagggcctcatgaatctagtgctctttcacaagagcaaagctttcctaagaagaatttcacccactgatctcacaccccactgatcaggcctgagtcacatggtcaatcccagctgagcaggacctgggaatcacaggcaccagtcttttcggtgaatatagaagacagtgctcaggtggaaggtgacagggactgtctgctgggtctgcaaacccagttttcccgcacagccaaaccagcacgatgaacaactcacttcaagaaggctgtgtcttgttcctgctgaattcaccgcatggaacgtgtcccagaccacagtgggtctggattaacatttgatgggtggatgttcttctgtctctgactttggtgcaggagtcaccactgtacgctggtcctgcatccacagcggggaccagtaagagccagtccctgagtcctgtgatccccgccctgcatgccaagccctggtattacccccatgaccacccaccgcccagacacatgtgcaggcagcctcagatggaccttcctcctcctcttccaaatattcatgttcatattgtcatgagtaatctgcacccctcgcacctggtattgaggcaggcatgagtcacaaagagaagagaaaaatttcctccattggcaccagcagtctgcagaccagggaatcagggacctgaacagaagattttaattatacacccggacccaggaggcccttgagcctccagcagccagtatggagcagccaccaggggacagaacagagtcacctggcaaagtcacttggagatagggtagacctgggtgacaaggagatgctgacatgcagggagggtcagtgaccacaacctgagatctagaaaggtgtcgtttttctacagcatcatccttaacatcgagtacaaattctccaggctttgtgtttctcagctttgtctctggccaatgttgcatatttgacacaggtgcagacactttgcttccccctacacactggcccactcttctgtgctaaaacgctgtcattgccacaaacgccatcctcccctgtgggcacatgtgtttcatcaccctcctgtttgctctgagagccccctcattctgctacacagcaaagttttctttcagcatctaagctgtacctgaccatgaccacatactgggggtacataggcacagcacctgtgccctaccctaggagctcacagccaaggccaggaacttacagcatctcctgagtctttcaacactccgtgtgcacatgacaagggtgaagtttgattgtggaaagcaccactcagaagcaatggcaggtccctgcatgtgtgccagccttacggtgtcacctgtagagtggggtcatgagggtcactgcactgggttgaaaagtgccctccagagggggagctagaaccacacctaacttctggattttgccacaaaatatttagggacaggacacccctggagtcctcaattacccaagttattctgagccagtattcaacagaggaagtaccttagatctcagaataatccctcagtcgccattgtaagtcagtccctggccatctccacgcaggacaaggaatggccacatgggcaggacatcatactacctggaaaacgcacaaagaattcctctcagagttctgcatggccagatcagctcaggagtgaggccataacacaacctacagtgacgatgtcaacccagatgatgggaccagaaggagaatgagaattctgtgtgctgagggtgggtctttaggggccccctctctctctgtcccttggggctgagcccttctctggaaaccacacagctcctcctgcagcagcccctgactgctgatttgcatcacgggccgctctttccagcaaggggataagagaggcctggaagaacctgcccagcctgggcctcaggaagcagcatcggaggtgcctcagccatggcatggatccctctcttcctcggcgtccttgcttactgcacaggtgctgcccctagggtcctagccactggtccagtcccagggctctgggtccagcctggccctgactctgagctcagcagggcccccgcctgtggtgggcaggatgctcatgaccctgctgcaggtggatgggctcggcggggctgaaatccccccacacagtgctcatgtgctcacactgccttagggctctttcatccctggatctgtgtccaggccaggcacgtgggaagatttacttggagttcagctcctcagtttcaagccttttctctcccgttttctctcctgtaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgcacacagtgacacaggcagatgcggaagtgagacagaaaccagccacctcggcctggctcacaagacccttccctctctcctgccctgtcacactgagcaggagggagccttccatgtggaatggaagtttccagtcctatccctgcccttatgttcctgagagacgggagcaagttcctgcccacctctaggctcagcttatcccagaataaactgagctagtcattttgatgatcaaatgccagctcccaaaagaccccagaaaccctgatatctaagtagcaccgactctattagtatcaagggagactagccctagggtggaatcattttagtgtctcagaaggcacagggcaatggaaagtgtttatgaggtttcaggatatgcacgtgagcagttaaaggcaggtcttacaaggaaggaacctactagaattggggcccatctgtgacatcatagcacagcctggtggacacagagaagggaaggtcctgaatcaagtcttgatcagtaaatatttattggataagtgagcaatttacataggtgagaactgtgtgctctcttgagcagaacacttacctggataattggttttcaggaattccctgaagcaatgagtgacattctttattgttttcaccctcatccacctgggaaagagtatcctggaaccagcagttaacattgacacagctggtctcggtcctcagcacaaacattcattgcaggctgaaaagtgacaacggaagagaaaggagtttattaaatccctagacacaaacaaatccataagcagagatgagagatgcgggctcagctggcccagtcccacaggggtcattcctcttgtgatggaaatgaccacatgagggtcccccaagcggtgttggggggcagtcatggggaactggcctcccagggctacctgctgcttgggctgggcagaggttagagggatggaagtctggtccagtccttcccagcagcatctccaggctcctcctccctctactggggcttcccctccactccccagaaccatcattgcttcctcatctcctgtctcctccctgccccaaggccctccctgtgctcaccctggctcctccccctgctccatgcccagcctctgcagagcagcccaggcccagagacttgggcagaagcttccgtcccaccagctgcagaaccttccctacagaaccaggccagtccctgtgtctcatatttgtagagatcccaatcaccctcagagatgacgggtgggaaaccagcccacagtgacctaggctgttgggcatatggccttcaagctggccttcaagcccacttggctgcatctccttggccaactccaacatccaggctgggagtctggaatcctagttcccctggcccattcactcccactagggttgcttctaaactccctgggcctcagcttcctagtctgcccactggaagcagcgacaggcattttccagggctgcggtaagggccctggaacaccctctctcaccctctctctccctttctctctctctctctctctctctctctctccccctccccctccccctccctctccctctctctctctgcctctgtttcctcctcagtagtgggaagaccccctgtcaggtgggccagtccatgacatctacagagggagcaggaacctctcctatttcctggaggagagctggggtggaggctgcaacccaggatcatcagaggagctggggtcttcaaggttcctagggaccccttaagcgggggtcagagtggcttcagcggtcttattgctcggtccagacagaagatgtttccagttgtgaaaaacgacttcagggacaacaaaaacagagattcgcctctccagacaccagtggttggtgtgcctggagtactcctcgtaccaggcaggggagagagtcctagacagaggaggttctaagtgtcacctagatttcaggcctcggggcctgtattgggtaggtgatgtcacagtgagttgatgctctgtagccccttccctaggaggtggcagagggaagagctggtggtcctctgaggtgtgagtgagtccaaccctgagggtcttcccaagctggaggtccctgggtgtagacggaagaggttctggtcaaagaggcctggtgttgaatcctggtccatttattcatttggtcaagaaatattcatggaggacccaatatgtgccaggtgccaagccaggtgactggggacacagtgttgagtgggacagttggctccttcactgctagaggtattatattctcaagccgagactcggctctacgattgtatgtcagatatatagcctctatgtgcatgtctccagagactggtttcctggagttccaagtgacagccatcactcacctcgaatgcaaaaattaaaggagcatccaaaaacctagtgacccagataaataatacttaatgcaatattttcaaaaatcaaaattaatgcccaacaaacccacaatgaacaaaatttcaggatctgactcactcacctcagtggttttgttcttggtcctacccacagtcccacaggtgagtgagtacccacagggatgcaaaaccagagtcaggcccctgcaccgccttctgcccggccaccagagccctcccctgggtcttggcctttctcttctgaagagctccagccagttcctcctcaggcttcctctactgctggtctcttctgccccctactggattctccccttacagctgcactccaggcagctggtggaggttaaagaacagaaacctcccaaaactccaccctccagttccaggctggctccacctcatgtccaaaaaggctggtcctccaggtctttgattgctattagtaagtcccaagacacagtctttacaccaagtcgctgtgtgccttgggcaagaaactctccctctctgagactgtgtttccacactggtagaagtagctagaagacctccctgccaggttggcaagtccactctgtgacatctacaaagggagcagggatctcttccatttcctggaggagagctggggtggaggctgcaacccaggatcaccagaggagctggggtctttggggttcctgaggactcctcagagggggatcaggagctgcagagccagcttctaactctggggactcagagatccagaacctttgtcatatccccagccaatactttgtcatcctgtgcctcagactcccccagatcccaagagtgagaagctcaagacgagacaagaaagaccagccagcttgaatttagggatggtggggagtggggagctggggacccctggacctgggggagaggagtctgcagtgcctgcaggtggagtttctgggacctgggggatggagactgggcaggggactgaccagcagaaggccaaggtgggggataccctcagacatggagcagggcagaagcaactggatggggtacatccctctgctttgggagagaagggccagggcgggacccagagagctctgcagaggcaccacagaccctcagcagggggtctgccaaacaggacagctggacttggctgcttctgcccaggcctggatccagcccttgcacatctcagggcaggggataggcctgggtggccagagctgcagctgcacctgctggggaggcctagtccagtcctccagggtccccagacagactcggatttccgactgcagccaccatggaaggatgtggtctgcggtgacgatgtctatccagaggccatggcaggtgcaagggtgggggtaggggcagcagctggggatgctacatttagggacagcccctttttatccccaagacctgggactgtccctgaaaggaaccacagcttctgggtcctgagcagtgggtgagtgtcatacccacagaggggctggaagggagcagcttcagcctagactcccagggcagaccctgccccagccccgaatatccaaggagcccaagatcagaggcaggaataggccaagctccccagtggagaagctgtgctggaccaggggtttcccagggccctcccttgtgccctgaatgatgtctgttagggcacctacaccctgttactgctcagtgccttgcctattttgaaggacagggatgtgtggtgattatttgtataatccagcccccagcacctggtcctcaaaagttacccaagcaatgtgtataaagatccagcctggagatctttgaaaaccgattcgatgagtcgaaccattaagtcatgatcaccatcctcaacttcatctctttcttcctcctcctcctcattatcatcaccttcaagaactgttaagagtctgagacttcatcctatttgcagactaaaaagtaagcctgccacagtgccatggatgctggcagaagatacaagactcctgggtcagagacaacgaataatctgtttttcacagcaatagcagttgccaaggtatcagcattgtcttgcaccagttccacaaggtgatgcaaagagggccaggtgacatctgcatgccagagctcagggatcccaaatatttcatacttgacagtaagcatatatctgtgttttgctccaaagagaggcattctctgtaccttccgaggttgttcactccacaaacactcttgaaaagataatccacaatcagtgcctttgcccgagagacatgcagaaatgcagagatccatagtagaccactgtctcccaacaaccatcaactttatcaatgaaatgaagtctcaggctatttgtctgttaccatagcccacaaaaatgtctggcttgattgtcaccaaatgtatcaaggaagttaaggagtatctgacacaaaatgtgaaccaagcaattctcaaaggagcctcccaggaaattcactttaggaagtcctaggaggctcctctgagagttgctaaaacaaaacattgagagtcctagagggctgcagatctgaacttgagcagatatttttaaagattttgtggcagaaaaagaaactggaaagcaagagggcagaccctcattgcagttctgtaatgtaagggggcagagcaggggcctttctcaccagagtatggggtcctgaagatctcctcaaacatttttatactaggctctcagggcaacagaaaagatgggagcgatgaatggggcgtaaaggagtgcaaatgacacaaggggtcacatgaagcaaaagaggtttattcaaccagatttagtccatgtttaattgagccactcctttgtgccaagctctgggttttcccatgcaccaagcagtgtgttaccacctagacccagagagccatgtcatcatcagcaaagcacgccctagtgtcatgcaaggaccaggcctcagattccgactccagacctactgcctcttggccctgtgacattaaaagagtagggaatcagcctgagcagcatttcctcatcttcaaatgtggaggacagtagatgatcttagctcccaggattagtgcttgtaaagcaataataatgtaatgcattattattgtattatgcatcatattcccatattatagtcaaaaaggaccccaacttaaagcacctgccagccctctcctcctccaccactgccgaatggagccaggcacgagtattccaggtggacagacgaatagaaatacaggggacgagccccttcctagatcctagcgcagcttgctccctacttaaggaatgatattggaccctgcattcatcttctctggatggtaattttctcacctgtaaaacagagacactggccccaaggacaccccacaagtagttgtgaatcccaaagtaagagaagaacaaaaaaagaaccagaatttattcaacacccactgagtgcttagcaaacacatggtttctttaactctcataagcttcatgctgcagaggaactctccccattttacagataaggaaactgaggcccagaggtaacctaggtctagatagactccacatttatgacttcaccactcttccttgcctgaaggatatagaatcactccctgcagggctcttgcctgactcaggaaagggccacaggatagccagccaggcttaaccaacccagccaagaaagggctggtcccaactggctggagtgcagtgtacaggcacccagcctggaagactgatcagaaaagaagccacagctccagccccagccccaaccccctgagctcaagcccttggggactcctgctgggcagctctctaggccctagggagatgctccacagacccaggctgccctttgggaagtggggaagacaagtgggtcaggtgtgcaccacccaggggcggggccaggcagccggctgtggtgggaggcagttgagccctggattgtgaccgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtaaggggcaagagattccaggggatgtgggggtcctgcagcagagctgggaaagggtgaccaaggggagacaagccagaggagtgaggaggaaggttaacccctaagaggggcctgggctgacactggctttagtaatgggttgatattttgtccatcacagatttgtttgaattactgtttttaatatcatattacgatattatttttcttgatttctgagttttctggcgccacttaaattttcaccagggtcagtgcctcaatcacctagtcctagtcctctgggtagggaaggaacagaggcagggacaggacatccacagggggtggtggccactgtccccacagggtgcccaggcctgttcctccccctcctcctctctgcccatgtgcctcctgcccagtgagggcaggggccactccctggagaaggcagcaagggcttggtttggtctcccccaaggctgtctgttcaccaacttgcacataaatgcttactggggccaggctcaaggacacagggagggtgggatgaaccgaggggagctgtccagtcattggaacaggcccacggcccatgtttggagcaataaagggagaggggatctccctctgggatgatgcccaggctggtctcacagatcgaggggcactggctggtgatgggtgcccccaaaagacagagcagcgtcagaggagaggagagcacaggatgaggctgggagctcctgggtgactgggaaggggaggcaagaagaccatagggtccgtgcaccattcccagtccaggacgagtccttggatggatttaggtagattgattatcagagtcagatttgtgtttttggaaaaatcagcaccggattggaggctgatgcgacgcccgattagaggagggaggagagggggtgatggccaagtccagggtaggtggggatcctggaggaagccgtgccttggggatggggaggacactcagattcagagcacccaggggcccagtttcctatgaaatgggagcatgaagttgaagtgagggctgagcagaggggagcagacacgctcggggactgtctatgggcattaaaaatgtataaccattttagcaacaggcggcgagtcaaaaaacaaagtgtgtttatctaaactgggcaattccacttctaggaatttatcctaagggttggttgggggaataatcaaagctgtaaccaaatctttataacaagggtggttagctcagcattattagtgatgggagaaaactggaaaaaatccaaatatctaccagaaagggtgtgaaaaaacacaattgtatttgggggactgttgttgtttttgttttgaaacagtcttgatctgttgctcaggctggagtacagtggcgtggccacagctcactgcagcctcaacctccagggctcaaaagatcctccagcctcagcctcctgagtagctaggactacagatgcaggccactacacctggctaattttgattaggattattattagtttagagacagagcctcgctatattgctcaggcctgtctcaaattcctaagctcaagcaatctttctgcctcagtttcccacgtgctggaattacaggcgtgagccactgcacctgacccaactgtgtttttaaagtatatatgcattttcaaaaacctgtcagaaaatatagaaaaatgtcaatggtgtgtctggctggctgatgggatttcacctaattttaatgtggctttataattttctggttttgtgaagttgttcacaaaaagagacatttcttctaatataatttttaatacaacagtaatgtactcatgtgcattactctttttgtaatgagtatattacaaaatgtaatgacttttgtacattactcttttttcttgccaaaaaaaaaaaagattaagcagagaagtatataaagtaaaagcaagtgcttctgcttaccatctctcacctcttcccagagatagccactgtcaggttggtcaatatacttccagaacttttcctgtgtgtgtgtgtgtccctgaaaacacacacacacacacacacacacacacacacagttggtgctgggattttattttgcaaaagtaagagccatattctgcatattaccaacttttaatctattattgacactttctgtatcagtccatatggattaaccacattcattgcttataaactttgttttataagcaaagtttagatgagccagaatttatttccactaaaaaatctaaatgacaaatgatgctgcagtggaaatttgtgtgtgtgtgtgtgtgtgtgtgtgtgtgtgtgtgtgtgtgtgtgtatgtgtacaaagtgcacttatatatctccccaggatagatgcctaaaagtggaattgctggatcagagagaatgtacttttgaaatcttataggtagtgtttccaaaagtctgtgtccactcactccggtgaatggtagtgccttcgctcctacattcttaccaataatgcaaaattgttgatctttttatattctgcccatctgatgagcaaaaaattgaatgtgtttatggttttattgtgtattttattactggtgaaattattttttatatttttatttattggttttatttcgtctgtgaattaactggtcatcatgttgcccgcctttccattcagttgctttcatctttttatatatcaataacatattgggatatatttgggattttaaccacttgtttagtgtatgtattgtaaatatttttccctggtctgttttacgggtcttttgtttatggggtctcccaccataaaactgtggtaaatttttatgtgtcgaactggtttaatcttttctttatggtttctgtgacctccaccatgtgtaggaagttgtctttatttcaatattataaactcatttttctgttttattctggtacttttggtgtattggtgttttatttttttttctttacttcccctggagtttatttttgtggatgtaggaataagaccttattttccaaataggaaagccaatcatcacacatttgttgaatataaatgcaacttttctcaattactacattactgatttattacattctttctgtggttctcttggtttattgagctattcctgcgcccaccctgttttgattattttagctttatggtatgttcggtaactggtagggaaagaacccgtcattgttactttttctcaaaatagtcatgtctattatctgtcattcttagagttggactgcagaattggttctctaattttcaaaaatcattcttgtgttatgtggtaatatcacagaatatgggattaatttgagaactgctatctttataatgctcagtgtttttgttcagagacatgatgtactctccattcactcagataagtggtttaatattttattcatgcaaatcttgcacactttgttttttattcataaagggtttgtaaatataattttattgaagttataaattttttcacaattttatatcgtaaatgattactgtttctatagcaaggaaccctattaacttttctatgttgctcttgtatccagacactttaactcttgtattaattccagcagttcttcagctgattctccgtgtgtgtgtgtgtgtttgtgtgtttagttaactatcacaccatttgccaagaacaattttctctctttttctgtaatatttatacctccttctctcccccttttatgtcatttcattggctggaatctatacaatatgctgaataataaaagtgagactagacaaccttgccttgtttctgattctttaaatgttttgcctttaaatatgaaggttgctgtaaatttggggagatattcttcactgagttaagaaaattttcttcagtaacttaataaaaggctaaatgtttgctttctttatatgagaaacaagtgttgaatttatattactattatattaaattctgtttcaaaaatcttctgcacatgtcttaaatacaaatgtattaaatacaagctgctgctaagatgaaagttgctggccccatcacaatgggtatcttccaatgtgaataaattgccttggggaataaaatcagatttggaaaaacctgaggatggttgccatcataaactcttagagtgtgacctgggtgtttttctttttctctgtaggatgttaatagtatcttgtgtcatgctaggatgtctaggacagagggcaatacaatgaggggaaggcattctgcgatgtccccaggcctctggcttgaagagtaacttgctgaagtgaggactctgtggaggagcaagttatacagaaagaagtttagttgtgatctgttgagttggaggtgtctacagggcatccaagcagacataggttgaggaggcagaatatatgtgaatctggagccaagaagagaggtaagggctggaaatagggatctaagacccctggacagttgtgagtgtgcacaatgagggtcagatgcagagaaaattaggagactacagagagcagaacccagggtggggatctgggagtcagcagttgggcatgggcctggtagaaagggaagccaaggaggaggagagggggcagtctcagacaccaaggaggggagagtgactagaaagaaaaccttcttgcagagacataggggatggggaagaactgcagactgaactggggcaaaggactgttggccttaaccagagagatttgagggagagatgaggctgagagccaggggatcctgccatgtcccagcataaaaacagtacctgacacagatgggtgcttgggagctgttgtcggatgaatgagtggacagatgcatggatggacggatggatggaaggatgatagattgatggacaaacagatgaacagatgaatagctggatggacaactggatggatgggtagacagaatgatctcagagatcagaaaaagcttcatgcactaagtgggactgaaccgcgtctccatgggtagaaagcagaggaatctccacttgagtcaggaatgacccagtgctctcaatccagggagaaagccagcctggcttcactggggacacttgtgtgggggactcagaggccctttaaatgaggccagacgaggttggacaggtccaagccaactcagcactcctctgccacactgcacaggaggggatgtgtcactcagggagttgctgggacctatgggtcccagtgttgtcatcagcaccgacagcctcagagaggaaagacacacactggggtaactccaaggctgtgtgtggcacttgccttggacagcagacaggcacagggacacctctagggggctggccacccccctgcctcatgtctaggtcccagccccgcccactgcaaccctgtgcccgtcatgcccagcaggctcctgctccagcccagcccccagagagcagaccccaggtgctggccccgggggttttggtctgagcctcagtcactgtgttatgtcttcggaactgggaccaaggtcaccgtcctaggtaagtggctctcaacctttcccagcctgtctcaccctctgctgtccctggaaaatctgttttctctctctggggcttcctcccctctgtcctcccagccttaagcactgacccttacctttctccatggggcctggaggaggtgcattagtctccgggtaaccggcaggaagggcctccacagtgggagcagccggatgcagcctggtcccggggcctgagctgggattgggcagggtcagggctcctcctctcttccagggcagatgtctgagtgagggacagaggctggttctgatgaggggccctgcagtgtccttagggacattgcccagtgactcctggggtcaaggacagaggctgctggggtgggcctgggagctgctgagtctcatagtctaggggagcagccccaagaacagctgagggtctaggctgaggactggatgccaatccagcctgggagggccacacggcctggtgacacagaggtcaccccaaggggagaccaatggagggcacagagagggctctgggtctaggctgcagctctgtggcctgtgctgggtcatgaggacatggggacacagagggacgggtgagactgggtgaggtgccagaatccaaccctcccaggacagtcaccagaaaggagacagtctcttagggcagagatgtgtctgtccctggagccccgtcacctctggggcccagtgtctctctgttcacggatcggcctcctgccttcctcaaagggcatgttagactcaggaaatgaccagaggggagtgaatgaggggtgcagagaactccatggctaccaggtgaagtttggggtcatcacaggctgctggggtgggcctgggggctgctgagtctcatagtctgtgggagcagccccaggaacagctgaggtgaagggttctgtggtcgggcttgtggagacaggaaacatctcagagcctcagaggagccctgaggcttgtctaggtggagcccactccttgccaggagagccaagtgggctgggctggggcagagcccggtgcctgtgagggataggaagctccagttcaaagcaggcttgggtctccccacacactgcctgccaggacagtcctacaggatgagcaggggacccacagttcacggaggaggctctaggtcctggaagaataaagtgggtgatggaggggggtatagggatggaaatgagggatccaggggtcaaggccagattctaaactcagactccagagatcagagaagaaggaacacagcctgccctgggtatatggagaaattgaggctgtagaggagaggggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacaccccggtattctgtctgccctctctcacccccttccctgtccacacaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgacaaccagaaatcttgttttatctcattttttttctcacataaattgctagcctccccggggttctcagtgtggggtacagggaattctgcacccagtgtgaaaatcacccaagggaggaggctcacagcctccctgagtcatctccccagagggtccttcctctcccagtcaccccttctccaactctccactgtacccctgagctaccagtctggcatcagttcagaccagtcccacaccctcctaaattttacttctcaataaatacctgatcatgtaaaacgcagcatttctaatgtgcagtctctgtctggtcatgtgtctgggctgaagggtcactgctcagggacagggggcagttccaggtgagatcccatgtctccgtcatcccacaccccacccaacctgccagggaaccgggtgagctccctgtgccagtgggaactgcaatccaaggcacaaaattgtcctgcagtccttgcccacctgggaagggacaggggcccagtgagaggtttgctggcgccctgtggggagattcaggagaaatgaagggggtccccggagaccagatgagggctagaggcagaaataatggaaaaaggacacccttgactcaaggccacggtctcagcaggaacagaaggtgaaattccccattgcatacgaggaaccagtcaggagagtgtttactgggtgagggataaataactgtgctgccactgggaacttgtaaaaacattgggaaaggaaacatgcaagtgtctttctaagacttgtacaatggacattggctaagtaaacatactgacaagtcctgcactagggaaccagtttaatatgatgagccacagcatatccaaaagcatgttgatctccttcttcacctttagaagacccaaaacactctgaaagataccagcgtttcctggaactagtttgtggaatatggggtgaggttgatgcacatgatgttacgggtatatgatcacatggctgtgggttggggatcaggctcaaagttaacactagcgtggggctggatgtcaagcatgaagggtgtggaccactaagtcaggcccaggtagagttaatttctgattggtttgtggctggagcttgatgatggtcagtctgcaggagcaggaggatgtggggaaattgggaaaatgagaaaagtcacaaatccaagctcaaactctgcatctattgattgcctgggggaggctaatcagagttgaattcaggatgagcttcagggctgggtcagactgaataagagctgagtgaatgtgggctgatggctccaggcaagtcctggcctccactaggagtcagatcccacaaaccctcctgcccgcagagcaccctctccctccgtagctcatggtggcgcagcctccccaccccatcccatgtacacctgctgcctcatctcagagacactcattccagtgtctctgacagcagatgatgtcagcctcctgggtgtggagaccccagctgtcttggagagtcctcagtgcctgggtactctcagaccccctgtctctgcctccagcacatcagagacatagcagctgcctccaccagagctgctgggtgatcccaacaggccagggacagagcctgcaaagacaggaatctctgcagtcacaatgaggcaaagaaagagccccttagagcttgatcacagccacccctgatccaaatcccagcctctcattagaaggaggcttgagggttctgttgccacagcacctgtctgagcccatttcatggaggggaaaactgagatgaccaagggccagatccatagtcctgctgggcacaaggccatccccagcagctgcctaatctttgactgtgttataagtttccattatggaaaactttgaacacatacataaggagacagagaaataataatgcccccaagttcccatcacccagcccccccaataagcaattcacagacattactgacccacccatagcagaataacccctccattacacaataccagacatcacatcttttcagctgtaaatatcccatttctatgctggaaagatatgggcttaaaagtaactgcaatattattaccaaacctaaatagaaattatcactaattccctaatatcaagaaataatcatgggctcctcaaatccctcacaaatgccagaagcgtattgacttagttaagtgttggtgctgtggttattttggggttttgggtggtttatttcagaattcaatatggcatcaaatggtgatgggcgcatgtgctgtcaggccagttgtcactggtgaatatttcctcaattgctctagtgctgcctggcaaggcaggagctgcaggagttgagagctgtccggggaccttcccacggttggaatacagccacacctcccaaaacaagaacccagggctatcatctacttctttttttttccccctgcaaaatggttctagcatggagggacttaactggattcagactagacattgcaaaatagcttccaaggacagggagctgctaacagcgagatcacccatgtcagattctcactcttgtagtaatgttagctgcataggatggtcaatagctacatccctcagaagggaaggaaggcagagggatgaggcttcagttcacctccttctcatgagtgctgcagagcatctgtgaattcagaggtctgcagctgggctctgttcacccaggagtgtgcttcatgctctaggaaggagccactttgcacacagatgatccggggcccagccatccttccagggtgaataattaatgtcttctctcatggtgaactctaggattcaagccatctaatgtttttgaagccactgtcattatatttaattgatgatgacaggtggccaccaatgatgaatattttcccagggggagtctccctaagtggctttagacttcctcacatggccccaggggattaaatggctcctgattactcagaggataagaggttctgtcttatcatgttcctttcttatttgtcttatgtgtctttcctgccccaggcctgggatcccccactgatctcccttcccttagtgagaggtggtatttggagaccacattctggaggctcccttatgtcccccatttgaaaaagacaacggcagccaccaccccagctgtcccacccaacatgaggccagattcggggtgcagggatgctcccaaggttaccctaacagatgtgactggcacttcatattgggaccagccaggcctcactgaccaggcctatccaactagaactactccagaaggtggggctgaaacccaccaaggttcccagaacactgcactctagggcaatcagcctctgcatgggaggagaggggcaccctctgcaccaccccatggtgttaccaaaagttgaaccatgggttggttcaactttgcagagaagagaccacctaacccatctgtggaaattcactccttagcgatactgatgctccctaagaaattcaatcctgggcctgagtgatggttggtgcaaaaaacaaattcaagatcccagtgtcctccagaagcctggatttccagggatcctgctgtgagtcacaggacgtcaccggtccccttctctttgtgggttgagtgtgggggccatgtggactccctcatgagcagatgccaccagggccactggccccagcttcctccttcacagctgcagtgggggctggggctggggcatcccagggagggtttttgtatgagcctgtgtcacagtgtgtggtattcggcggagggaccaagctgaccgtcctaggtgagtctcttctcccctctccttccccgctcttgggacaatttctgctgtttttgtttgtttctgtatcttgtctcaacttgtggtcagcctttctccctgcatcccaggcctgagcaaggacctctgccctccctgttcagacccttgcttgcctcagcaggtcactacaaccacttcacctctgaccacaggggcaggggactagatagaatgacctactgagcctcgtctgtctgtctgtctgtctgtctctctgtttgtctctctgtctctctgtttgtctctctgactgtctgacaggcgcaggctgggtctctaagccttgttctgttctggcctcctcagtctgggttcttgtcggaacagctttgtccttgggttacctgggttccatctcctggggaattgggaacaaggggtctgagggaggcacctcctgggagactttagaaggacccagtgccctcggggctgatgctcgggaatcacagagctgggacccagagccaggatccagacccagaatgaggtaggaggtggaggggctgccctgggcgtctgggggctgccagggactgagccctgagccagcctgagactcaggaaaccccgtcaggagggagaagggagaagcagactctggacaccagaaagccaggggaagggtcacaaaaggagtggatgtgacggaagggcgggctcctgggtctcttcagaacatatcccctgtgcccagggggatcagaggggcagagtccactgcgtgaaagccccactgctatgaccaggtagccgggacgtggggtggatgccagaaaagactccacggaataagagagagcccaggacagcaggcaggctctccgatccccccaggcccttgccccatacacgggctccagaacacacatttggctggaacagcctgagggaccaaaaggccccagtatcccacagagctgaggagccaggccagaaaagtaaccccagagttcgctgtgcaggggagacacagagctctctttatctgtcaggatggcaggaggggacagggtcagggcgctgagggtcagatgtcggtgttgggggccaaggccccgagagatctcaggacaggtggtcaggtgtctaaggtaaaacagctccccgtgcagatcagggcatagtggaaaacaccctgacccctctgcctggcatagaccttcagacacagagcccctgaacaagggcaccccaacacctcatcatatactgaggtcaggggctccccaggtggacaccaggactctgaccccctgcccctcatccaccccgcaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgcactcaataaaccctcaataaatattctcattgtcaatcagaaatcttgttttatctcattttttcttttctcacatataattcctagcctttcctgggttctcaatttgtggtggaaagaaccctgaacccagtgggaaagttgcctatgtgaaggggttctcagttccctgggcatctctgcaggtaaggccttcctcacccagacaccccttcctcagctctccactgtacccctgagccaccagcctcgcctggctgggaccaggggggtgtcacactctcctagattctgcctttcaacagaaacctaaccacgcatcacacggcacttctcgcatgccttctgtgtctgctccagtctctgggctaaagagttgctggtccgggacaggggataggtccgctcttggtcagatgccaggtccctgccatggcatccctgaccctatgcaacaagccagtgactctggtgagctctctgtgtcaggagaatccatgatccagagtttcatattgtcctgcaagcatctggtgggctgtagctcttgccaaactgggaaataccatggcccagcatcaggatgcaggacagtccggagagggaaatcaggagaagtgaaggggtctctggggagcccagatgtgggctagaggcagaagtaagggtgaagagcacctatgagtcaatgtcatggtctcagcaggaacacagttgaaaatccccattccacacaagaccgtttagcaggaaaggagtccatacttgtgctgccaccaggatgtcctgagaagccttggagaatgaaacatacaggtgcatttcctagacttgacaatgcacgttagccaagtaaaggcaatgaaaagttctctactagggaaataatttcctgtggtaaagcttagcttatgtaaagtcacatttatccatctggcacctctaaaagccccataatattctgcaagatactagtatgtcatggaagtagtttatgaaacataaagtgagatttaagaacaaagatgttacgggtgtatgataagatggctacaggctcagggtcaggctcgaggagtgaaggaggccgtgtcaaattcatgacaagagttggagctgggccaggctgggtcagggctgtgtgaatgcagacagagggctacaggcaaggtcaggcatccatgaacactcagctcccccagaccctcctgcccactgggaccttcgccctcccttggtcacagtggtggagccttcctacccaaacctctatggaggccctggatgactgtgcgttcttagtgcccacgcaaacttagactccctgtctctgcctccagcacatcaggaatgtggcagctgagttcaccagagctgctgggtggtcccgacaggccagggacagagcccgcaaagacaggaagctctgcagtcacaatgaggcagagaaatggccccttggtgcttgatcacagccacccctgatccaaatcccagcctctgaattagaagaaggctaaaaggttctagtggccacagtccctgtctaagcccatttcacaaatgagaaaactaagaccacccaaggagggccagttacgtaggcctgctgggtacaaggccaaggtctacttcacacccagcagctgtccaaagactgagctgtgtcataagtttatattatgaagaactctgaacatataaataaggagacagaaaaataacagtgtcccatgttctcatcacccagcactcaaaataagcaattcacagatgatgccgacccacccacagcaaaataaattctcccttacacaacatttagaaagaaatacaagacatcagatctgttcagctgtaagtactccattactgtcctggaatgacatggaccttaaaataactataatatcactaccaaacctaaatagaaattatcactaattccctaatatcgagaaataagcagggtctcctcaaatgcatcagaaacaccagaagtgctttggcttagttacatgttggtgctgttggtatttgggggtttaagtttatatgaggagcaatatgacatcaaatggtgatgggtgcatgtgccatcaggctggttgtcactggtgaatatttcctcaattgctctagagcctcccggcaaggcaggagctgcaggagctgagagctgtctggagaacttcccctggctgctatacagccacgcctcctggagcaggaacctagggcttccctcagcttttattttcctggaaaatgattctagcatgaaggggattaacttgattcagattggacattgcaaaatagcttgcaaggacagggagctgctaccagcagagtcacccatgtcagactgccactcttgtagtaatgttagctgcataggatggtcaatagctacatccctcagaagggaaggaaggcagagggttgaggcttcagttcacctccttctcatgagtgctgcagagtgtctgtgatgtcagaggtctgcagctgggctctgttcacccaggagtgtgcttcatgctctaggaaggagccactttgcacacagaagatccggggcccagccatccttccagggtgaacaattcatgtcttctctcatggtgaactctaggattcaagccatctaatgcttttgaagccactgtcattatatttaattgatgatgacaggtggccaccaatgatgaatattttcccagggggagtctccccaagtggcttcagacttcctcacatggccccaggggattaaatggctcctgattactcagaggataagaggttctgtcttatcatgttcctttcttatttgtcttatgtgtctttcctgccccaggcctgggatcccccactgatctcccttcccttagtgagaggtgatatttggagaccacattctggaggctccctcatgtcccccatttgaaaaagacaacggcagcctccaccctagctgtcccacccaacatgaggccagattcaggggtgcagggatgctcccaaggttaccctaacagatgtgactggcacttcatattgggaccagccaggcctcactgaccaggcctatccaactagaactactccagaaggtggggctgaaacccaccaaggttcccagaacactgcactctagggcaatcagcctctgcatgggaggagaggagcaccctctgcaccaccccatggtgttaccaaaagttgaaccatgggttggttcaactttgcagagaagagaccacctatcccatctgtgga

SEQ ID NO: 1968 - DNA, 175559 bp, Homo sapiens
agactgttaattactgaccttagaccttatacctaatgatctcattggtcatgtctgtgggcacagcatacaggtaggaatggaaaaaaaaaattgttactggagattaagtaggatcaagcatgtgaaggaattcatgagttacctacagatgttagattaataatgagaatggcttcctagtgtcttcaatcctcattcctgctattacactctctggttttacttcccattgatggctgcccccttcttctcaccaagccattctcactgttagcctgatctgcagggtgatgtagtagtacccttaagctgagccccagctggaaagagcctcagactgattatggggccttgtgagtttctggatttagataatccctatacagtctagttcatggagccaagatttggcctagtactttaatttcttgtaggagtggagttctgcagtcattttattcgtccctcttcttagggactagagctctgaatctgagcacaggtttttgggtagtgctgtgtctctggccagacctcttagcttactaaaacataaattccccatgcctggtctgacccgtatgttgatcctgccatcacatcatctaaactggccggcacagtggctcacacctgtaatcccagcacttggaggccgaggtgggaagatcacttgaggtcaggagtttgagaccagcctggcccacatggtgaaatcccgtctctactaaaaatacaaaaattagctgggcctggtggcggccgcctgtaatcccagttactcaggagggtgaggcggaagaatcgcttgaacccgggagatggaggttgcagtgagctgagattgcaccagcctgagcgacagagtgagactccgtctcaattaaaaaaaaaaaatcatctaaactgctttgacttttctcaccaactttgggctcggagattatttctcttttgcttttcaacactactgggcatgtttagatctggatcctggcccccttcccaatggccctgtcctcctttatttaaatagacaaaattcagctccattttgaaagtaggattcttttcacaacaattgggaaaaatgattttttttgttttgttttttgtgagatggaattttgctctgtcgccaggctggagtgcagtggcacgatcttggctcactgcaacctctgcctcccgcattcaagtgattctcctgcctcagatggccaagtagctgggactacaggcgcgcactacatgcccaactaatttttttgtatttttagtagagacagggttttaccctgttggctgggatggtatcgatctcttgaccttgtgatctgcctgccttggcctcccaaaatgctgggattgcaggcgtgagccaccgcgcccagcctaatgttattgtttttacaaaatatttgaggagctgattgagaggaccttatgcagaaacttaataaacttaaaatcatataatgtgagattgaaatgcttagattattctgtaatatggaaatagcaggtctaatgtaacagacaactccagtaacagaggaaatgtctacctattctttttttttttttgagatggggtcttgctctgtcacccaggcagaagtacaatggctcgatctcggctcattgcaacctctgcctcccgggttcaagcgattctcctgcctcagcctcctgagtagctgggattacaggcatcgcgccaccacgcctggctagtttttgtatttttagtagagacggggtttcaccatggtggtcaggctggtctcgaactcctgaccttgtgatccacccgcctcggcctctcaaagtgctgggattacagacatgagccaccactccccttccatctacctgttcttaaaataaaaaaaacccataaaggtggagaggtaataataacaaaggcctcagatatctatataccaatggagtttgtgggtagtcagtaatgtattctaaccccagatggcatgtaacagcatatgttttttcttttgttttgtacacatattatatatgataatattaaaatagaaaaatactttgttcaatagttatgtaacttgtcgtttaaaaatccttgtacttcaacactgttatcttttatttgtgtttttttgtttgtttgttttgagacaggctctagctctgttgcctaggctggagcagagtggcatgatcttggcttactgcagcctcagtcttctgggctcacatgatcctcccacttcagcttcccaagtagctgggactacaggcgtgtgccacaatgcctggctaatttttgtatttttttttggtagagataagtttcactatgttgcccaggctggtctcgaattcctggcctcaggtgatctgcctgccttggcctcccaaagcgctgagattacaggcatgagcaaccgtgcccagccaacactgctagctttttaaaacagaaagtgagttttatttaggccggccgcggtggctgatgcttgtaattccagcattttgggagactgaggtgagtggatcacttgaggtcaggagttcaagaccagcctggccaacatggtgaaacaccatctctactaaaaattcaaaaattagctgggtatggtggcgtgtgcgtggtggcgtgtgcctgtaatcccagttactagggaggctgtggcaggagaattgcttgaacccagcaggcagaggttgcagttagcagagatcgtgccactgcactccagcctgggcaacagagcgagactctgtctcaagaaaagaaaaaaagaaagtgagttttatttagacaaagatgaaggtttggaaattaaccatatttgtgcttgcaaaaggggcacggatttttaagccctagtctcacaggctctctctgcagcatctgatactgttgcttgattattcctgctttaaactctgtcccttggattccaaggcatcaggtagctgctcttcttttttcttttctgttttttctttctccgacttcttagggatttcttctttcttaactattatgtttttgcaggattctgtcattgatccccttttctttctagctgataccctttcattctcatctactttcatgctatcagttataagctctgtgctgacaacccctaaaaacatgtttctaggccgggcgcagtggctcatgcctgtaatcccagcactttgggaggcagaggagggtggatcacctgagatcagaagtttgagaccagtctggccaacatggtgaaaccccgtctatactaaaaatacaaaacaattaaacagcatggtggtgggtgctgtaatcccagctacttgggaggctgaggcaggggaattgcttgaaccagggaggtggaggttgcagtgagccgagatcgtgccacagcactccagcctgggcaacagagtgagacaccatcttaaaaaacaacaacaagaacaaaaaaaacacatttctagcgcaaatgtatcgtttgagctagagacccacatccgtcatcaccctctataggcactttaagtatactgacttctctcccaaacttgaaccttctcttataggccaggcgcggtggctcacacctgtaattttaccactttgggagactgaggttggtggattgctggagctcaggagttggagaccagcctgggcaatgtagcaaaaccccttctctactgaaaatacaaaaattggctgggtgtggtgaagcacatctgtggacccggttactctggtggctgaggcacaagaacccttgagcctggaaggtgggggttgcagtgagccgagattgcgccactgcactccagcctgggcgacagagcaagactgtgcctcaaaaaaaaaaaaaaaaattcctttaaaggaattgtattaagttcttatcagtgttgtatttttcttcctagatctcatattttggattctggatatattataatgagtgacactttgacagcggatgtcattggtcgaagagttgaagttaatggagaacatgcaacagtacgttttgctggtgttgtccctcccgtggcaggtaagcaattattgtgtgtgtgtgtgtgtgtgtgtgtgtgtgtgtgtgtgtgtgtgtgtgtgtgtattttgcagctgtttctgtgtaagcttctcagtagcactttataccacaaattttgacgaaattaacaactaatttataggtgcctcctgtatccagttttatctgagtgacagtatcctgtggtatctatgattttgtttaattatatgccatttaattatttagtgttgctatcttatataaaatcaaccttaaaatatcttctgaggaaactataaacagctaaaagtcttgaaacctcataaacctcaactcaagtaatttttttgaaatttcttttgtcattaatccacgtgtgtaggtatctaatatagtttaaactgatacacattacaatttttgttaccttttttttaaacttattttttggtataaatttacctatgtttctacagcattattttgcaatatttcttctttttttgattttgcgtatttcttaattattacatttagtataatatatagtttgtttaattgttccccatttttggatgttaatttctagtttttagagtaaataataatgtagtagacttactcataagtcttagtcaacaaaaatttgactgttttctgtgtattttgagacagagtttcgctcttgttattcaggctggagtgtagtggtgcgatgttggctcaccgcaacctctgcctcctgggttcaagcgattctcctgcctcagtctctcgagtagctgggatttcaggcatgtgccaccacacccgactaattttgaatttttaggggagacagggtttctccatgttggtcaggctggtctcgaactcctgaggtgttctgcctgcctcggcctcccaaagtgctgggattacaggtgtgagccaccgtgcctggccaataaggaggctttctatgaactgggcaactgctggaaccaagctgatatgggtttactagctgattgcaatgtgcccagaattagaatatttatccatatttttacattacccatccctcttgtttcttctgagctgcagccagagatcaccagttggttcacaggaataagcagggttagcctaaattgaagaaacaaacttaaaaacaactaatgagactagaatctaatgacaaatgccccatagttcttgaaacataatttttctctctagtttccaagttttactaaagacaagtcatggtaagactgatttgcttgggccgggcacggtggctcacacctgtattcccagcactttgagaggccaaggcgggcggatcacaaggtcatgagattgagaccatcctggctaacacggtgaaaccccatctccagtaaaaatccaaaaaattagccggatgtggtggcgggcacctgtagttccagctactaagggagactgaggcaggagaatggcatgaacctgggaggtggaggttgcagtgagccgagaccacgccactgcaccccagcctgggcgacagagcgagactccttctccaaaaaaaaaaaaaaaaaaaaaaaaaaagactgatttgctttattgtaattggcctgattatttgtataaagtgcagcaagaataattatttttcttttttttctttttttaattttttaattgtatttttattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtcctcagagtgtgatgttcaccttcctgtgtccatgtgttctcattgttcagttcccacctatgagtgagaacatgcagtgtttggttttttgtccttgtgatagtttactgagaatgatgatttccaatttcatccatgtccctataaaggacatgaactcatcattttttatggctgcatagtattccatggtgtatatgtgccacattttcttaatccagtctatcattgttggacatttgggttggttccaagtctttgctattgtgaatagtgtcacaataaacatacgtgtgcatgtgtctttatagcagcatgatttgtagtcctttgggtatatacccagtaatgggatggctgggtcaaatggtatttctagttctagatccccaaggaatcgccacactgacttccacaatggttgaactagttgacagtcccaccaacagtgtaaaagtgttcctatttctccacatcctctccagcacctgttgtttcctgactttttaatgattgccattctaactgatgtgagatggtatctcattgaggttttgatttgcatttctctgatggccagtgatggtgagcattttttcatgtgttttttggctgcataaatgtcttcttttgagaagtgtctgttcatgtccttcgcccactttttgatggggctgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtcctggcccatgcctatgtcctgaatggtattgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacatggcgatgcgggctcttttttggttctatatgaactttaaagtagttttttccaattctgtgaagaaagtcattggtagcttgatggggatggcattgaatctgtaaattaccttaggcagtatggccattttcacgatattaattcttcctacccatgagcatggaatgttcttccatttgtttgtatcctcttttatttcattgagcagtggtttgtagttctccttgaagaggtccttcatgtcccttgtaagttggattcctaggtattttattctctttgaagcaattgtgaatgggatttcactcatgatttggctctctgtttgtctgttattggtgtataagaatgcttgtgatttttgtacattgattttgtaacctgagactttgctgaagttgcttatcagcttaaggagattttgggctgagacagtggggttttctagatatacaatcatgtcatctgcaaatagggataatttgacttcctcttttcctaattgaataccctttgtttccttctcctgcctaattgccctggccagaacttccaacactatgttgaataggagtggtgagagagggcatccctgtcttgtgccagttttcaaagggaatgcttccagtttttgtccattcagtatgatattggctgtgggtttatcatagatagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctattgattggaatagtttcagaaggaatggtacctgttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttctttttattagtcttgctagcggtctatcaattttgttgatcctttcaaaaaaccagctcctggattcattagatttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgttgtcccagagattctggtatgttgtgtctttgttctcgttggtttcaaagaacatctttatttctgtcttcatttcattatgtacccagtagtcattcaggagcaggttgttcagtttccatgtagttgagcggttttgagtgagtttcttaatcctgaattctagtttgattgcactgtggtctgagagacagtttgttataatgtctgatcttttacatttgctgaggagagctttacttccaactatgtggtcaattttggaataggtgtggtgtggtgctgaaaaaaatgtatattctgttgatttggggtggagagttctgtagatgtctattacgtccgcttggtgcagagctgagttcaattcctggctatccttgttaactttctgtctcgttgatctgtctaatgttgacagtggggtgttaaagtctcccattatcattgtgtgggagtctaagtctctttgtaggtcactgaggacttgctttatgaatctgggtgctcctgtattgggtgcatatatatttaggatagttagctcttcttgttgaattgatccctttatcattatgtaatggccttctttgtgtcttttgatctttgttggtttaaagtctgttttatcagagactaggattgcaacccctgcctttttttgttttccatttgcttggtagatcttcctctatctttttattttgggcctgtgtgtgtctctgcctgtgagatgggtttcctgaatacagcacactgatgggtcttgactctttatccaatttgccagtctgtgtcttttaattggagcatttagtccatttacatttaaagttaatattgttatgtgtgaatttcatcctgtcattatgatgttagctgtttattttgctcgttagttgatgcagtttcttccagccttgatggtctttacaatttggcatgattttgcagtggctggtaccagttgttcctttccatgtttagtgcttccttcaggagctcttttagggcaggcctggtggtgacaaaatctctcagtatttgcttgtctgtaaagtattttatttctccttcacttatgaagcttagtttggctggatatgaaattctgggttgaaaattcttttctttaagaatgttgaatattggctcccactctcttctggcttgtagagtttctgccaagagatccgctgttagtctgatgggcttccctttgtctctggctgcccttaacattttttccttcatttcaactttggtgaatctgacaattatgtgtcttggagttgctcttctcgaggagtatctttgtggcattctctgtattttctgaatctgattgttggcttgccttgctagattggggaagttctcctggataatatcctgcagagtgttttccaacttggttccattctccccgtcactttcaggtacaccaatcagacgtagatttggttttttcacatagtcccatatttcttggaggctttgttcatttctttttattcttttttctctaaacttcccttctcgcttcatttcattcatttcatcttccatcactgataccctttcttccagttgattgcatcagctcctgaggcttctgcattcttcacgtagttcttgagccttggctttcagctccatcagctcctttaagcacttctctgtattggttattctagttatacattcgtctaaatttttttcaaagtttttaacttctttgcctttggtttgaatttcctcctgtagctcggagtagtttgatcgtctgaagccttcttctctcaatttgtcaaagtcattctctgtccagctttgttccgttgctggtgaggagctgtgttcctttggaggaggagaggcgctctgctttttagagtttccagtttttctgctctgttttttccccatctttgtggttttatctacttttggtctttgatgatggtgatgtacagatgggtttttggtgtggatgtccttcctgtttgttagttttccttctaacagacaggaccctcagctgcaggtctgttggagtttgctagaggtccactccagaccgtttgcctgggtatcagcagcagtggctgcagaacagcggattttcgtgaaccgcgaatgctgctgtctgatcgttcctctggaagttttgtctcagaggagtacccggccgtgtgaggtgtcagtctgcccctgctgggggtgcctcccagttaggctgctcaggggtcaggggtcagggacccacttgaggaggcagtctgcctgttctcagatctccagctgcatgctgggagaaccactgctctcttcaaagctgtcagacggggacatttaagtctgcagaggttactgctgcctttttgtttgtctgtgccctgcccccagaggtggagcctacagaggcaggcaggcctccttgagatgtggtgggctccacccagttcgagcttcccggctgctttgtttacctaagcaagcctgggcaatggtgggcacccctcccccagccgcgctgctgccttgcagtttgatctcagactgctgtgctagcaatcagtgagactccgtaggtgtaggaccctccgagccaggtgcgggatataatctcctggtgtgccgttttttaagctcatcagaaaagtgcagtattagggtgggagtgacccgattttccaggtgccatctgtcacccctttctttgactagcaaagggaactccctgaccccttgcgcttcccaaatgagggaaagatgttacaggaaatggtctcaatccagaccccaaaagagggttcttggatctcgtgcaagaaagaattcagggccagtctgtaaagtgaaaacaagtttattaggaaagtaaaggaataaaagaatggctactccatagacagagcagcccctccaggggattctgatgcacaataaggtttggtgaaagccattgaacaagatacatgtggactctgccttcatggaggctgtggaagtctttaacatatacctaatctgtcaagggtttttactttcctggtattatttgtaaatgggaagagaaagtaatgtttaatgaataattactgtgtaccagacacttgaaagcatgctctcaactttgaatattccaataacaaccttaaaatatagatgttactattcctatgtttatagacaagaagaccaagtctcaggtcttaaaacttttatatagcagagctgggatttgaatctatccttcattgcccatgccctttcttctctgttacttcttttttttttttttttttttttgagatggagtctcacttttgttgcccaggctggagtgcaatggcatgatcttggctcactgcaacctccgcctcccaggttcaagtgattctcctgcctcagcctcccgagtagctgggattacggggacccaccaccacacccagctaatttttgtatttttagtagaggcagggtttcaccatgttggccaggctggtctcgaactcctgaccttaggtgatctgcctgcccaagcctcccaaagtgctgggattacgggcatgagccactgcacctggctctactctgttacttctaaggaatgtgaatattctcaggttcttgacatatgttgccaaattgttgtctgcaagtcagtcaatgtccggtacttggaaatttccaatattcacattctctgggaagcagacttagctagagatttacacttagaaagtttagtgttcagaaagttttttagggagtactttgggaccagtactcatggaagaggaaagagagtaagcaaggttgggcagagggctaagctgggctatggtacagcctcaacaaatatttcagctgtctcctttgggtgctctgaagatagagtggcctttcagagtctttcctagtggagatgaggggctgggtcattatacattagtgatgatctgtcactaggttctgttgaccctaggaagggggtgtgcccttgggcaagatgctttctacagtagacagttccataagagggcagacagttgagggctatttaccaaaagccagtcctcccagctattgggagataagtcccaattcttgaagacagggtggcatatcactagtacagtaatatagataaaagttttttaatgatagtttagcaaacgtgaagtttttaatttatttaaattttatttattaaattgcctgtgaatgtgacactttcttcatgcatgttttatcaggtaagtgcttctttctcccttgaaaattgtaattctgcagagagggagctactgtaaatttaagctttttgtttgtttgtttgtttgaggttgagtttcgttcttgttgcctaggctggagtgcaatggcacaatctcggctcattgtaacctctgcctcctgggttcaagtgattctcctgcctcagcctcccgagtagctgggactacaggcacctgccaccacacacagctaatttttgcatggtttttttggtagaaacggggtttcaccatgttggccaggctggtctcaaacacctgacctcataatctgcccatctctacctcccaaagtgctgggattacaggtgtgagccaccacgcctggcctgcatttagtttagaggtcatcttttggaattggtactaagatgcacagaaattgaacacagatttagtaataatttctgcggttacttcactggatgttgtagagctgttatgacaactaaatcagttagatgtttaaagcacttagaccagttaatcgtgcatattgttgtaaataaacattttaaaacttactttaaaaagaaatgcagactgggcgtggtggctcatgcctgtaatcccagcacttcaggaagccaaggctgtagatcacttgaagtcaggagtttgagaccagcctgaccaacatgttgaaaccctgtctctactaaaaatacaaaaaaaattagctgggttttgtggtgcgctcctgtagccccagctacttgggaggctgagacagcagaatcgcttgaacacgggaggaagaggttgcagtgagacgaaatggcatcactccattccagcctgggtgacagagtaagactgtctcaaaaaaaaaaagaaaaagaaaaagaaatgcaattgtactaatgttctgcaaatggcttcttgtaattggagatattatttcctgtgatagcatcatacaaagatttaaaaagtattacatcttaaactgttcagatggaataaagatgatatactgtggtgggcaggataatagcctcccaaagatgtccccagaacctctgattttgctaggttacatggcaaaggggaattagaattatagatggaattaaggttgctaatcagctgattttaagattgggagagtatccggtttatccagttgggctcagtgtaatcacaagaatcattagaagtagaagctaggctagacgcagtggctcacacctgtagtcccagcactttgggaggccaagtcggatggatcacctgaggtcaggagttcaagaccagcctgaccaacatggtgaaaccctgtctctactaaaaatacaaaaaatacaaaaattagtcagatgtggtggtgcatgccaataatccgagctacttgggaggctgaggcaggagaatcgcttgaacctgggagacggaggttgcagtgagctgagatcgtgccattgcactccagcctgggtgacaagagcgaaacgtctcaaaaaaaaaaaaaaaaaaaagtagaagctagaggcagaagaggcagtgtcagtgtgacgtgagaatgtttcagctggccattgtttattctgaagatggaagagggtcatgagctaaggagtgtgcagcctctaagcctctagaagctggaaaaactttcctcatatgataaggaagctatcatgtaaaggttcatcttacatttcttgctgttttctttctttcttttgctggcaaatatcattcaggggccacagtatgggctgcagcggtgttcattgctactgggttggtcttcgtttctgggcctttttaaaggacagagctgcctctgttggattaattcctacaagtagaatagatttaaggaagatatgagtagtttttatattattattagaaaatacaaaaaagaaaaggtttcaaaaatatagaaagtagagagaataagccaggcgtggtggctcacgcctgtaatcccaacactttgggaggcaggtggatcacttggtcaagagttcgagaccagcctgggcaacatggcgaaaccctgtctctactaacagtacaaaaaaaattagctgggtgtggtagtgggtgcctgtaatcccagctacttgtgaggctgaggcaagataattgcttaaacctgggacgtggaggttgcagtgagccgagattgcaccactgcaccccagcctgggccacaaagactccatctcaaaaaaaaaaaagcgtagacaaagaaagtagagagaatagtataatggacacctgtatatgcttgtcatgtcagtttaacaattgttaacatgttaccataccatatttgcttcatttccttttttttttttttttttttttttgagatggagtcttactctgtcacccaggctggagtgcagtggtacgatctctgctcactgcaaccactgcttcccaggttcaagcggttctcctccctcagcctcccaagtagctgggattacagacttgcaccactatgcccagctaatttttatatttttagtagagatggggttttcccgtgttggccaggctggtcttgaacacctgacctgaggtgatcaacccacctcaccctctcaaagcgctgggattacagatgtgagccactgcactcggcccatctcttattttttgcttaagcattttaaattatatacggagtagcatttcattcctaaatactttacattgtaattctaaaaaaaaaatacgttttcttacaaaactgtacagtttaaattgtgattcataggttgggtatggtggctcatgcctgtaattgcagcactttgggaggctgaagagggaggattgcttgagctcaggagtttgagaccagcctaggtaacgtaacaagatccctgtctctagcaaaaataaataaataaataaataagtacataaataaaaaataaaatcagccaggcatggtggcatgtgcctgtagccccagctacttgggaagctgaaatgggaggattgcttgagcccaggaagttgagcctgcagtgaaccgtgatcgtgccactgcactccaggctgggtgacagagcaagtctctgtttcagaaaaaagaaagttgtgattcatattgtcaaattgctgaacagaattttttttttttttttttttttttttttagacagagtctcgctcttgttgcccaggctggagtgcagtggtgggatcttggctcactgcaacctccgcctcctggattcaagcaattctcctgccttagcctgccgagtagctaggattacaggcacccccctccatgcccagctaatttttgtattattggtagagatggggtttcactgtgttggccaggctgatctcgaactgctgacctcaggtgatccgcccacctcagcctcccaaagtgctgggattacatgcctgagccaccacgcctggcccagaattgttttaaatcagtaaatccagattattgaaaaacttgattctatttcacatcttggtttaattctttagtccaaagtggtgtccattctttaagattttaagatggggtagtcacatgctcttttaatctgctgtcttttaacaaaattatttgccaggcatggtgactcaggcctgtagtcccagctactgggaggctgaggtgggaggattgcttgagcccataagttcatggctgcaatgagctataatccagcctgggcaacagagtgagatgctgtctctaaaaaaattaataaaaaaaaattctgctttagcttttttcttgattaattttagacatgagtttcttagcttcccatatagagaaaaatctaatttttatcccaccatttcctgtggttacactttgtttttcaccaaaatgaaatgtttgtttataaagacttctgtagcatttatttacctactattggcttttcacattatttatatactgagttataatgctagagatattttaaaaaatagtatttaatggtcgggcgtggtggctcacgcctgtaatcccagcactttgggaggccgaggtgggtggatcacaaggtcaggagatcgagaccttcctggctaacacggtgaaaccctgtctctactaaaaatacaaacaattagcctggtgtggtggcacgtgcctgtaatcccagctacttgggaggctgaggcaggagaatcgcttgaacccaggaggtggaggttgcggtgagccgagatggcgccactgcactccagcctgggtgacagagtgagactgtctaaaaaaaatagtatttattgattatatcttattattgttgttttattgctgttcttgttccagagttttaaatgtttttttttcatttactgtattgaaatatattgaaataataatacctggagaatagagttgacacaggtagtctggtagcaaatctcttcataaagtatgtacagcagtgatgttcttttagcagttgtatacacctttcagaagaatcatgcttttatcctcctacagagcaaatagatatatatgtattttaatatggtaatgacatgatatgttttcatgttctgggagtggatgaaggaaacagctaagcttactgactgttgcctaggggaacatctaaagattgtatcaaaccaaagttcctgcctttgacagacacaccgtggtatttaggtgaaaattgtagtgtaattaagtaggtaattaagttatttatttcatttagtgatttcagggtgcatattgtagtttacttattactaggatgcagccctacttaaaatttgtaacaaattttattttatttttatttatttttttgagacggagtctcgctctgtcgctcaggctggagtgcagtggtgcaatctcagctcattgcaagctctgcccgctgggttcacgccattctcctgcctcagcctcccgagtagctggaaatacaggcgcccaccactacgcccagctacttttttgtatatttagtagagacggggtttcaccgtgttagccaggatagtctcgatctcctgacctcgtgatccacctgcctcggcctcccaaaatgctgggattacaggcgtgagccaccatgcctggcctgtaatgaattttattatagacatttgataatttttgataatttctttttttttttttttttttttttttgagacaggttgtcactctgttgcccaggctggagttcagtagtgctatcatagctcactgtaactatagcttctgcacctgggctgaagtgattctctcaccttagcctcccaagttgctgggactacagatgtgcaccaccatgcccagctaattttttgtattttttagagagcgggttttgccaggctggtgtttagcacctgggctcaagcaatctgcctgcctaggcctcccaaagtgctgggattacaggtgtgaaccaccacacctagcccttattttttgagacagagtcttgctctgtagcccagggtggagtgcagtggcatgatcatagctcactgaagcctcaacctctggggcccaagtgatcgtcccacctcagtctcctgagtagttgggattacaggcactagccaccataccttgctaattttttgttgagacaaggtcttcctatggcgcccagactggacttgaactcctgggctcaagcgatcctcctgccttggcctccgaaagtgctgggatcacaggcatgagccacagttccaggccagcttatatatttgtaatgctgattactattccattgtctggatgtaccacggtttattcttcacctactaaaggatattttgttttctggtttggggaattatgagtaaagttgctttaaacatttgtgtgcaggtttttgtgtggacataaattttcaacttatttgggtaaataccaaggaggatgatttctggattgttggattaattcttttaatttttgtgggtacatagtaggtgtatatatttatagggtacaagagagattttgatacaggcatataatacataataatcacatctaggtaaatgaggtatccatcaccatttattctctgtttgttacaaacagcccaattatacccttttagttatataaagatgcacaataaattattgttgatggtagtcaccctgtcatgctatcaaacactagatcttatttatgctatctgtatttttgtgcccattaaccattcccactctctccccctgcccagccccccagcctttagtaaccatcattctacttcttcttcttcttttttttttttttaaggtggagtctcgctctgtcgcccaggctggagtgcagtggtgccatcttggcccacagcaacctccgcctcctgggttcaagcaattcttctgcctcagcctcccaagtagctgggattacaggtgtgcaccaccacacctggctaaattttgtatttttaatggagacggggatttgccatgttggccaggctgctctcgaactcctgacctcaggtgatccacctgccttagcctcccaaagtgctgagattacagacatgagccaccgtgcccagccccgttctacttgctatctccatgagttcaattattttcatttttttagctcctgcaagtaagtgagaacatgtgaggtttgtctttctgtgcttgacttatttcatttaacataatgacctccagttccacccatgttgttgcaaatgacaggatctcattattttttaaggctggatagtattttattgtgtatgtgtttattttctttttctttttctttttttttcttttgagacagagtctcgctttgccgcccaggctggagtgcagtggagcgatctcggctcactgcaagctccgcctcctgggttcacgccattctcctgcctcagcctccgagtagctgggactacgggtgcccaccaccacgcccggctaattttttgtatttttagtagagatgggatttcaccatgttagccaggatggtctcgatctcctgacctcatgatctgcccgcctctgcctcccaaagtgctgggattacaggcgtgagccaccgtgcccggcccttatgtgtttattttctttatccattcatctgttgatggacacttaggttgattccaaaccttggctattttgaatagtgctgcagtaaacataggagtgcagatgtctcttctatatactggttttctttctttttggtatataactagcagtgggattgctggaacatatggcagttctatttttagttttttgaggaatctccaaactgttctccatagtggttgtactaatttacattcccactaacagtgtgtgagggttcccttttctctagcatttattatatcctctcttttggataaaagtccttttaactggagtgatgtgatatctcattgtagttttgatttgcatttctctgatgatcagtgatgttgagcaccttttcatgtacctgcttgccatttgtatgccttcctttgagaaatgtctattcagatcttttgcccatttcttaatcggattaatagatgtttttcccattgaattgtttgagctccttattatattctggttattaatcccttattagatgagtagtttgtaaatattttctcccattctgtgagttgtctcttcactttgttgattgtttatttatttatttatttatttatttatttttcttttgagacaagagtctcgctctgtctccaagctggagtgcagtagcgccatcttggctcactgcaacctccaccgccctggctcaagcgattcttttgccttagccttccgagtagctgggactacaggggtgcgccaccacgcccagctaatttttgtatttttagtagagacggggtttcaccacgttggccaggatggtctcaatctctttttttttttttttttttgagacggagtcttgctctgtcgcccaggctggagtgcagtggcgcgatctgggctcactgcaagctccgcctcctgggttcacgccattctcctgcttcagcctcccgagcagctgggactacgggcgcccgccaggatgcgcggctaattttttgtattttttagtagagacagggtttcaccgtggtgctagccaggatggtctcgatctcctgacctcgtgaccttgtgatccacccgctttggcctcccaaagtgctgggattacaggcgtaagccaccgcgtccggcactttgttgattgtttctttcgctatgcagaacttttgtgatggattaattatttttaattcttgtgatgtcagtgaagttgggcctgattatgattggcttttcatgtggcttgagtccatggagaataggaaacaaattaggttgaccagagtaatcaggtttgtgtgacagctttattaatcattgtgaattaataaacctgtgtgctagtgtctggttcagtcttctgtgcatttggaattttcaaattgaggctatcagggtttgttcgccctggatgtagaaagcaaaaatctggatcttacacattcctgggatctgactggtgaggtatacccttataccatgtctgtccactctcttactcatactggtttctgtagttgctcctctatcattaatgtactggccccaggggaaaagcttgctaaaccatagatattcttcgtcagacttacagctaatcacagttgaatgctggccttgctccttctgtctgctttggcttgaaaaatgacttgtgctttgcagtgtgagagaatggccttattttgtgcattcttctttgtagcatccatcaattcaacccattctgatagtttctatgatgataacatttacttctttctttttttttttttttcttttgagatggagttttgttcttgtcgcccaggttggagtacaatggtgcgatcttggctcactgcaacctacacctcctgggttccagcaattctcccaactcagcctcccaactagctgggattacaggcacccgccaccacgcccggctaatttttctatttttagtagagatggggttttgccatgttggtcaggctggtctcaaattcctgacctcaggtgatccacctgacttggcctccataagtgctgggaccataggtgtgagccaccgtgcccgggtattggaaaatgttttcttttaatgagagcatttataccatttatgttttacttaattattgataatttgggtttatatctctcatcttactacttgctttttgtttgttttgctgacattctgttcctttttttctcccttcattggatgacgatgatgattatttgtggtgttttcttttttttttttttgagacaaggtcttactccattgctcaggctggagtgcagtagcactatctgcaaattctgcctcctgggttgaagcagtcctcccacctcagccttccgagtagctgggactacagctactgtagtcccagctactcggaaggctaaggcaaaagaatcgcttgagccgggcttatttttgtagtttttgtagagatgtggtttcactatgttacctaggctgatctcaaattccagagctcaagcaatcagccagtcttggcctcccaaagtgctgggatcatgggcgtgagctcccgtgcccagccactatttcttttctttttttcttttttgagacagagtctccctctgtcactcaggctggagtgcagtggctcaaccttggctcactgcaacctccatacctcaggctcaagcgatcctcccacctcagccttctgggtagctgggatcacaggcatgcaccaccatgcccaactatttttttgtatttttagtagagacggggttttgccatgttgcctaggctggtctcgaactcctgagctcaagcaatccacccgccttcacctcccaaagtgctgggattacaggcgtgagccaccaagcctagagatgattatttttaccttgtgtttcttctccattagtttggagttgtggtggtatgatatatattggtttttgttcatggttcctggttctcaactcccatacctcttgttacagtcttttgttataatattggtgtgtcaggcctcaggaaacaggatctctctcctgccctccattctcctgccccaaggcagaactctaatcttcttccaccattctgactgtgggtcataagaccctcccggagaggctcccacccctctacactagaggcaggaatgctaatgtctttgaacttctagatagctgaatctgtgaaggttcttgcatccatggagggcttggaagctccacagcccttcccctgtacctcgccttagcacacctcttcatctagattctttgcaatattttttataataaacctgtaaatgtaagtaagtgttttcctgagttctgtgagccgctccagcaaattaatcaaatacaaagagggggctgttggaaccccagctgtttgaagctggtcggtcagaagttccagacgcccaggctagtggctggtggtctgacactatgtccagtcagatagtgtcagaattgaattggcggacacccagatggcatcccctgcttggtgtgtggggaaaacccccacacattcggtcacagaagtcatctgtgctgatcgttgtagtgtgaggaatagtgtagcagaggaaagacatggtttggagagttttaacttatgcagtagttattcattttttatttttccttacacagcagttaattttttattatttagaggtaagtctagagattaaaatatgcatctctggtttacagaaatctagtctaataattatacctccttttggacccatgaaagaccttagaacatgccatttatcaccttcctaactcatatgtgtgacattttaaccgatgtttattttaaacccgaagaactgatattattactttacattgtctgtattactttaacttcacccatatatttacccttttcttgccttttatctccccactccttgtatctttaggcttctatctggtataattttctttttccttgaagactacctttattgggtttttgctgaaattgaaggaaaaaattatttttcctcttttttttttgagatggagtctcgccctgtcgcctaggctggggtgcagtggcgtgatctcggctcactgcaacctccgccttccgggttcacgccgttctcctgtctcagcctccggagtagctggggctataggcgctcgccaccgtgcctggctaattttttgtatttttagtagagacggcgtttcactgtgttagccaggatggtctcgaactcctgacctcgtgatccgcctgcctctgcctctcaaagtgctggggttacaggcgtgagccactgtgcccagccttttttttttttgagacggaattttgctcttgttgcccaggctggagtgcagtggcatgatctcggctcactgcaacctccgcctcccgggttcaagtgattctcctgcctcagcctcccgagtagctgggattactgtcatgtgtcaccacacctggctaattttgtatttttagtagagatggggtttcttcacgttggtcaggccagtctcgaccagtctcgaattcctgacctcaggtgatccgcccactttggccttgcaaagtgctgggactacaggcgtaagccactgtgcctgggctttttttttttttttaatttttattgtagccacatacataacataaagtttgccattttaaccacttttcaatttaacattttaaattgtggtgaaatatacgtaacataaaatttaccatctgaaccagttttgaatgtacagtttagtagtaactaccctaagtatctcatataagtggaatatggtatttgtccttttatggtggcttatttctcttagtgtaatgtcctcaagggtcagttttgtttagtgtgctcaataaattttagccattcttgttttctggagtggtggtttttgttggctttttcacccagacatgctatggcatttgctgattgaagtcctgagtataaggctaacttgtccattccctcctccccaagtggtatctgtgtgatatggtttccgctgcaaattggtatttgcttgcagaaaactggagcattgcctgtatcatcatctgttactcatttggtttttcttgttctgctaggaccctggttaggagtagaatgggacaatcccgagagaggaaagcatgatgggagccacgaagggactgtgtattttaaatgcaggtaacttttcattatgaatcagcacggtcatttagtcaagattatatttaatacttgaataaggagggatggagaggaagaaatgtttggctcatggagtagttatattatggaatttgttgtattccaaaaaggcagttattttatttgtggcttaattgctgctgtttgtagcatttttcccttttttaaaaaaattctgactcttgaccttatgcatggcgttgctttcttcgtcctttttttttttttttttttttttaacagtcctttaaattggatgaatgtaaacctttctggctcattaccaatttacaatccagtaagtaaataatagaaaagagaaacagcctagatttccagtaagaaggaattgattacacaaaatacagaacatctgaatagtggaatgttgagccaccattaaataaatttcttatcataggaagagttacatgtcacattgcatttctttgtctttttttttttttttttgagacggagtctcactctgtcgcccagctggagtgcagtggcacaatctcagctcactgcaacctccacctcctaggttcaagcaattctcctgcctcagcctcctgagtagctgggattacaggtgcccacgaccacgcctggctaatttctgtacttttagtggagacgaggtttcaccatattggccaggctggtcccgaactcctgaccttgtgatccgcccgcctcagcctcccaaaatgctgggattacaggtgtgagccaccacgcccggcctgtcacattgcatttctattattatttttgatcgcctgatgtcagaaaaactgcatgaagccctgaaaagggtgctggggagccttcaggcagagcctgtcttctaaatttttgttgttgttgttgatttttattagttttcaatttctgaaaacgatctttccctagtaagctgtttttccttaagtatggtacagtgaacacaatactgccctggaaatcagggggcctctagcctgtttttaacagtcttttttgtttgtttggttggtttatttgtttattttttgagacattgtctcgcctagactggaatgcagtggcatgatcatgactcactgtcaccctgaactcctgggctcaagtgatcttcgcgcctcagtctcctgagtagctgggactacaggcgtgcaccagcacacccagctaatttaaaaaaataaaaataaaaaagagatgaagtttttctatgctgcccaggctggtctcaaactcctggcctcaagcgatcctcccacctcggcttctcaaagtgctgggattacagatgtgagccactgcaccagccccacttttaacagtctttatggtcctgaacaagacaagtttactaacctttaaaatgaaggtcagaattaggtaaccacacagcatatctcctggtccactatttcataattttagaaagtcagggtgttcttaaaaggccaactctacttgtagacttgccatctctgaatttgttcagagctgttcaggttatatggttagggagaaatattttagccaggcccacagattccttaggtacctggaccatgaccttacaaaccctccagtgaaaggacttttttcttttttttgagatgtagtctcactctgtggccaaggctggagtgcagtggcgtgatcttggctcactgcaacctccacctccctggttcaagcaattcccctgcctcagcctcctgagtagctgggatcacaggcgaacgctaccacgtctggccaatttttttgtatttttagtagagacggggatttcaccaggttggccagactgttctcgaactcctgacctcaggcagtccactggcctcggcctcccaaagtgctgggattacaggtgtgagccaccaccccctgtgaaaggactttttatttggaacttaccccagcctacttccttcttgtaaaagcttgcccaaattgtccatacttttatggtctttaatggtctctggatacagtgatattttcaaagtcttggttgctctgagcagaaaaatcaagaattgcttcaagtcctgggtgatgcagggtttgtcctgaaatgctaatgggaagccttggttcagggacattgagtcagtatagtcatgcattgcttaatgaaggggatgtgttctgagaaatgcctgttaggtggtttcatcattgtgtgaacatcatagtatacttaacaaacctgcgtggtgtagcctactgcacacctaggctactgtatggcatagcctattgcttttaggctataaacctgtacagcatgttactgtgctgaatactgtaggcaattgtaacacaatggtaagtatttatctaaacatagaaaaggtacagtaaaaataaaaaattggccgggtgcgttggctcacgcctgtaatcccagcactttgggaggccaaggcaggcggatcacgaggtcaggagttcaagaccagcctggacaatatgatgaaaccctatctctactaaaaatataaaaattagccaggcgtggtggcgggcgcctgtagtcccagctactcaggaggctgaggcaggagaattgcttgaacctgggaggtggaggttgcagtgagctgaggtcgtgccactgcactccagcctgcgtgacagagcaagactccggctcaagaaaaaaaaaaaattaagcagtgtggggtggtacgggtggtatgtgcctgttagtaccagctacttgggtggctgagtcattaggattgtttaagcccaggagtttcaagaccagcctaggcaacacaatgagatctcatcataaaaaaaaaaaagatagaaaatggtatgcctgcatagggcacttagcgtgaatggaccttgtaggactggaagttgctctgggtaagtgagtgagtggtgagtgaatgtgaaggctgggacattcttgtaccctactgtagactttggaaacactgtagccttaggctacactaaacttagaagttttttctttctttaataataaattaactttagcttcctgtaacttttttatgttataaactttaaattttttttttttttgggatggattcttgctctgtcacccaggctggtgtgcagtggcatgatctcagctcactgcactgcctgggttccaacgattctcttgccttagcctcctgagtagctgagattacaggcatgcgccaccacacctgggtaatttttgtatttttagtagagatgggatttcaccatgttggccaggctggtgtcgaacccctgacctcgtgatcaaccctcctcagcctcccaaagtgctgggattataggcgtgagccaccatgcccggtactttttttttttttttttttggagacagagtcttgctccgtcacccacgctggagtgcagtggcacaacctcggctcactgcaacctctgcctcccaggttcaagtgattctcctgcctcagtcttccgagtagctgggactacaggcgcatgtcaccatgcccagctaatttttgtatttttagtggagacggggtttcgccatgttggccattctggtctcgacctcctgatctcaggtgatctgcctgccttggcttcccaaattgctgagattataggcatgagccactgcactggacctgagccttcttccagaatacctcctgaaggacctgcctgagggtagtttacaattaactttttttttttttttttttaataagtaggagtttgctgggcacagcagctcatgcctgtaatcccagcactttgggaggctgaggcaggaggatcacctgaagtcaagagttcgggaccaccctggccaacatggttaaaccccgtctctactaaaaacagaaaaattagctgggcatggtggcatgcacctgtaatcctagctactgggaaggttgaggcatgagaatcacttgaacctgggaggtggaggttgcagtgagccaagatcacaccattgcactccagcttggtcagcagagtgaaactgtgtctcaaaaaaaaaagaaaaaatagaaggagtacactctaacataatgataaaaagtatagtatagtgaacacttaaactagtaacatagccatttattatcattatcaaatattatgtactatacataattgtatgtgctatacttttatgtgactggcagtgtagtaggcttgtttacaccagcatcaccacaaacacgagtattatgttgtactacagcattaagacagctacagcttcactaggagataggattttttcagctccagtgtgattatgggaccactgtagcatatgcggtccattgttgatctacacgtcattatgtggtgcatgactgtatttggattcttagccttggaataactgcttacttcattatatcgtctagtgttgtgttgtcatgcctaaacatttacataattgaagtacatattatcttattataaataactttttaaaatttaaataggcactttgttgacattaaaaaattatatgagtaggtaatgttatctgtgaattccatttcaggatatttatggggcaatacaaaagagatcattgggtctgaagtggtggagaaccactggtctggactacaggaatttaactggtcctttagagtttgatgatttcatgtcatgttttagtttctctgatctcttttgtaacctaaggtaaatatagtaatctcctgagctattattacccataattaatatttgtaacattagcaattaatagtggtttacagtgtcaaaataaaaataaaatgtgcagatgaatgtctaagtgtaacattttatttgggaagcaagaattgcagttcagggcatccgcacagactagatcgtctttggtatatccaaagaacaaagaacaaagagaaacgtggattttttcttttagtttttgagacggagtctcactcagtcgcccaggctggagtgcagttgcaccatctcggctcactgcaacctccgcctcccgggtccaagcgattctcctgcctcagcctcctgagtagctgggactacaggcgcctgccactacacctggctaatttttgtatttttagtagagatggggtttcaccatattggccagactggtctcgaactcctgaacttttgatctgcccacctcggcctcccaaagtgctgggattacaggcataagccactgctcctgggcttttttttttttttttttttttgagacggagtttcgctcttgttgcccaggctggagtgcaatggcgtgatctcgcctcactgcaccctccttctcccaggttcaagggattctcctgtctcagccttttgagtagctggtattataggaaagtgccaccacgcctggctaattttgtatttttagacaggatttctccatgttggtcaggctggtctcgaactcccgacctcaggtgttctgcctgccttggcctcccaaagtgctgggattataggcgtgaaccactgcacctggcccccgccttttttttttttttttggacgcagggtcttgctctgtcacccaggtagtagtacagtggcacaatcatggctcgttgcagcctcaacctcctatgctcaagcagttctcccacctcattttttgatttttttgtagagatggagactccctattttgccctggctggtctcaaactcctgggcttgagtgatcctcttacctcggcctcccaaagtgctgggattacaggtgttacccgccgtgtcctgtctagtacattttataaaaaggagaaatgttacatattgttctgaaagaaagttcattggcactagtcaagttttggagagctggctagcaagctctgattggtgagtgacagtggtgggtaagattagtcttagagtcacggcagattgttttagtagctattaaataaaactggcttcaggttacaacaggcagtctcagcagctgggcttgtaataaactgaattcttggagcaggtgttgtgtgccccgagcactttttccccttggtcccttgactctgatttagttgggtatgacaagaatgacccagtttctgtaatcaactttcccaagatttatccaagatttatggccgtgcgccagtcacccgtgtccttcctaggtactcctgctctctacttcttgttgaaggggtagttgaggggttcaaatatggtaagtaaccttgaagtcctctttaccttgtccgtagacagcagagtggttttcagttttttttttctttcaacctaaaccccagagtatgctctgaacagagctgtgtgtgtcagtattctgcccactcaccttttatttcagtgcttctgtttccaagcaatggtagaagttctcttttctggtgagaaataaatcttaaaatctgacttttcttcaacactagggagcagaatctaactttaatacttagcatcagagaggtcgtgctgttccagcctgtgtctgtggtaatggacatcttaggaaatggatggttgacaatttaagaaacaaagccctagcaataaaggataagtgtttgaaagaaaggataaatgtttgaagtgatagataccccattcaccctgatgtgattgttacacgtgtgcctgtatcaaaatattgtatgtacccacaaaaattaaaaattaaactaaaaaaagaaagcccttgatttattcatcttttgtgtgtcataagccagttgtaaagtgttttgaggatcttggctgagcattaatggattggtataaaatattctcttggtgtggtgtaaagtgttggaagatttttttttttttttaatcaggaaatgtaatgatagtatgtgggcaaggcgcatctctgttcaaaaaggtggtagctctgcttcatttttggaaggttttcttgaatcagagcaaaatcataattgtgtcaacgcaaaagcagttgagatgaatattaaattcagctgattagagaagcaaacaaaaagagcagtctacagcaaggtgcttatctactgtactgctttactcacaggaaaacaacctctctgggtcagctctttagatgttacagcgctgaacactgcacgaaagctgagttctcctctcctgatgaacagctagttatgcaaccttgctgaacactaaacattcctgaaacaaacagggtatcaagatcaacagtatttattagaaactccccagagacctggccttttccagtagcttgtatccaaagctccaacaagaaagaagcttactgtggaagtctgggagtctgttggggaccctttacctttgtgtagtgttgccagattcagcaaacaaaaataccaaatgcatagtgaactttggatttcagataaacagccaatcttttttttttttttttttagtataagtatgagacatgcatgggggcatacttacttaaaaatgatttgctgtttatctgaaatacaagcttaactgagcatcttcgattctatgtggcagtcctgatggggacataggacagaatgaatcttgataactgggttttatgagcacatgctgtttccacaagggccatgggtcaggatgatgattttaccagcagcatgtgtaattggtaggcagaaggaggaaggaacctgaacaggccaaatgcttccaagagaaacgtttttggacacccctccctgtattctcctcctcaccaacatttttctctttagacatggtttggaatttcagtgtttggatacagtttcttaatatattaatgtagaatctcagtggagtctatgtaaattattacagtttacctcttggagatttgttgttattgatgggcacccattcagctagggtttttcactatttgttgaggctgttttgttttctgagaaacctgctggaaatgttccagaaaatattgatctttagtgttagtctttgatctgtaaagggcatagcatccgttttgcaactacctaacaacattcctaactctcctttcatctgcctgcaactaaactcaacagtaataaagatctgttcatgacttcttgtttttttaccatggttttaaaacttgtttattaccactgttttaaaaagtgtagatttagggcctggcgccgtggctcatgcctgtaatcccagcactttgggaagccgaggtgggcggatcacttgaggtcaggagttcgagaccatcctatctaacacagtgaaaccccgtctctactaaaaatacaaaaaattagccaggcgtggtggcgggtgcttgtagttccagctacttgggaggctgaggcaggagaatggcgtgaacccgggagttggagattgcagtgaaccgagatcgtgccactgcactccagcctgcgtgacagagtgagactctgtctcaaacaaaaacaaaaacaaaaaaaacagaaacaaaaattagccgggcgtggtgttgcacgcctgtaatcccagctactcaggaggctgaggcaggagaattgcttcaacccgggaggctgaggcaggagaattgcttcaaccagggaggctgaggttgcagtgagccaagatcaccccactgcactccagcctgggcaacagagggagactctatctccaaaaaaaattataataaaggaataacgaatggctactccataggcagaacagtcccgaggactgctgggtgcccatttttatggttatttcttgagtatatgctaaacaaggggtggattattcatgcctccccttttaagaccatgtagggtaatttcctgacgttgccatggcatttgtaaactgtcatggtgctggtgggagtgtagcagtgaggatgaccagaggtcactctcatctccatcttggttttggtgggttttagccagcttctttactgcatgctgtttcatcagcaaggtctttaatgacctgtatcttgtaccgacctcctagttcatcctgagacttagaatgcctaacagtctggaatgcagcctggtaggtctcagccttattttacccagctcctattcaagatggagttgctctggttcaaacgtctctgacatatttcccccctcccttttacgagagaacccttaatcctaagggctgcagagggatgaagatccactttctgtaacttctttatgctgaacaggggtgatgatattcctgcctaactgttgggtctcttgcattcagggtagaggagctcagttcgaaagcgttggtatggcgaaggccattcataactcttgagttccgacaaaaggtatatctggaagattaataagtgttcagtttaagaaaacatttagtaagcttatcctgcattcctacacaaagagtataatcacagcaatatattccacaacagtaaaataaaaaaaataaaattatcccaagtaaactgaattagaaagttttccatgaactgggcaattgtttaaatcaagctaataaggagtcactagccaattccaatatgtgcccagaattagaataacattacccatcactcttgtttcttctgagcagcagccagagatcactggttggttcacaggaataagtgggatcattctcttgtcttccataggtctgtgggacacaggtcaggaactgtgtagacaaggagtgaggccagttttcccaagcggcttttattggctctataagtcaagtttgattccataaaggaacacacaccattccagttgaagccttggtaaaataagcagtttctccacttgtgtcccaaggtcacccagtcagtgctgcagactatttcctttgggttggggggcgggtcccctcagtgtcctcctttctgtggttcgccagaaagatgttaccagaaaggggtcctgatccaggccccaagagagggttctaggatcttgcaaaggaaagaatttgaggggaatccatagagtaaagtgaaagcaagtttattaagaaagtaaaggaataataaagaatggctactccataggcagagcagccagtaaactaggcttgtaacttaagagacatgtttaacttacagaaacaaatcactgatgtgtgtgtataagccatgagagagatatgggacttaattttgctacaaaagaggatttaatttcctgcataatcagcttccccctattccactgaattaatttcatcaacatacaaggtggatattttctcctgtcttaagcaatctccctcctttgacccctgtgccccttcaggacaagggtaggctgtgctcacttgcctcccagtctttggaactcaccctcgctgggctttgccctattgccccacccagactgctcgtaggaaaggttatgttcatgttgctggattcagtggcaaggcctcagctgttaccttacctgacctggttttagcattggacatggttgttgactttcttcattggcttccaggacaccacactctccaagtttcccttcccatccctttcccttcccatccctttcccttctcctccccttcccctcccctcccctccccttcccccctcccctcccctccccctcccctccccctcccctcccctccccctcccctcccctccccctccccttccctcctttcccctcccctcgtttccatctgtcgcccaggctagagtgcaatgatgtgatctcagctcattgcaagcttcacctcctgggctcaagcaattctcttgcctcatacttccaagtagcgaaactccaggtaccagcaaccatgcctggctaatttttgtatttttaatagaggcagggtttcaccatgttgaccaggctggtctcaaactcctgactttaggtgatctgcccacctcagcctcccaaaatgctaggatcataggggtgagctaccgcacctgatctcaaactcctgactttaggtgatctgcccgcctcagcctcccaaaatgctaggattataggggtgagctaccgcacccagcccacactctctaagtttctaactccctcctggccacttcttcccaggttggggattggttttaactttttgggatcacaagttccttttagagtctgatcatcactgtgaacccacatcttagagaaaactgtacgtatgtttatgttaacaaaatttatcacaaatattagttttcatccttttcaattattattattattatttttttgagatggagttttgctcttgttgcccaggctggagtgcaatggcatgatcttggctcaccgcaacctctgcctcccgggttcaagtgattctcctgcctcagcctccccagtagctgggattataggcatgtgccaccacacctggctaattttgtatttttagtagagatggggtttcttcatgttggtcaggctgatctcgaactcctgaccttaggtgatccgcccttttcagcctcccaaagtgctgggattataggcatgagctactgtgcctggccagaattatggtgacttctaaaaaggtctgatttctttctttaagagttaatggttgttgcctgggcaacgtagtgagatgttgtctcttaaaaaaagtacgaaaagtgttagctggacatggttgcttgtacctgtagtcctagctacgtgggaggctgaagagggagcattgcctgagccctgggaattggaggctgcagttagttatggttgtgtcactgcactctcaccgaggtgacagagtgagaccccctttctttaaaaaaaaaaaaaaaaaattaggcgtggtggctcacgcctgtaatcccagcactttgggaggtcaaggcgggaggatcacttaaggtcagaagttcaagaccagcctggccaacatggtgaaaccctgtctctcctaaaaatagaaaaattagcctgggtgtagtggcacatgcctgtagtcccagctaattgggaggctgaggcaggagaactgcttgaacccaggaggtggaggttgcagtgagtcaagattgcgccactgcactccagtctgggcaatagagtgagattctgtctcaaaaaaaaaaaagaaaaaaagtaatgatcgtaagctgaaatagtgtttataatacaattttgatcaatttatagagttcactgtttcttctttttttttaagtgacaaggtctctctctgttaccaaaataaaaaataaataagtaaataaataaataaatgattttgtatataatccacctacgatttttttttttttttttttttttttagatggagtcttgctctgtcacccaggctggagtgcagtggcatgatcttggctcactgcaacctccacttcccgagttcaaacaattctcccgccttagcctccctagtagctgggactacaggtgtgcaccaccacgctggactaatttttgtatttttagtagagatgggggtttcgccatgttggccaggctggtcttgaactcctgacctcaggtggtcctcctgccttggcctcccaaagtgctgggattacagtcatgagccaccgtgcctggccacccccatggatttaatacttctgttttttctaatgtgaattgtcagtttcatattacttgttagtttatttaaagggatttaacatgcttgcataagatcataaccctttatggtcaatcatactgattatatattattttagtatgtgatattctcttttatgctaattttgattttttagcatgtagaaatttttgaagaccttcagaaaattgtatttatggcctttcttggtgggtaatattttctgtgtttcatttgctcttctttaccaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaaggtaagtggagtttataacggcagagctgacttttatggttttattaaggttcagaattgaaatacccatgactgtatatggatgctcatgactttgctcctaaactggtttatggttccacagaaacggaatcaaaatctgaggaatccaagaattatttagggaaattaaaattcttatgttagcacaggattggtagatttatccagtttgcaattgaaatatttattggcccattattactattcacatcatattatctcgtgttgactaagtaaccaaggctgacgtttgggttcttttctatttcatggtgatgatggtaagttgggaatggaaacagcagtctgaattgttccctatgccgtggagcgtgctggtgccgtctgttaatagtagggagtagttctcacctcgggctgcacatcttcatcacctggggagctgtggaacatgcggcatccttggtcccatcccagatctgctcaatcacaattttgggatatgggctctaatgcattttattgtattgtattgtattgtatttttatttttatacagacaggatcttgctatgttgcccaggctggtcttgaactcttgggctcaagtgatccttggcttcccaaagcactggggattacagggattaagcacccggccttaaaataatgccctttaaaactgctgcacaagaacattctcttttctctgaaactgtatattgtgactttgtacaaggaggctttctagtcattccagtgaactgcttgaatcaaagagagagaaagatagtatttacacaaaaccagtcatggctgcacaagaactggccaggccttgcagcttcctactgtggtgagtgacttggacgaggcatctgggtaaggacccctggtggccactgtgaggataaatttgtggccacttggaggcctgcaatatattttctttcagtctctaaaagaattaagctatagttctgtccaaagtaaatttctttactatcttttgttattgttgttattaataaaagtgcacatggggacaatgtggaaaataaatacatttcttggtacatctactctttagcatacatggcccccattaaaaaaaactcagaataaatcaagagttttagaaaaaggaacaaatggactgttctttataaaacaagatacctttattgttgagaatttagaaattacagattgaacaaaaaagtatcatgattaatgccaccacttagatataagtatcgtaaacgggctgggtgcggtggcttatgcttgtcatcttagcacttttggaggccgaggcagttggatcacttaaggccaggaatttgagactagcctggccaacatggtgaaaccctgtctctactaaaaatacaaacaattagctgggtgtggtggtacgcacctgtagtcccagctgcttgggaggctgaggcaagagaatcgcttgaacctgggaggtggacgttgcagtgagccgagatcatgccgctgcactccagcctgggtgacagaatgagactctgtctcaaaaaaaaaaaaaaaaaagaaaaaaaagacgtaactatcatgaacagtttttactgtttaccctactgatttacttggatttaaagaactacatgcttcatagggttagagttctttgctttattttttcccatttaaaatacaaatagcctgggcaacatggcaaaaccctgtctctacaaaaaaaataaataaataaatgcaaaaattagctgggtgtagtggtgcgtgcctatagtcccaactatttgggaagctgaggtgggaagatcacctgaacccagaaggtcaaggctgcagtgagacatgattgcaccactgcactccagcctaggtgacatagtgagaccttgtctcaaatgacacacaaaccaaaaaaaaaaaaccccaaatatttacatatctcttacccaaaggaagcatttttttaattggttaatctctttctgagaatattaacaaattgcaaatggattttcgtcccctagtttatgaacagctatgtaactcatgaatttttctgtaaatgaccctactacttgagtatcattgcatttaatcattagctagtgtctttcttgattgaaaaggtaaaattttagagattctggagtaatctcatatgttggctggagattagtcaattcagaaattatgagacagcttggtggaatgcagccagtgttggagttaggctgggttcagccgccagctaaggcacttttggctctgacagaagttagagatagctgcttattgtttctaagcctcagtttcctcagttacaacataaaacctaagatataagtgctgttgtgaataacaaatgagatcctacaattaatgatagctgtcagttaggagttgaaacctctactttaagccattgtcttatctcatcaataaaatccagctgaccagctttgagatcgtaccactaagaagagacttactcaataaaggaatcaaaaacaaattaaaaaatccattatgtatggtttctcttggagatggctttggctctggagtgatgcttggactgagatctgagtcctcatgcttagtgccaagttgacctggcaaagaaggctattttaaattttagggggaaggagcgacatctgtcggacacagtgcaaactacagtttgaagtagttgcctgtttcatgagattcctgtagttcttttcaatgatgtcataagcctacaaagctggcttttgggcaattgccgcgataaaacacaagtatttatgtacatctatcatgcatcaatagaaatatttgttttataaaaaagcaagtatctcttaaatcagtgtggaactggaaatggaattggtggcgtccagtctgattccagggtttgggaagttgggcagtgcccagcagacactgagttgacaggacataagtaatgattaagttgtttggccctaactacgtacttaattggaactgtgaggtatttattttggcctaagtaccatgaaaaaaattactgaaaccctaaggaccgtgtggcctgagaaagtttgggaccctctaaccttgaattctgctgctgccttttgtaccctggtttttctttcttttttttgttgttgtttcttgttttttgttttgagacagagtttcactcttgttacccaggctggagcgcaatggtgtgatctcggctcactgcaacctccaccctcccgggttcaagcgattcccctgtctcagcctcctgagtagtcgggattacaggtgccccccactatgccaggctaatttttgttattttttttagtagagacagggtttcaccatgttggccaggctggtctcgaactcctgaccccaggtgatccgcccaccttggcctcccaaagtgctgggattacaggcataagccactgcccccggccatgtatttgttcttctgtgactggcttatttcacctagcataatacactcaaggttcatccacattgcggcatatgtcagaatttccttccttttttttaagttcgcacaatattgcattgtatatgtgtgccacgttttgtttatcctttcatttgttgatggacacttgggttgcttccacctcttgactaccaggaataatgctgctgtgaacttgtgcatataccgtggccttttagagatgtgaagtctgaggcacagaggtgctaattcacttctccaaagccaaaggagatggtggaattgggatttgaacccaggtggtctggttccagattctgtgttcttagacattatgtatgcggattcttttcatgaatagaaagcacaagattctctacacttaacaaatggctgccggaagtatctggtcatgctgaagctgggtgcgctctctaggaagtaccttagggaggcttttacatgtgagtgcgagaagcactccatagcatgtacttctgcgtggttgggaacaatctaaatgtcagcagaagagtatgtacattccttgtggtctgttcatataacaaacgctgtaaggtgtgaagatgaatgtcctggagctccatgtgtcaccgtagtgaaatctcaccactgaacaatagactgttgaggaaaaagtcaggtgcagaaggctctgcggagtagaataccatttatatcaagtttcagaatattaaaaaatgctgtaattgtttagggatatggaaatatatggtaaaaatattaagaaatgcttaagattaaataaacaccaaatgtagtataaggccctggggagggccgggcgtggtggctcacgcctgtaatcccagcactttgggaggcggaggtgggtggatcacttgaggtcaggagttcgagaccagtctggccaacatggtgaaaccccgtctctactaaaaacacaaaaattagccaggtgtggtagcaagcgcctgtaatcccagctactggggaggctgaggcaggagaatcacctgaacctgggagggagaggttgcagtgagtctagattgtgccactgcactccagcctgggcaacacaacgagactctggctaaaaagcaaaaagaaaagtttacctctgggagtagagggagaattgtgtttggagagggccccagaggacttcagttgcatttgtaatatttgtagtgctctttttcttttttgtaatgctttatttcttaatttgggtggtggttactggtatttgtatattatttttggtacccttttatatgtctgaaatgtgtttaattttttaaagggccagtggatagcatacgtgcttatgtatccatgtgaactctgtttttcatgcagtcagctgagcaagttgcaagaagtttctctgaggaactgtgcagtaagttgtgctggtgaaaaaggaggagttgctgaagcatgtcctagtatccttttcaccgagagcttgttattggaatctgactatggattttatacctgtgccagagactgctaattgcctacccattgtccagtcttgacaacttccttcctaatgcagttcagttttgcttggtgtagttggggcccagataaattatttaccttcccagacccctttgcttgcaagtttgccagcatgttcaggtggaagtttctacaccgggctccttgaaagggggcacacttggccaggcgcagtggctcacgcctgtaatcctagcattttgggaggctgaggcaggtggatcacgaggttaggagatcgagaacatcctggccaacatggtgaaacctgtctctactaaaaatacaaaaattagccgggtgtggtggcgtgtgcctgtagtcccagccactcaggaggctgaggcaggagaattgcttgaacccgctaggcggaggttgcagtgagctgagatcgcgccagtgcactcagcctggagacagaacaagacttcatctcaaaaaaaaagaaagggggcacacttgtttggcctctgccttttgcctgttgcttttacccttcccctgccttgagcggatggaaagcccagggctttggcagctgtcttacaagtgtgaagaaagccatccagtacagattgggagagcagaggagagggaacctgggctgctgactgtgtactgggaacctaagatgaatctgcttcagccctggtctgttttctcatgcagttcttttttttttttttgagatggagtcttgctctgttgcctaggctggagtgctgtggcgtgatctcagctcactgtaacttccgcctcccaggttcaagtgattcttctgccctagcctcccaagtagctgggattacaggtgcccgccaccatgtctggctaattttttttttttttttttttgagacggagtctcgctctgttgccaggctgcagtgcagtggcgtgatctcagctcactgcaacctccgcctcccgggttcaagcaattctcctgcctcagcctcccaagtagctggggctacaggcgcccgccaccacgcccagctaatttttgtatttttggtagagacggggtttcaccatgttggccaggatggtcttgatctcttgacctggtcatccgcccaccttggcctcccagagtgctggaattacaggcgtgagccaccacgcctggcctcgtctggctaatttttgtatttttagtagagatggggtttcgccacattggcgaggctggtcacgaactcctgacctcaggtgattcccctgcctcggcctcccaaagtgctgagattataggtgtgagccacatacctggcctcatgcagttattttttagtgggaaagactctggttctgtttcatgcagctgaatgcagtttgttataataccccaacagaggctctttatgaagtttggaatctcttttctctacctgctcttattagtgttatttttgtcatatatttcttttttgcctgtaagcaaaaatgttggaggtaggttaaaagaaaattttaaggatgggcatggtggctcatgctggtaatctcagcatggtaatctcagcattgggaggctgagactggaggactgtttgagaccagccttggcaacattgccagaccttgtctctataaaaaattaaacaaagcaaaacaaaactgggtgtggtggcatgtgcctgtcatctcagctactcgggaggctgaggtgggaggactgcttgagcccaggagtttgaggctgtgatgagccatgatcatgccactgtacttcagcctgggagaccccgtttctattaagaaatttcccatggaggctgggcgcagtggctcatgcctgtaatcccagtactttgggaggccgaggtgggcggatcatctgaggtcaggagtttgagaccaacctggccaacctggtgaaactccatctctactaaaaatacaaaaattagccaggcatggtggtgcatgcctgtaatcccagctacttgggaggctgaggcagggagaattgcttgaacccgggaggcggaggttgcagtgagtgaggtcatgccattgcactccagcctgggtaacagagtgagactctgtttcaaaaaaaaagaaagaaatttcccatggaaaccaaatagactttctttaactttaaaaggtctttccccaattcattaagtctgtctgatctgtacataataacttttgcaaaaaatagcagttttgatcagtttttttctgagtgaagagatgccaggtgaagtagctctctttggcaaaatgccccgacagtgcagtgaaggaaattagatcagacatctctccatctgtgtgtctgagggttcacttcccttgggggaaacagtctgggggtctgttgggacctgtggtagctgcacaggtctctgcctgtctctgccagtctctgcccctgagcagcctcctccgttgaccccagcgtgctgcaaatatgaggtcattttcaaaagtaggcagctggagtgaggggaattgaagtggatgcagaaaagagtttgctgaggagccagtgccacagcagtgtcagagcattctgcattctgcctggcctattcctaaactatttcagaagattggtaatcgggctgtgtacagtggctcatgcctgtaatcccagcactctgggaggccaaggcgggtggatcacctgaggtcaggagttcaagaccagcctggccaacatggtgaaaccttgtctgtactaaaaatacaaaaaattaactgggtatggttacggacgcctctaatcccagctactcaggaggaggctgaggcaggataatcacttgaacccgggaggcagagattgcagtgagccgagatcacaccactgtgctctagcctgggtgacagagcaggactccatctcaaaaaaaaaaaccaaaaaacaaaaaacgggggggccaggtgtggtggctcacgcctgtaattccagcactttgggaggctgaggcaggtggatcacctaaggtcaggagttcgagaccagcctggccaacgcggtgaaaccccatctctactaaagtacaaaaattagccaggcatggtggtgggcgcctgtagtcccagctacttgggaagctgaggcaggagaatcgcttgaacctgggaggcagaggttgcagtgagccgagatcgcgccattgcactccagcctgggcgacaagagcgagactccgtctcaaaaaaaaggacagatgtggcggtaaatgggtttgggagtgctggctgttgggttgctcagagctgtcagcagtgtcctgaagaatcagcatgttgtttgtttatactgcacttttctggagaaaaatgtcccccaggacacgaagaaatgaggtttcacgaagataatcaagtcatgattggtatttgcagatacagtgataaatgtcttgcagctcccgattgaattctcgccagaagttgaagtattgctttgggtgcttaatccagtcatccttttttgggttggtctgtctttgaggttatttactctaccagaactcgaggcagtgggagagctgcagacccgggtgtgtcaaatctgagggtacttccaggggaggggatgagcttcctcctccctcatgacctgcggaggagagtctgtgcccaggtgcttggcctgtgctttcacgggggctccttgaacggtgtgtgtgggaggggcgaccacatattgacagctgttgttcgtggttgatttcaggatgtaggtggtctgtgtgctctgtacagaccttagaaacaataactctaggctacataatgggaagcagcagtgagggaagcgtgattggacttaaacccttcctcagcagcctaacagccgatttagcggggttaatggaaacacagggtggccaaagtgtcacccagaggccgggaaagcacccctcgcatgagcctgtgttaggcggtgtcaggaagctagggcagccgagaggaggctgaggaggaggggcagaggagcagtttacagaagccatcatgcaggtgtgggcccaagggcagaggaggagcgcgaggggacctggagggtgtttgcccggtctggaattttcggcagcctgcaccgactcttttcccttccatttgatgcgacggccacggcaaaattgaggctattctgcaggtactcatattaccgattgaaatgcaactgtttacgagggtagaccccattgttagctcttgggctgtaatagtccaggcagctggcaggattcgggcatgggtagctggcgaccgggtatggagtcatccctttcttcgcatcttctctgccgtccttcccttgttcctgaccttcttgcagagcttcctaattggttcctgcctaaaattatttcctttctaaccaatgctttggagtgatgccactgtttttgtaaagaaactttctccacgttttatgtatgtttgatgactccctgttgcattatggggtgcaatgatatggattttggatcgaggatgacttgggtgtaacttcccacttgttcatttgcacacaatgacacagctctgtgactgctgtgccaccgtttgttctgctatgagaaagcaaaacaacccagcaatcagcatagtgcctgggtctggttagcagtggcagcagcagtgcgggtggtggctgtcactgctgctgttgttattactggatcttagagctcttttttttttttttttttttggagatggagtcttgctctttcactgggctggagtgcagtggcgcgatcttggctcaccgcaaccttctggcacccaggttcaaggattcttctgcctcagccccctgagtagctgggaccacagatacgtgccaccacgcttggctgattttgtttttgttttttttttttctttttttgagatagagtttcgttcttgttgcccaggctggagtgcaatggcatgatcttggctcactgttacctccgcctcccaggttcaagcgattctcctgcctcagcttcccgagtagctgggattacagacatgtgccaccatgcctggctaattttgtatttttagtagggatggggtttctccatgttggtcaggctggtctcgaacccccgacctcaggtgatccgcccgcctcggccacccaacgtgctgggattataggtatgagccacagttcccggtccaatttttgtatctttagtagagacagggtttcaccgtgttggccaggctggtctcgaactcctgacctcaggtgatccgcccactttggcctctcaaagtgctgggattacaggcgtgagccgccgcgcctggcctggatcttggagctcttcttctgtcgctggccactcctcagtcgcttctgtgggacctttctctggttgcagactgttgggtgtaccccaaggctcagacttgggagccctgggcttcttgagagaccttctggggtgtggctggcactcctccacggcctgccctcttccacatctgtctctccagctgcagctttgatacctctgtctggatgtctcatagccatcatagatttagcatgtccaaaactaagacccacgcctgctcatcctgtagtcttttccctcttaataaatgacagttccatttgcacaggccacagatcttggagttgtccttgacactccctttctcccatgccccacacctaaatccattggcaaatcctgtgagccccacttccagagtcagacgccccctctgacatgttctgccctctcatgctgctggtttgctccggcctcctggagactcccggccctcctttatttccctgcaattgtgctcaactcagaagcacagtgacttttactggatttttttgttgttgttgttttgttttttgacataatatagatcaaagtcaaagcagagtgatttttaaaggacccaggtcacctgtcgctgtttcaaagcctccaatatctcccgtttcaagcaaactttgaaaagtccgtttcaaacagactttgaagtggcctgcaaggccctttgtgatgtggcctggccccttattccttgtgaccttgtttctagtacccccaagcccctctgctcgagtcacacaggcgctggcggtcccggtcataggctgagctcgttcccaccccagggccttttgctcttgtcactcctccgccatgtgctcctctcccagatggcgttcccccatttccctcagctctctgctcagatgccctcttagaggaggtggtcttccctgggcactgcatatagaacagccacacacctttcctgcatgccctgctctgtccctgagcacagacaggcctgcctgtgacacactgttgaggcccctgtgtcgtgatcgtctctccccgatgacactctgctttgctcactgcgatgctcctggccctaaataattacttgcagaatagacgagtgcattgaataatttccacacatacacatattagatgagagtgtagctcctccagtagctggcccggtcctgctgcaagctcctctgtctttctctgcggggacctggctaagctgtgccccttcctgatggtgctgcacctgcacctagcccctcacctccacttgtgttgtctgtcggctttgcttttccagccccactgtgttatcctctctgaatccctgtatcaggggcagttggagtgatactgttacaactgcttccaggctaccggacaccctctcaattcctaagtcatgcgcttttgcacatgtgtcccaagttgacccctcttctctgccctgtagatgctatttatctggagattcctatggtaatggtgccccatagaaggtcatgtgctggggtgaggcttgtgtgtataccttaggtgcttcagaaatcaaagttaccctcactgcttttcccctctccttttgttggatagtgctaggatggtttagcgttatgacatttggttctttgtcatttgattgtagatgtttgtctcaagttttgagtatataacaatgaacttttaatttatttttagttttttgagacagtctcactctgtcacccaggctggagtgcagtggcgcagtctccactcactgcaacctccgcctcccgggctctagagtttctcttgccttaacctcctgagtagctggaattacgagcgcgtgccaccacacctggttaatttctgtatttttagtagaatggggttttgccatgtgggccaggctggtcttgaactcctgacctcaagtgattcccccgaccttggcatcccaaagtgccgggattacaggcgtgagccaccgcgcctggcctcacaatgaactttttcgtttctcagtgaagttttggataacttaaaaatattatgtactcctgaaaaaatttgaagctgactagagggtataaaatgaaaagttaaaacgctcatgctctggaattaagagtaactccttttatgtcttttgtgaatcttttgaaattactgtttcttaacatgtgcttttagatatcagaaaggtagatttgtcaaaaaacctgttgtcatcatgggatgaagtgatacacattgctgatcagctcagacacctggaagtccttaatgtcaggtatgaactcttggttgctgaatcttcattaacaataaagctcatctctccttgcttcctcacagcatctctgtggaaagaggtagggagccggaagggttaaggctgccacctgatgatacaggagttaagaaggaattactcaggctgatagtgagggtatggaagtcctcagtaaggttttccttttaatgaaaagcagccccaaattattttcctttctaacacaagcagcctgtaaaatcgagctgcagacatagatgcagacagttgagccaatcaggttcaagatggcagctccatcttcccttctcttttccagccacgtgtacagtaaggagcagacaagatggtgccagccaaagggaaatttcatttacatagtaagattagggtggggtggccagcctttcctggctgtgtaaatgtcatgcctgattgaaccaatctgtgagcattaagtaaatcagacactgcctcctcaagtcaaactaaaatctgtgcatctgggccgggtgcagtggctcactcctgtaatcccagcattttgggagtctgaggcaggcggatcacctgaggtaaggagtttgagaccagcctgaccaacatggagaaaccccgtctctactaaaaatacaaaattagctgggcgtggtggcatgcaactgtagtcccagctactcaggaggctgagacaagataattgcttgaacccgggaggcagaggttgcagtgagctgagatcgtgccattgcactccagcctgggtgatagagcaagactccgtcaaaaaaacaaacaagggccaggcgcagtggctcacgcctggaatcccaacactttgggaggctgaggcgggcggatcatgaggtcaggagatcgagaccatcatagctaacaaagtgaaaccccatctctactaaaaatacaaaaaattagccgggcgtggtggtgggcacctgtagtcccagctcctcgggaggctgaggcaggagaatggcatgaacctgggaggcggagcttgcagtgagccgagattgtgccactgcactccagcctgggcgacagagcgagactccatctcagaaaacaaacaaacaaacaaaaaatctgcatctgctgccagcttgcctttttcttcttggaagtcccctctctcttactagagagagagctgttttccatcttctttctcttgccttttaaacctctgctcctaaactcctcatgtgtctgtgtcctaaattttcctggtgggagaagaggaataccaggtgtataccccagacaacgcagctgcttcgctagtagacatttttatacagccagattttggtttacttgaatttatctaactttaactttaaggacacatttaatctttaaggacactttatttatttatttatttatttatttatttgagacagtgtctcgccctgtcgccaggctggagtgcagtggcgtgatcttggctcactgcaacctctgcctcccgggtttgagcgattctgctgcctcagcctcctgagtagctgggactacaggcacgagccaccacgcccaactaatttttgtgtttttactagagacggggtttcactatgttggctaggatagtctcaatctcttgaccttgtgatccgcccacatcagcctcccaaagtgctgggattacagtgtgagccactgtgcccagccttatgtatgtatgtatatatgtatgtgtgtatatatatatatatattttttttttttttttttttgagacagagtctcactcttgtcgcccaggctggagtgcaatggcgcgatctcggctcactgcagcttccccttcccgggttcaagggattctcctgcctcagtctcctgagtagctgggactatgggtgcccaccaccactgccagctactttttgtatttttagtagatgcagggtttcgccatgttggccaggctgttcttgaactcctgacctcaggttttccacccacctcggcctcccaaagtgctggaattacaggtgtgagccaccatgtcccgcctctttaaggacactttaatctttaagggcacattgattattatagccttgcaaacggtcacatgaggtgattcatgaataaggaatgtgttttaacttttaccaggtggggatgagttagattttcattgaactgcaagatcttatttttagcctgaccgtaaagatggaaggttgggggaggtgatatttaattggggagtaggagaggagaggtgatattattaaaactgcttgtttatttgaaaacttctagcgtttaattgctgtaggaatgagtaatttcattgggatactgtttaattctgttttgataaggatttttcattaatctacctattttactaatgtcacacttttctaggccttcctgaatatttaatttgttttaatctcagaacctaactttccaagggcttagccaggcttcctccatttttttttttttgaggcagagtctcactctgttgcccaggctggagtacagtggtatgatcttggctcactgcaaccttcgcctcccagattcaagtgattctcctgcctcagcctcccaagtagctgggactagaggtgcctaccaccacacccggctaatttttatatttttagtagagacggggtttcatcatgttggccaggctagtcttgaactcctgacctcaggtgatccatctgccttggcctcccaaagtgctgggattacaggcgtgagctaccgtgcccagcacaggtttcccctttcattcttgaaccatttttgcatagacatgtgagtgtacagtaaagccggtagacaggcctgaatgagttgtgctcccaaatagagcaaacgggggcaattcaacccatggtgtctcatcttctggaaatacgggcttgtgttttttaatagtatcgtctttcaaagtgactgtcaggattgaatactttctgagattagggttttgagaaataatttaaggggcaataatttcatccatcctcatagccaaagggcagactctatgtttagagaagcaaaattctagcccatgattcagtgtatcagtaagactctggagaacgggactttgttttgcagtatccagagccatatcttgtgaagctggaagctcaccttgcaaatgcctgagttttgggtttaggaagcctacagccgcatacaggtgccctaatcctgtgaaagcatctttacacagctgataccaaaaagttgtatgttgtaaatgttaaaaattaggtagtcttgattcacttgaatcattaaaaaagtgatttttaaaatataattccattttaagattgaaacaaatcaaaccccttagattaaaacccagattgttgctttcaacaactatttcagttgggtttactgtatagaaataagtacattgtatcttttttttctacacagtgaaaataaactaaaatttccctccggttcagtattaactggaacgctttctgtactgaaggttttagtcctcaatcaaacaggaataacgtgggctgaggtaatcatatttctttgttttattacacattaataagcaattaaaaatgtttggtttaatagagaattgttagtacagtttaatagtacaactgtggcttcatttaaatcatcccagtatctattaatagataacaagattcattaaagtgccttataaaaacgagttaaaagagcatcatagttgagttttgcatctggaaatccatgtcctatctcagctcattttgacttgttctggtgcctttataaacagtggcgctccgttatggtatgaaccagtatgtgctgagcttcaaaaagccgtagtgttggctattgactagcttcctgagttttcctgttagttttttttagaacagaagccaagcagcagaaaggttctcacatacttttcttgttagaagttcggctcttggaatccactgttcattttatacagccgggctcaaaagtagacttgtgggtccttggcacagcagcatttgggacttatatctggcagtactatttcctgtctgaggtgtactgacttcacacacccagagcattccactttctttttttttttttttgagacggagttttactcttgttgcccaggctagagtgcaatggtgcaaccttggctcactgcaacctttgcctcccaggttcaagcgattctcccacctcagcctcccaagtagctgggattacaggcatgtgccatcacacccagctaattttgcatttttagtagagacatggtttctccatgttggtcaggctggtctcgaactcctgacctcaagtgatttgcccgcctcggcctcccaaagtgctgggattagaggtgtaagccaccgtgcccagcccactttcatttttatttatttatttttcttgagacagagtctcactctgttgcccaaggtggagtgcagtggcgcaatctcggctcactgcaacctccgcctcccaggttcaagtgattcttccgcgtcagcctctcaggtagctgggattacaggcatgtaccaccatgcccagctaattttgtatctttagtagagacagagtttctccatgttggtcaggctggtctcgaactcctgacttcaggtgatccacccacctcggcctgctaaagtcctgggattacaggcgtgagccaccgtgcccagcccactttcatttttatttatttatttttcttgagacagagtctcgctctgttgcccaagttggagtgcagtggcatgatctcggctcactgcaacctccgtctcctgggttcaagcaattctccagcctcagcctccaaagtagctgggattacaggcgcttgccaccatgcccagcttatttttgtatttttagtagggacagggtttcaccatgttggccaggatggtcttgaactcctgacctcaaatgatctgcctgtctcagcctcccaaaatgctgggattacaggcgtgagccactgtgcccagcttgggcattccactttcaaaccaagggtgtagaaatacattcccagccatgttcacccaggaagtgccacagaggccactcagtgagagacaggtgggccccttgtgcccttaatatgcccgtggccatggagcctctttcctagggcccctcctctgtgaggcgcttactccctctcaaggtgtagatgtagctggaagacaagaaggggccagacactggcactggggctcacacctgcaatcccagcgctttgggaggctgaggtgggaggatcacttgagcccaggagtttgaggctgcagtgagctaggattgcacctttgcactccagcctgggtgacagagcaagacgcatctcaccctccaaataaactaggaagggcacacagaaattgaagtggtggagatggcagtaaagttccagtgagaaaatttagaaatagttggtgaggctggtcatggtggctctcgcctataattccagccagcactttgagaggcccaggcaggagaatcacttgaggccaggagttcaagacccacctaggcaacatagagagatcctgtagatgctatatatatattatatattattatacataattatataatatataataattttttgtaatttttttttttgtaaaaaaaaaaaattaggctcatgcgcagtgtggtggcagcaggcacggtctcgacatgcagaaagacgccagcaagttcgtggatctgtgcgtgctgcagaaatgctccaccagcaactgcatcatcagtgccaaggaccacacatccatgcggatgaacgtggccaaggccagtgaggtcacgggcaggtttaacagccagtttaaaacctgtgctatctgcaggactgtttgcaggatgggtgagtcagatgattccattctctaattggccatggccaagggcgtcatctcaactatttggtttttgagatggagtcttgctctgttgcctaggctggagtgcagtggtgtgatattggctcactgcaacctctgcctcctgggccaaaatgattctcctgcgtcagcctcccaagtagctgggattacagacgtgcactaccacgcctggctaattttttgtatttttagtagagatgggttttcaccacgttggccaggctgttctcaaactcccgacctcaagcattctgtctgcctcagcctcccaaagtgctgggattacaggcgtgtgcaaccatacccggccatttttgtatttttagtggtaatgggtttcatcatgttggccaggctggtctccaactcctgacctcaagtgatccacctgccttggcctcccaaagtgctgggattacaggcatgaactcactgtgcccgatctcaaagaacttttgattggagagaatcatggatgtagaatatttgtcataaatatataatgaaaactttaaaaaatgtataattaaaaaaataatgaaagaagaaataattgttgagaaatttatgaaaggatatgaaaaattagcatatcctttacaaacccagattggcatttagaattgaggaaaggtgtgtaacatcaatttacttattttggttaagcaaattctatcaaataataatatgtgcagttagtatctcctgttccacctcgtagctgctttacctaaaccatgcattgacacgtacctccaaggcctcaaagtgcccacagtgtgtgctcccacagcattaaaatgcacccccttaacattttatttatcaccccccaccactattccaggcctgaaacagtcttatgaactgtccgtgaggcacttgtttgctgaaacagtaactgagctgaattcttgtggtggttcctatgaacacccgggaagaaacagccagcagaggccgcctgagcctgaaccgagtttctcttccaggtgctgcggtgtgtcgcggggtgcccaggcctggaggaactctaccttgagtctaacaacattttcatttccgaaaggtaactagcacttacttaaatgcatctatccccatttaatcatcattctgagtaaataaatggtctcaattatatctaaccttaatttttagaaggatttgcaaacaagaattaggaaaaatgcttattattcattgccttcacaaattagaatttcactaattggttctaatcaaaggaaactcatcagaattaaatatttgtgaagacatgagttatattagttttgcatcagtgtattaacttgctgtttcttttttttctttttctttttttgagacagagtctcactctgtcgcccaggctggagtgcagtggcgatcttggctcactgtaacctccgcctcctgagttcaagcgattcttctgcctcagcctcccgagtagctgggattataggtgcctgccaccatgcccggctaattttctttatttttagtagagacggggtttcaccatcttttacggggtttcaccatcttggccaggctggtctcgaactcctgaccttgtgagccactgtgcctggccaacttgctgtttctaaatggaagttctgtaggatatgctataaggattaaataatgtatttttcattagcatcatctgtttaaggtcattgtaccaaagtacatgtaaaactttgttctctgaaatatattgttgcctcatctcctttttaaattaataatattaaattactatgtaaaattaacctaactgtgggaaaatttacaacagattctgaattaaaggattcagaatcttaaagattttcgtttacagaagggtttcattatgtaggcaaatgcaggttttttgttttgttttttttttgagatagagtttcattcttgtcacccaggctagagtgcaatggcaccatctcggctcactgcaacctccacctccctggttcaagtgattctcctgcctcagcctcccatgtagctgggactacaggcacgtgccaccatgcctggctaatttttgtatttttagtagagacggggtttcaccatgttggcccggctggtcttgaactcctgacctcagatgatccacccgcctcggcctcccgaagtgctgggattacaggtgtgagccaccgtgcctggcctgcaggttttttaaattaaatttttttattttgagataatcatatattcacatgaagttttataagaaatgatacacagagatcacttgtacccatgacccaggttcccccattggtaacaagttgcaaaactatgatataggatcacaggctaggtgtgacactgataccggcaggaatatgtgcatcaccacagggaccactcaggttgcccctttacagtcatatttacttgcttcttatccccagccctccatcgcaccaaatgcagggattttaaggctgtatctttgaaaacaattaagagataaattcacggtgaaaaaattttattttccatacaggccaacagatgttctccagacagtcaagttattagatctttcctctaatcaattaattgatgaaaatcagctgtatctgatagcccacctgcccaggtaatttgcccctaaatgcctgatacaatagtgttcagtcaattcttagtgaagcagttttcatatgctatgtatgctttctcaatagaaacgtggtaacaatgatggaatttctaaattgagtaattccctttgggaaattttcatttgaattcatttagaaaatttacttgtgaaccctgtataatgtggactatgtctgtaccagataatttgaagaatgaataatttgaccctggtgataatgcggaaagtcttcattcattaaactccgggcagtagaccgtgtctctttcctctgagacgcatttagcacctgacatagcagtaggtactcaagaaccattaggtgactatggagtcattagaatacaggataaagagttcactttgcatgtcctaagttggactttatggtttctaagtattttacatgggattaaaaacccagggtgtaggaaaaaaatttacaaaccgagtctggttgataccccatagcattttacattgttctgtgtaatcaaattgtacattttgaatttcaggttagaacaattaatcctctctgacactggaatttcttctctacattttccggatgctggaattggtatataagattagtaaagttccccactgcccccccacactatacttcagctactttcacttctactgtgtaacttcattcctctttttatagggtgcaaaacgtccatgttcccatccttgaagtacctggtagtaaacgacaatcagatatcacaagtaagagctgctcggagtatgcccagcacactgttgcctctttccactctcatggcagagtttggaggttccttctaccaaaaaagtaaaaagaaatttaaatcgaaagagaaatacctcctcagagtgaaactcctcataagaagccaaaaatattaagaaagaaattagttcacttcacacttaagtggacttcacacttaaatggcacattaatagagtaaaaggggccgggtgtggtggctcaagcctgtaatcccagcactttgggaggtcgaggcgggcggatcacctgaggtcgggagttcgagaccagcctgaccaacatggtgaaaccccatctctactaaaaaaaaaaaaaaatcgcaaaattaaccgggcgtggtggcgcatgcctgtaatcccagctactcgggaggctgaggcaggagaatcgcctgaactcaggaggcggaggttgtgatgagccgagatcgcgccgttgctctccagcctgggaaacgagcgaaactccatctcaaaaaacaaaacaaaacaaaacaaaaaacaacagtaaaagtatgtggtctttctagaggggattgcttagtgcatgatgaaattccctgcctcagattagaactagggacatgctttcctgttgctggttcaaacttctgcaaaagtggcatgaacgtaccgcttttcatttatttccttttgctgtgtttcagtggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgaggtgagcactggcgtcatgactagatattttttagactagaaaataaatgattttaggccaggcgccgtggctcacacctgtaatcccagcactttgggaggctggggcaggctgatcgctgcagtccaggagtttgagaccagcctgggcaatcttgtgaaaccccatctctacaaaaaatacaaaaattagctgcatggtggcacgcgcctgtaagtgcttgtagtcccagctactcaggaggctgaagtgggagaatcacctgagcccgggaggccaaggctgcagtgagccatgaacatgccactgcactccagcctgggcaatggagtgagaccctgtcttaatttaaaaaaaaaaaaaaaagtaaaaaaattatttttgaatattgtaaagggggtgagatgtagctttccttggaatggtaaagattagccttgtgcagtttcataatagtggttcttttccagctcctcaggagagagtcctccacttagatcagtgcagtatcatttgaggcacaccaggcaccgtctccatgttttcagggaatgtaggcagaaagaacacagaccacagagctgctttctcctccccttctcagccactcttccccataaaagtgggaagtccatgccttgtccttgccagcacttttgtgcattcactgggagtcagtcagctccaccagagcaggcgcctccaggcagacctgggggaggcgacccagggtacctggtgtagtcctgaaactggcctatgcgcaagtactcgcatgaattaaaagtgtaggccaggcacggtggctgacacctgtaatcccagcactttgggaggccgaggttggcagatcatgaggtcaggagatcgagaccatcctggctaacacggcgaaaccccgtctctactaaaaatacaaaaaaattagccaggcattgtggcatgcacctgtaatcccagctattccagaggctgaggcaggagaatcacttgaatctgggaggtggaggttgcagtgagctgagatcatgccactgcactctagcctgggcgacacagcgagactccatctcaaattaaaaaaaaaaagagtgtaaaactgaaattcttttttcttttctaataaacccctgagttctgtcaatgttaaaaagaagggtgaaaactagatcttgtccctctcaatttgattattttctgcatgtgctatggaggaaggacaaggtgcaaaacgcaaaggacatgttagaaaaaagctttgtaataggcttgtttttatgtcacatgaacatagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgagtacgtgcgtatacactggtggccttcaggtggtggatttccagctggaacaaagttttttcttgggtatcaaaagaggttctcagtgttgcttttgcccttcttcctttcctgggcttcttgtattcatctgaatggactataggcactttcctggggcgagggcggcagggcaagagcagtatctttcagcaggaggaacctgggagactgtttatgttcttgaaatggagaggtttgcatttggggaagggaaagcaattcttttatttttaagagatggagttggccgggcgcggtggctcaggcctgtaatcccagcattttgggaggctgaggcgggtggatcacgaggtcaggagatcgagaccatcctagctaacacggtgaaaccccgtccctactaaaaatacaaaaaaaaaaatgagccgggcgtggtggcgggcacctgtagtcccagctactcaggaggctgaggcaggagaatggtgtgaacccggggggcggagcttgcagtgagccgagatcacaccactgtactccagcctgggcgacagaacgagactccgtctcaaaacaaaaaaagagagatggagtcttgctctgtcgcccaggcccaggctggagtgatctcagctcactgtaacccctgcctcccgggttcaatttattctcctgccttagcctcctgagtagctgggattagaggcgcccgccaccacgcccgactaatttttgtatttttagtagagacggggtttcaccatattggccaggctggtcttgaactcctgacctcaagtgatccacccgcctcggcctgtcaaagtgctgagattataggtgtgagccaccgtgcgtagcaggaaagcatttctttttctttttttttcttttgagacagagtcttgctctgtcacccaggctggagtgcagtggcacaatctcagctcattgcaacctccacctcctgggttcaagtgattctcctccctcagcttccagagtagctgggactacaggcgcacaccaccatgcctggctaatttttgtatatttattttttgagacggagcctcgctctgtcgcccaggctggagtgcagtgccgcgatctccgctcactgcaagctccgcctcccgggttcacgccattctcctgcctcagcctcccgagtggctgggactacaggcgcccaccaccacacccggctaattttttgtatttttagtagggacggggtttcaccgtgttagccaggatggtctcgatctcctgaccttgtgatccacccaccttggcctcccagagtgctgggattacaggcgtgagccaccgcgcccagccagggaaagcacttcttaaatgtaggttcttctcttgcatatgtccaccaggtttcaggtggcgcaccatgctccactgtaggaagggtaggaagcactccagtttatgtctgaggcatccgtatatatatatatttttttgagatggtgtttcgctcttgttgcccagactggagtccaatggcgcgatctcggctcactgcaacctctacctcctgggttcaagtgattctcctgcttcagcctcctgagaagctgggattacaggcgtctgccaccatgcccggctaattttttgtatttttagtagagatggggtttcaccaggttggccaggctggtctcaaactcctgaactcaggtgattcgcccgcctcagcctcccaaagtgctgggattacaggcgagagccaccgcgcccagccggcatctgtatttttttaaagccccccaggtaattctagtgaataggaaagttcgtatgagtgtagttctgcagtaagctctcgtcccgagggctcgctaccaaggctggcacttggcatgcacggtggttccttaaatcctccagcctggttcttcaggctttgaagctaagaattcatgagtctttgtccctgatgtactttccattttgttttgatgacattattactccacatttcgcttttatgttatttccttttttatatttcttaatgcaagaagctcgctgcataaacgcttcaggcttgaacagtatgtttaaggaagaaaagcagcctagaggaatcactttcaaatgactccattagccagcccaatctcctggccacgctcggtgaattctaaatcactcgggggtgggcaagggaagatgtgaagcagccgggcaggtattgttgagtatttcactgctaagaatgttagaagacaaaagcacagatagatggggggatttagagaaatgttgtcactgtttggcctagagcaggaaaaaagtactgctttcctcctctcctgtggaggctgtggtccaggcctaggaactggtttgcagtatggtactgagcacccagcctggcactgcacggtctggtggaaacgtgagaagtgtcctgtggatcgtgtctcaggtggcaccaggtttctgtcagcgcagaaagagaactgttaccaaaggtgacactcggggaaaacatttgaagtatttgaaggcagtcttctcttgctagttttgagtcaggacacctaaggaacaatgatgtaatacacatgtaaacatgttgcttttcatttgttgtcttttgttgagtttcactggtcattaacaatgagctagataagctacagagtctgcagctctgggtagatagaagattctgcccttggaagtggtcgttgtccatcactcctaaaaatcacactgaataaaggcagctccatgtgtcctgggaaaggcacaggctctctggacgcttacctatcctttgtttgtttgtttgttttgtttttacttatagtggcctttggtttatcattcatctcttttgctttcttaaacagaatatggtgcacctgaagattgggaactcaaaacacagcaaccacttatgctgaaaaaccagctactaagtaagaatctcagattcaaatagtttatttgtatttgagtgcttaggtgctgaaacagttagtgtgtttctcttaagtgtgtacctcttaagtacctaagtaaatgccttgagttttaaatgaaaatttttttttttttttttgagacagagtctccctctgtctcccaggctggagtgcagtggtgtgatctcagctcattgcaacctccgcctcccaggttctaagcgattctcctgcctcagcctctggagtagctgggactacaggcatacacaaccatgcccggctaattttttttaatcgagacggagttttgctcttgttgcccagactggagtgcagtggcacgatcttggctcaccgcaacctccgcctcccgggttcaagcgattttcgtgccttagcctcccgagtagctgggattacaggcatgcgccaccacacccagttaattttgtatttttagtagagatggggtttcaccatgttggccaggctggtctcaaactcctgacctcaggagatccacccgcctcggcctcccaaagtgctaggattagcggcatgagctaccgcgccctgtcaaagaaatgaattctttaaaacatgtttaaattcttatacatttttgtaactcctatgttttaaactcatttaatagtgttataaatgtgggaggtattggagttgtgaaccaaattgtgatttgtgaatttatgacttgaaaacctagccaagctgtaaggaaagaagtactaagtggggaaaagggaaagtattgtccagctatttctgttgttgttagcaatccatggaaggattaatagaaagaattttaaacattgattagacctgccaatttgcactgaatacctctatcatttggccatctgttgatgtgtgtggataatttaaatccatataatagtagatatcaattagtctttttctttgtttctcttaaagcactgaagataaaataccctcatcaacttgatcagaaagtcctggagaaacaactgccgggtaagaagaaccagcctgtcttttccttaaactctgaatcatcggcctaggtatgagtcagctaaaattaaaacctttaactcatgtctcaaagtgtggacctcagaacttacaggttttcattagtcttttatattctaaaatacaatcaatcatgctaatatcactcccccatgcccccaaaagttcaggtctcccctaactttatcagctgaaagcagttctgttaaaattggaagcccctgcatataattacacacacacacacacacacatatatatatacacacacacacacaattttttttgagacagggcctcactctgtcacccaggttggaatgcagtggcaccaactcagctcacggcagcctctgcttcctgggcccaagcaattctccagcctcagcctccacgtagctgggactacacgtgcgagccaccaacgcccagctaatttttgtattttttgtagagatgggttttcgccatgttgcccaggctggtctcgaattcctgagctcaaagccatcctcctgcctcagcctcccagtgttggaattaattacaggcatgagccactgcagttggcctaagttgtatttttaaccaaaaaacctgagaccttgaatggcatagccttttggaagcattccccaagcctgctgctgtttccagggagactgtgacactgggtttggggtctgcttctcatcccttcataagagaggagctgtgtcctggtgaaccaaattcttacgggaggtttgtgactttgcttacattctacttctcctgactgattaggagtccctgcaaaaacaattcgcagatgctcttttaatggacaccctgaaatggttttctttgagaaagctaccttagaacttaaaaaaattgtggtactggaactgaattacttttatttggaaaataaatatgcttgtgtcaataaagtagatcaacataacttaccttaaactttcactcaaaagaaaaatgaaattatagtctatttttgagtatgccatgatactgtgaattctcaagattaaacttgattcatagctaaatgctaaaatataaataatttagagcagtgaggatttaaataaatgaaatacacatcagcttaatgactctagtacactgggtttctttgcccatcagtgcagtaaattcacattgatttttaaattagtttctatcagataaagcaagcttatcatggtattgcttatagaaggccttagttgtgttcaaagaagtacctttctgattgataaccatccatttaatttaccacaacgtctccatttttatttattcacaatccagtttctactcctgtaatatgtaatttggctactgctatataatgggttagaattagtgatttcccccttcattattctgttttcaaacttagacagacagtaaaggccctggtggagacagactagtcaaagagggccaggactgttttatttttgatatatttttttcagatggggtctggctgtcactcacgctggagtgcagtggtgccatctcagctcactgcaggctccatcaccttgatcccgggctcaagtgatcctcctacctcagcctcctgagtagctgggactataggcacgaaccaccacaccccgctaatttttttgatttttagtagagatgaagcctcgctatgttgctaaggctggcctcaaactcctgagctcaagcagttctcctgtcatcacctcccaaagtgctggggttataggtgtgagccaccatgcctggcaggccaggactttctgtgaatgtttttggccttcgatgtctttgcgtgtttccttttgcctttgcagatacatcaaatcaattcatgggaatgttaccactatagagtatttgctcaagaatattgtcattagacctgtttcgttaagctttccttttcagtctttctctggaaggcactgaggtagacctgccaaggcctgccgtctgggcatatgcctgaatgcagcccttggctgggggtgacagtgccgccttacccttctctacttccacactgtacacctgactggtatcccaggtcttctgagattcagttagccattttgggaacacccactgcattcatgctgtttttattaatctttgggtagctagcagagattcgactatccatagaaattatatgtaagaattactactttaaactattcagaatctgagtcctatattctataaattcagcagtaagccagcagattacaagggttcctttttttccccttttttatttgcttttctgtttctcaaatgtgcactcactcactcactcatacaaaggttcttaatactaattcttatgccacatgctgtgaatatttaaccactaacataggtaaatgtcttctaaacagaaaagtaatagccaggcatggtggctcacacctgtaatcctagcactttgggaggccaaggtgggcaaattgcttgagcccaggagttcgagaccagcctgagcaacatggtgaaaccccgtctctacaaaaataaataaatacaaaaattagctgggtgtggtggtgcatgcctgtagtcccagctgcttgggcggctgaggtgggaggatcacttgagcctgggaagttgaggctgcagtgagctgtgattgagccactgcaatctggcctgggtgacagagtgaggccctgtctaaaattaaaacaaaacaaaacaaaactgcaatatctttttttttatccattagattagcaaaattaaaataatactggctggcatgaaaaagcagtatacccttttttaaagtcatgtgggaactactataaaaagttaaaaatacacatatgctctgaccaagcattgtatcttgcagcatttgtaatggtaaagatagtaagaatctaagtacttgccagcggaggaatggtgaataagctctggtggaaccacacagcacacaaggcactgtcgtgtgtcaccgaggagagtgaagcagtctagagctgcgctgtccagtgtggctgcaataaccacatgtggctatttaaattcattaaaataaaataaattgagttcttcagtcatactcgccgctttccaggtgctcagtaccacatgtggctgccatactgggcagtgtatggctagaggacatggcatggaattggcatgaaaagctataccatcatgtcataaagaaatacaaatgtagtacgtcaatatattataaaacctatacatccttttttttttgagacggagtctcattctgtcacccaggctagagtgcagtggcatgatctcggctcactgcaaactctgccttccgggttcaagcaactctcccggcctcagcttcccaagtagctgggataacaggtgcccgccaccatgcctggctaatttttgtatttttagtagagacggggtttctccatgttggccaggctggtctcaaactcctgacctcagatgatccgcccgcctcggcctcccaaagtgttgggattacaggcgtgagccactgcgcctggcttaaaacctatacatccttatatgaacacagaaaaaaaaaggcctagaggtatacctctcaaatttttaacactggtcataggcaggtaaaaagaaataatcagctatttccatattttctgaatgttaagacagtcatgttactatattaaaaatggtaatgctatttattacatagagattgctactttcttctatagaaccggtatgagtaggcaggttttttttttttttttgagacaggttctcactttgttacccaggctggatggagtacagtggcgcgatcatggctcactgtagccttgacctcctgggctcaagtgatcctcccaagtagctgggactagaggcgtacatcgctatgcttggctaattttttattttttgtagagatggggtatcctcatgttgcccaggctggtctcaaattcctgggctctgatccctctgcctcccaaagtgctggggttacaggtgtgagcaggccaggcagatttcttattagaactgttttatgaccaaactttttgtttctggcatgtgttaggagtatgtcactccccactggtgtgcagcaggtaaccccttctctcaccagccttcaaacaatgaaagccagtccgtctcaatcttttgaaaggactagactatcacatattcacacatgaaagagcaaattgttaattaaaattataaattctattaactgtattcaatacatacaaaaaggccagtttttattctaaaataaagaacatttattatcacaagttggataaaaacacacagcttttacaaaaatgatttttgatagaaaaatatgtttgaatacactgtgatatttgtaggaacaccacactattgctgtatctccagctaaagcttcaaggaaactctatttcttataatcaaaatatccactatttaccacaacccgtctttggaaagaagttcatagtgtattctgaacaaaccaaagcatttactcggaagttacattcccatgcctggcagtcacttgtgtatgtttaatacagttacacatgatgtaattacagaatggcggcgctggaagggaccttgtagatcatttagttggcaccctaattttacagagggggaactaaggccagagttgagagatgtcctcaggatacctgagtcccattccagtgttcgttcagtaattcataaggaagtcatcataaaggtttaaaaagaaaacgttaatgactcgctccctttattcttctgtgctgagagtatcattctggtttattcagattaagaaagaaatacactactgaaatggtatgaaactcactgtcaaagggcacttaggtccgttggctccgtttcccacagttccccaaatgaacaggtggtacaagactcaggctttcccctaattacttacttgggtaaagtgacttgggtaaaatgaaagatacagccaggcgctgggctcatgcttgtaatcccagcactttggggggccagggcgggcggatcacgaggtcaggagttcaagaccagcctggccaacatggtgaaaccccgtctctactaaaaatacaaaagttagctgggtgtggtgatgggcaccagctactcaggaggctgaggcaggagaattgtttgaacccgggaagcggaggttgcagtgagccgagattacaccattgcactccagcctgggcgacagagcaagacttacttaagtaagtaagtaagtcagtctcaaaaaaaaaaaaaaaaaaaagacagatacagctatcattgcaatgatactgtggtctcatcacatgagctagttttacaggtaactgtcatttgagagaacgaatggacttttcttgtcttttgataggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaatgattttctgatcttatttcatatttatttttacagctcatcactgcatttcatgataagatttaaatattaaatagaaagaaactagctagcctaataaaatctgaacacagttaatatctgtcataagactagttttaatggaattctctattgaaactactattttaaagggttactagaaatgatttggttggtcattttgggaaatgtcccttaaacttggggagacatcctctactatgtataacaatatgctattatctgtcttctcagttgcactatttctaagagtacttaaattaatcacatgcttttccctacaattatacctaagctgagtatatcttcttctgtgataaccagctttgattgaaatgtactcatattaggtaaacattaggcaatgataggaggaaagcaaaactaattctttcaaaatgtcaacaaaatttagaaatatccttcccgatggcactaaaaccctgagaggtatttgcttttattcatactcacacaactttagcatttaaaaactatgagtactaaactgtgaccttcaggatttatgttagatggcagaaagaaaatttgggtattagtctaccatataaatgaacttctttaaaaccaaggttcagaactgagaatcatattggttcctcttcaagttagttcaagttgcccacttcagagatccacaaaatctgacattatttccagaaaccccaaactttggtataagtgaccactgctcaaatatgtgatcacatgatcacacagcattcctgtgagttcctttttgtctgataattatcctaattagctctacagagctatcctgcaatccaggttgaaattcaaactctcagttactactacagatttctgaactaggccaagttttaaccaaaaactataggtaatggtgaattactaattagccacaatgcatcaggatttagaaatattttttcttttataaaataacttggtatttttctgataatcttccaatagataaataaaaacttttcttatgctacagtacaagttgatttttaaggaaatttgtgcaaacattaagaaacaccgcattggttctgggtgaaagtgccagtctggaactctcttgaaagaccatacagtctactgctaaaccctgggactcctcagacttgcactcagattatcgtttgcctgccctgattttagactctgctaattcaagtccctgttatcttgcttgacatcgacaaggatcaccgcaccgttccttcagtttccacagttccgtcagttcccacggagaatactgaggagaagacagcattcctgtctcacaggtcttctcacacagccacagactgtcctgttgagaaacaaccaaagccgatctgagagtggtgaaactgttttaagagcatcagaaagtatgcacgtagacagcttttatgtattctaatgatgctgaaattatttcaaggataactccgtgtgtggaacaactggtgaggtttgggggtggcacctcctgatttgggaaagcaccaggtcccacagtcctgtggctgtggaatacagaaacaaggcggtgtgtggatgaagagttagtcaacaaatgccattccgtaatgaacgattttagaaaccacaagtgagtttcatgtttgctagtaaaggtgtgtctatggcagtattagtaacagctattattctgatggaatgcttacaatattgcagggactgtaccaagtgctttgtaaatatctcacttaaatctcacagtaatgctgtgaggtaggaactatttccctcttaacaattgaggaacaaacgaagagttaaaaaacttgttccaggtcacagggctggtaaatgaagaggagggattaaagactcccaagctcaagttcttaaccactagactatttcctagctacgtgaattggtttctatttccagcaatgtagcagaacacagagagaaactcattcaatgttttgacaacacaaaaatgttggataaaattaaaaacctttataaagcatggctcaactccgtgatcaaagaagaaacagggtaggagaaagcgctgagtcagcctgtgccttgaaggcagctgctgatccttgggtttggaaggccaagcccagggtcaggagactaatgggagactgacacagagctaggatctctgaggggccacagcctcaggggtgataaaacaaaacacactcagcttgtctgtctcagtcttgcccctcagtgggatggaaaggagtctctctcccctcagtgcctacccacagcttgcacttaggtaggtctggggctggtagtcagtctgtgtaagcccaacagttccaagccaaaaatctgaagtattcatagatggtagtattcctagatgcatggcagaaaaaaatgtaaatatgtaaatcctctctgtaggaatgcattttaaatagaggactcagtttccaaagacatgagatggtcacaaaaaaaaaaaaaaaaaaagaccgcatcagaaaacaagcgccatgaacaacagttgtagaaacaacaaactgcaaaatcagacccagcaaagactacagatcccagaattaccagatacaaaaaagaattatattcaaagatgagacaaagtacagcaaaggaatcagactatcaaagtggaccatgtagatgtgggttgatttcttgtcctggactgagagctgctctgggaccccagctctatgcagggcttctaactgacagacactgcatgtgccttctgtcccctgcaccttcgatggccaaagtggaagctgcaagaatccagaacagaaatctctgaagctaaagccagctttgtgcttgatttcttcccagggctctagtttccattttggtctctgcagattcatttttttttctggttcagcaatactgtgttttaaatgatgtcttatatttcatgcagtgtcttatttttatcggtcagaagggttgaaggatccttagactgccacactcaatcagtggattctgtcgttcagttttttttttgagacggagtctcgctctgtcgcccaggctggagtacagtggtgtgatcttggctcactgcaagctctgccccccgggttcatgccattctcctgcctcagccttctgagtagctgggaccacaggcgcccgccactatgcctggctaattttttttgtatttttagtagagatggggtttcaccgtgttagccaggatggtctccatctcctgacctcatgatctgcccgcctcggccttctgttgttaagttttaaagctgcaaataatttctgatcaaatctatggaaactgagtttttttgtaggcaggggaacgttgatttataaccttttgctttaaactcagaaaaatactgtatgagaaataacctagtggattattgtgaattaaagcaacagcataactattatggtagaagatcctcattctttctgcccatggtgtgataaacattacaggttgagcattccaaatctgaaaatttgaaatccaaaatgctccaaaatccaaaacttttttttttttttgagacagggtctctctcactctgttgcccaggtgggagtgcagtggtgcattcacagctccctgcaccctcgacctcccaggctcaagttgatcctcctaccttagcctcctgagtagctgggaccacaggcaggcgctgccatgcccagctaatttttttgtagtttttgtagagacggggggtttcaccatgttgcccaggctggtcttgaactcctgggctcaagtgatacacccaccttggcctcccaaagtgttgggattacaggcatgtgccactatgcccagcccaaaactttttgagagccaacatgacactcaaaggaaatgctcactgaagcatttcagattttcagatttggaatgtgcaacttctaagtataatgcaattattctaaaatccaaaaaaatctgaaatcctaaatacttctggtcccaggcattttggataaagaacactcaacctgtatatagaaatccacctcctcaactcttaagaaccctgaggccatccccaaagacttacctggtatcttttaggtcctatggcagccatccagatgcccatgcttacatcttcaccctatacatggcccataaagtttaaatgtaaaaattttaatgctattttatttgtaaagacaaaaccatagccactcccatcataaaccacctttctacttttttgctctgttattattctaatatgaaatagcaaaaatgggttcacatgaagtcaaagctagtggtctttaatatgaagcacccctgccacaaggtaataagatgaaaccgcgagcagacgacccatccttctcatgtaccttaagcttccaggaagcacttagggcttcctccttaggaataaaaatctttctattcctccagggactatactttttttttttttgagacagagtgtccctctgtcgcccaggctggcatgcagtggcgcaatctcagctcactgcaaactccgcctccgggttcacatgattctcctcctcagcctcccaagtagttgggaatataggtgtgcgcccagctaattttttgtatttttagtagagatagggttctgccatgttggccaggctggttttgaactcctaacctcacgtgatctgcctgccttggcgtccgaaagtgctacaattacaggcatgagccacagtgcccagcctccagggatgacacctgtaaatactagctgaaaacataataagtaggctcaaaaaagatttaggaatagaatttaaaggcaagatttgagggatgtaggggtgcatccttaacctttgagaggtgattcctatacagagaataacgtgcttttccccaaggtaagtgggttctgctttccatgatgggatgccgagtgagatgaaacttggtgtgatgagtgtatacgtaggtgggaaatccttaattttttgtttttattttattttttattatagagatggggtcttgctatgttacccaggctggtcttgaattcctgggctcaagtgatctacccgccttagcctcccaaagtgttgtgattactggcaagagccaccacgccaagctaagaaattcttaattacctgataggtctttaacctccccgagttgcttgccagccacttgacgatgtccttggagatcacatatcctgacccacatgcaaaggcagggtaagcggggctcgggtactccaactcctgccactttccggttcggtcaactgcccaattcagtctgaaactgagatgaaaaataatgtggcctcttgtgttagtctgacacatatcctgccactattaaaacttgactcctttatcatcactacaaaggaataagcttgtagaagtgaggaaagaaaataagaaaatttctttttttttgagatggagttttgctcttgttgctcaggctggagtgtagtggtgccatctcggctcactgcaacctctgcctcctgggttcaagcaattctcctgcctcagcctcccgagtagctgggattacaggcgcacaccatcatgaccagctaattttttatatttttagtagagacagggttttgccatgttgtccaggctggtcttgaactcctgactttgggtgatccaccctcctcagcctcccaaagtgctgggattacaggcgtgagccactgcccttccagaaaaaaattttcttaatctaaggaaaggaattatcatttatccagtgttgttttagataaaagattggttatgttaaattttctcaaagttgcatttgtagagtttctgaatgaaaagcactagaagatcaccctgtgttttagtatatatgaaaacaaaaaaccaaatcactaatccatattgtattcctgaggaagcacagaaaatggtttcagagacgtgtcacaaacgtactctaacaaaatatacagtagcttctaatgtgaataccatttatttctttggcataagaataaaagccatattgttttccctcctttactacattagcctgaggcttttcatttaaaaaataatttcctccaattgtacagtaatataaaatttattattattattaagacagggtctccctctgttgcccaggctggagtgcagttgcaaaatcatagctcactgcagcctccaactcctgggctcaagcagtctccctgcctcagcctctcaagtagctaagggctacaggctcacatcacctttttaattttttgtagggacagggtcttgcaacgttgcccaggctagttttgaactcttggcctcaaaggatcctcccacctcagccttcccaaaactctgggatgacagatgtgagccagcatgactgacctagagtaatgaaatatatataaacccaggagtctagtacgaaattgtatatctcaaccacattttcaaaaaaaaaagatattttatgctttattaattacatttgatcaggtacacgaatgccaatgggctaagaatggttaacttactttccccaccaaaaattaggcccatccagattcttttggacaatcctattaaatacagcttcgaggtctatgtaacagtcatcatctgtcttcagcaacaaattgaagctcgttgtttccacagtcctgttgacacaaaagggataagaaagtcagtgcgaccaaacaaacaaacaccaatgcagtggcgtcactaacactttcattcaaaactgtacctgtcattatctaaatttcttattcctcaaatgttgagaacatttgctctaacaaaattttgctgctatcaactaaggccatcacttggtctttactaaatggcataacacagagaagtactaacctgattttaaaaggcaaagaaagagcatattgaaggaaaatatctggcttaaatggaacatatgttcaaacaaatgcttcttaggcatcattcaactcctgctgccaaatctattaaacgcctgaaccttgccccgtgtgttcttaataacaaaggcccagcataatgaattaggtgttacatctgggcctctcacacagaacgctattgtacaagatgcatccgatgctatttatattacactcaaaatattttatggcttaaaaaaacctgacttattacattgaaacatattttcccttggaaacaacttctagcaattaaaccattataaatgaccttctggaaggcaaaggatagtgacttcattatctagacgtaaaatatataatcatgactaaagacaaaattgactccttcatttcacattgacagtccctgtacatctgtttaaaaatgcagttttgctagggtgccagtcatatgtcagaaatctcaataaaataaatttagaatttcattaggtccaagaatggtgaatttaacaataatgggtccacaccaaatagcatcaccccatgtttctaaagtttatttccaattaacagcagaaggcatacataatatttgctaattagaaatttcatgataaagaatatttaggtcactgataactgaaataatgaggaagaaataatgaaactcatttgtagtgtggagatgggtgatgccagctatggggacgcaggtcccagatcagagtcctgttgaaggttactgcagcgatccagggagagaaggtggcagccaacaatagcggcagcggagactaagggagaggctaagatacttccacgcctaggaaatatcttgctctaaagagtatccggggctgactcttagccctgacttcccacccttgggacttccatgcccattcctcatctcagcctcacctacaattgcaactctcatttgcggccccaaattaaaaggaggttctttttcttactacagctgcctaaacttaacctagtattcgacacacccagatttccaaccctcatttacctctgctctctactcacaggatgagtcccaaattatattaatttgccccagcaggccaggtgtggtggctcacgcctataatcccagcactttgggaggccaaggcaggaagactgcttgagacctcatttctattaaaaaataaataaataaataaataaataatttgccccagctaagaaacattaccttccataaaccaattagaccatctacccctcaggaccagggaactgtatccgtaaagtactgttcttggtaacttcccactctgcctagggcaacagagaagaaaagaaagagacagaccctgggcctcacaccaaggaacagaagaaggtttttaaaaataaaagtgaaaaaaataaaaagtgaataccctttataggtttggcctaatcagagataggtttgaaagttttggctccatggtcaggacagacagtaccaggaaactcaacataaaattttgagatcctagagtaactaataattctaataactatacgttaagattatatagatatataatatgtatgttactattattatatattgttgctgttattcttgttataaaagtaggaattaaaagtaagttccaagaaacactggagggtctgggaaattataaatatgatagattctgggagttgtggaattttagtaagccagccacgtaagagttttagaatcagggaggtagtttttaaacggatggagtagagactggaagtataaagtggatattcagtagaagagaatgcctatcagtaacctaaatgtgagtgactataactggggaatctgggtaggtgggtataaatacaactaaaaatggaccattcccaaactcactgatttttatctaatgctggcttgagacaaccgaggcaagcagaaatgactcaaaatgaatcaactttttttttttttttctttttttttgagacggagtctcactctgctgcccaggctggagtgcagtggtgtgatcttggctcactgcaacctccgccttctgggttcaagtgattttcatgcctcagcccccctgagtggctggcattataggcgctcgccaccacacttggctaatttttgtatttttagtagaaacagggtttcaccatgttggccaggctggtctcagactccagatctcaagtgatctgcctgccttggcttcccaaagtgctgccggcaggcataagccaccagccaatttttgccgtgtttttgataggttaatatcacattgtggatctttatcaaaataaagtggcagcatcttagaagctcagttttcgcaaggaactgggatacaataggtcatatcccaggtgctcagtgtccttaggtttgtttttatttgctgaaatctcagtggtttgaagttgataaattgtctcgatagcaaaagaacaataaggcacagtgtcatgtgcctgtaatcttacctactcaggaggctaaggcaggaggtttgcctgcactcaggagttcaagaccagcctaggaaacccctagtaaggggtttccttacagcctagtaagaccccatctcaaaaaaaaaaaaactaacaataaaacaagttctagctacccaacatttttacaacctaccatctatagaagttcaataattttgcaggaacattacgataagtgtcgacaacatccacaaaaacaatatcatcatagatgctgctttcctccttcagtaaggcatcttcctcatggagattccttatatgatcaataagtctttgagggcgagaatgaaggttgtgtaagagagcatcaccttctataaaggaaaagttgagagttggagaaaaatgctgttgtaaagttaccattcagaactgatgatgtacactaaagttcttttcccaaggtaacccagcagaaacacatgcagttgtttggaactttaggtagaaaaatgggaactctcatacactgccagtaggattaagtggatgctcccactctggaaagcaatttggcaatatctatttaggctgaaaatgtgtacaccttatggttcagttgaggccacttgtagatatatccctactaacattatttcacatgaggatattaattacagcattgtttgtaattgtggaagaaaaatgggaccaacctaaatgtccactgagagaaaaaaaaaaaacagccaagttgtggtatattcacataatgaaatatagcagttaaaaaaattaccctgatcttgcatgttaaaaggattgggatgaaaaaataaagttgagtgaaaattgccaagtgataaatacaatatgacaccacagatatcaattataaaacactcaaaactatgttatttaaagacatggtcaggcgtggtggcttatgcctgtaatcccagcactccgtgaagccgagggaggagaatcgcttaagcccaggagtttgagatcactctaggttatatagggagaccccatctctaaataaaatttaaaaattagccaggcatagtggtgcatgcctctggtcccagcttcttgggaggccaaggcaggaggatccctggagcccaggagttcaaggctgcagtgagctatgattacaccactgaactccatccagcctaggcaacacagcgagaccctgtctcaaataaataaataaataaagagacgtaaatatgttcaaagtagaaaaataagaatgggaagggtacacatgaattttagggaagtggcaccccctttgaggagagggaagaggaatacatctagggagaaccacaaggaaaaggtttcaactgtacctacaatgttttcttttttttctttttttgagacagagtctcactctgttgcccaggctggagtgcaatggcatgatcttggctcactgcaacctccacctcccagattcaagtgattctcctgcctcagcctcccgagtagctgggattacaggtgttagctaccacgcccggctaatttttgtatttttagtagagacggagtttcaccatgttggccagctggtctcgaactcctgacctcaaatgatccacctgcctcagcctcccaaagtgctgggattacaggcgtgagccactgcaccaggcatataatgttttctttctttcctctctttttcttttttgtttttgagacacagtctcactctgttgcacagactggagtacaatggcacgatctcagctcactgtaatctccacctcccgggttcaagcattctcctgtctcagcctccctcatgagtagctgggattacaggcgcctgccactgtgcccagctaattgtttgtatttttacaaacaattgtaaaaattgtttgtaacaagaggcagggttttgccatgttggccaggctggtctcgaactcctaacctcaggtgatccacctgcctcagcctcccaaagtgctaagattacaggcatgagcgactgtgcctggccatgttttatttaaaaaaaaaaaaaaaaaattagaaatgaataagaaaaaatgtaaataaaaaattgttaattctgagcactgggtacctggctgtttctgtactatttctggtgtatttatgattatttcctttgtttttttttttttgagacagggtcttgttctatcacccgggctagaatgcagtggtgtaattatagcttactgcagcctcaacttcctgggctcaagtgatcctcccacctcagcttcccaagtagctggtactcccggcacctgtcaccatacccaggaaattttcaagttttttgtagagatggggtctcgctatgttgtccaggctggtctctaaatcctgggctcaagagatcctcttgcctcccaagtttctgggagcctcccaaagttctgggactacaggcgagagccactatgcctggccatgatatttcataataaaaatgattactaatgtgcttaaaagacaatttatttgccacttcacaagttaatgagtcacttgtcacgtgtgcagggactgtccccagatcctactgatttaaggcaattctttcgctgtggcaggagacgtcaggatttcctaaaaatgtctcaatcaaattaaagaaaaattttgaaaaatacaaagaaaatgagctgctgagggtggcaaaggaaatgaaatacaatttagcactgcactctttgtcactgcaaatggaaaggatgaggtgggaagctgaaggcctatatctgacttctgcctctcatgacttgtgagatactggacaagttctgttgtctctagaccacagcagtctcacctgtagaaaatggtgctggattcaatcagtgattcttgggaatgcttgctgaaatgcagattcctgggccccaagcctaaagattcagtaggtctggggtggagcccaggaatctattttttttccttctgcacctgctcccaggaatctatatttttaatggccactgctgcgaccctgatgcaggtaggcagaacacagaccagcctttgagaaacacaggggtagatgacctcctgtttttttttttttttttttttttttttttgagatggagtctcactctgtcacccaggctggagtgcagtagcgctatctcggctcactgcaacctctgcctcccaggttcaagcgattctcctacctgagcctctcgagtagctaggattacaggcgtgcgccaccatgcctagctaatttttgtatttttagtatagatggggtttcaccatgttggtctggctggtctcgaactcctgacctcgtgatccacctgccttggcctcccaaagtgctgggattacaggcattgagctactgcacctggcctgacctcctgtttagacttacaatttttggactttacgataatgtaaaaacaatatgtgttcaccagaaaccatgctttgagtacatatgcaaccattctgtttctcatgtgactacagtcttgtgagatgttcaacctttattatggaataggctttgtgttagattattttgcccaactgtgggctaatgtaagtgtcctgagcaagtttaaggtaggtgaggctaagctataacattcggcaggctaagtgtatgaaatgcattttcaacatacatttttaacttaacatgggttcaacaggatgtaacattgtaagtcaaggagcatctgtataatttaacacttgatggaaagtgaaagtgttataaaattgtaacaggaaaatggcttgtaacaacaggagtgcagaaattaaatacaagccttttagactagtaacacattttgtttcactgcatgtatctgaaaaatatgagcataaattaatatgtcaggaaaatgaaaggatgtctgcttttgccacttctattcaacatacatgttctagccaggacaatcagataagaaaaaaggcatccagattgaaaaggaagaagcaaaactctctcttcttacagatgaaatgaccttgcatgtagaaaatcataaggtctaactttaaaatgattaagtaataaatacatggatctgttcagcaatgttgcagcacacagatcaatcacaaaaacaatctgtatgtctatatactcgcaatgaacaatcttaaaattaaattagaaaaacaattccacttacaacagcatcaaaaagataacataagtatttaataatttaacaaaagaagtgcaagacttttatactgaaaaatcaaacatcattgaaggaaatttaataagacatggatgttcaaagacttaatactgttaacacggcaatactccccaggttgatccacagatagaatgcaatccctgatgggaatgtgaactagtacaaccactatggaaaacagtgtggagattccttgaagaactaaaggtagatctaccatttgatccagcgatcccattaggaaagtaagtcattatatgaaaaagatacttgcacatgcatgtttatagcagcacaatttgcaactgcaaaaatatggaaccagcccaaatgcccatcaatcaatgagtaaagaaaatgtggtatatatatatataccatggagtactactcagccataaaaagaaacaaaataatggcattcacagcacctgcgtgcagctggaggccattattctaagtaaagtaactcaggaatggaaatccaaacatcgtatgttctcactcataagtgggagctaagctatgaggatgcaaaggcataagaatgatacaatggactttggggacttggtggggacagggtgggagggggtaggaataagactacacactggttacagtgtacactgcttgggtgatgggtgcaccaaaatctcagaaatcaccgctaaagaacttattcatgtaatcaaacaccacctgctcccccaaaaccgattgaaattatatatttattcatatatatgcatatatatatatgcaatcccttaaaacattccagctaggttttcttttttttttttgcacaaattaacaagctgatcataaaattcatatggaagtgcaagagacccagaatagccaatcaagcttgaaaaagaacaaggttggaggattcacatttcctaatttcttttttttttttttttttttttgagacggagtcttgctgtcacccaggatgaaatgcagtggcaatctcagctcaatgcaacctctgcctcccaggttcaagcgattcttctgcctcagcctctggagtagctgggattacaggcgcccgacaccatgcctggctaatttttttgtatttttagtagagacagggtttcaccatgttggtcaggctggtctcgaactcctgacctcgtgatccacctgcctcgggctcccaaagtgctgggattacaggagtgagccaccgtgcccagcctcccaatttcaaatcttactaaaaagctacataatcaagacagtgtagtactggttaaagacgcagacacatagatcaatggaatagaattgagagtcctcaagtaaatccttacatctacagtcactgattttcaacaaatgggtgctgggacaactggatatccacatgcaaaagaatgaagttaaacctctatttcatgccatatatgaaaatgaacatggatccaagacctacgtataagtgctaaaactataaaactcttggaactgtaaaacaaaggcacaaatctttgtgacctcacattagacaatagttccttacatatgacagcaaaaacatgtgacaaaattggacttcatcaaaatttacaacttttgtgtgttaaagggcaccatttgcaaagcatgtatctgataagggacttgtatccagcatatataaagaactcttacaattcaacaataacaaaataattttataaatgggcaaaggatctgaatagatatttctctaaagatatacaaatgactctctctcccctcctttcctcccttcttccctccacccctccctccctcaccaccttctccctctctccaccccttcctccctcacttcctccccctcctccctccctcacttcccacatctagctcatataccataataattcaccctgttaacagtgtgcagcctcagcaatatgacaaaaccctgtctctacaaaacatttaataattagctgggcatggtggcatgcacttgtagtcccagctattcgggaggctgaaatgggaagttcacttgagcccggggaggtcaaggctacagtgagctgtgatcatgccactgcactccagcctgggcaacagagtgaggcctcgtctcagaaaaaaagaaaaacaacgaaacaaaaaaggaagatatacaaatggccaataagcacatgaagaaaatgctcaacatcattagttattatggaaatacgaataaaaatcacaatgaaataacaatttacacccactaggattggtatattttaaaagacagacaatttattaagtgttgacaagaatatggagaaactagaatcctcatatactgactatggaaatgtaaagtgggctgctgctttagaaaacaacctggcagtgcctcaagtgattaaacacacaattatatgacccaggtcttctactcctagacatttaagagaaatggaaatatatgaccacacaaaaacttgtacctacatgtttactacagaattattcatattcaaaaagtagaagcaatctaaatgtccatccattaatgaatgaataaaatagggcatatcgatgcaatagaatattatatgatcataaaaaagaagtactgatacatacaaaatggacagacctggaacacatgttacagcaaagaaactgacacacagagtacgtactgtgcatttccatttatgtgaaatgttcaaaacaggcaaatccatagagaaagaaagtgcatcagtagttgttagggggtggggggttggggaggtaagaatgaggagtaactgctaatgggtgtggggtttccttttgggaggtggagccggttgtagaactctaagaatacactaaaaccactgaaccactttaaaagggtgaattttatctgaataaagttttttaaaagacaaaaaagaaaaaatccttttctctcaagtataaagattaagtgtaagacattcagtgtacttttcaagtttcaactagcaaacttaccctgaatagtatatataaaaccacctgcaactccctccacaccttccaagaattcatgaggcaatgcaccctccccagcctgaaaggaataagaatgtactcagtgattcattactaaaaatacactgatcatattttaaaatcgatttgacaaaaatcataatatgactccacttgcagcagataaatgcatgtaagatgctggtgcactggaggcttataatatcaggatgacatacggtattctactatttttgttatctaattacaatactaaagataagatatacccaacattccataaggtgttcagaattgcaacttacatagaatcatgtttatgtacttgctactctagtagtacaaaaagcaattgattttacatcccaaccccaccacttaaaaaaatatgtattacgacctttgattttttggaaactaaaaattctcatgagttcaaatacatcttggcatgctttaaagttaagagaccatgcagagaaaggctcaaaattaacagtctgttccaaatattcaaattgaactctactgtatattgattaaaaaaaaatttttttttaatttttaatttttcttttttttttttttcaaataagagacagtgtttcaccatattggtcaggctggtctcgaactcctgacctcaggtgatccgcctgcctcagcctcccacagtgctgggattacaggcgtgagccaccacacccggcctaatttcattttacagacagggtttcactctgatgctcaggctgagtgcagtggtgcaatgatatctcattctagccttgaacatacaatcttcccatctcagccttacaagcagctggcactacaggtgtgcaccaccatgcccagctaatatttataaattttttgtagagaagaggtctcactgtgctgcccaggctggtcttgaactcctgggctcaagtgatcctcccgcctcggtctcccaaagtgctgggattacaggtgtgggccactgtgcccagcctgttgatgttgttgaaggtgcttaagcctattgtgccagcagccaatgacagtcctttctacttcttagaatggagaatcttttattattaaagagttatctctcttcaaaagttacccaatggccttactcagagtgaactgttttacttctgtatacagtaaaccactatggtacatctaccagagtattgtctggctgttgtgggctagatcagacagttaagagtccatactcagtgtatttacagtattttttctacaccttcatttaatcaagagagctactgcttggctattcttaaacagatcttttcagagttgtactgtacaaagcaatgttttaaggccagtagaagaagtaatctgaggtcactgtagtaacttgtcatttaatttaaaatatgtttgtaggccaggcgcagtggctcacacctgtaatcccagcactttgggaggcggaggcgggcggatcacgaggacaagacatcaagaccatcctagctaatacggtgaaaccctgtctctactaaaaatacagaaaaattagctaggcatggtggtgtgtgcctataatcccagctactctggaggctgaggcaggagtatcacttgaacctgggagaaggagattgcagtgagccaagactgtgccactgtactccagcctgggtgacagagtgagactccatctcaaaaaaataaataaaataaaataaaataaaagttcgtagccaaatgtgaaaattactaaaggggcaggctatagattccaacgttgtagttccataaaagactgtatatgctttatttgttatttacttatttactttttttttttttttttgagacgaagtcttgctcttgtcccccaggctggagtgcgatggcgtgatttcggctcactgcaacatctgcctcgggggttcaagcgattctcttgcctcagcctctcaagtagctgacagtcgcctgccagcacacctggctaatttttgtatttttagtagagacggggtttcaccatgttggccaggctggtctcgaactcctgacctcaggtgatccgcctgtctcggcctcctaaagtgctgggattacaggtgtgagccaccgcgcccggcctacttatttagttttttgagatggagtttcactcttgtcgcccaggctggagtgcaatggcgtgatcttggctcactgcaacctctgcctcccgggttcaagtgattctcctttctcagcctcttgagtagctgggattacgggcattagccatcacgcctggctaatttttatatttttagtagagacggggtttcaccatgttggtcaggctggtctcgaactcctgacttcaggtgatctgcccaactcagcctcccaaaatgctgggattacaggcgtgagccacagcacccagcctatgctttattttttattgtatatttctatattgttttggctttagaactcaatagtaatttctgtttattaacttctctctaaaaggtcacaacttggctttttgcctttaaaatttttctgacatcacttgctggcaagggaataaagcttagtgaaaactctcagctgtacgcatttgtgatgaaaatcttaatttgtacctggggtttcttagcgtaggctttaaaaagttacctggttttgtttttgtttttttaggttaactgtatgtttaagctatctttagccctctataataatttttactcccaaaggcagatcatttgagtctttacatttgaacctagttctcaactcagaaacctaccttttttttttttttttttttgcgacggagtctcgcactgtagccaggctggagtgcagtggcgcgatcttggctcactgcaacctccacctcctgggttcaagcaattctcctgcctcagccttccgagtagctgggactacaggcacccgccaccacagccagctaatttttgtatttttagtagagacggggtttcaccatgttggccaggctggtcttgatctcttgacctcgtgatcctcccacctcagcctcccgaagtgctgggattacggcgtgagccaccgcgcccggccaatttatttcttttagtgtaaccaatattatagaattttggcatatgctgggtattttaaagtttcataaatagaaaaggaggcaagataataaggaaagatataattccataaaactttctattttcagtaaaaaatttttcataagacttaaaatgaactttagtaaacaagtggtgtgtgtgtttactaaagtaaacaccatctttattgtcctccatttactttatgaaatttacctgtcataataaatcctaaatcctaaacatgaatgaaatcctaaacatggcctacaaatctaaatgtataactacatatgaatctatgggtctatttgtttaatgtctttcttcctcactggactgtaagttccacggtgggccactagtatgtctattttaccctgccattgtttctgccttaccacaggtatgcaggaaatgttttttgaatgagtaataacgtagcatatattcatttcaactcagaaattaatccatgtaaatgaggttaatattcattcactaagcttgtgaatttaaatgccaagtacattcctaatcattggacaggagatcgaggagaataaaagattgtctatgattccaccgtacagaccgtttgtttactaaagttcattttaagtcttcatatacctgctttattgacctatatttactttgagaaattcacctgtcaaactgttttaaatttaaagcaaagccgaatgagaaatatgagagtcagaaatcccagagttgcttcagcaaaataaatgaaagtactcaatcttattttctatttttttttgttttgttttgagatggagtctcgctctgttgcccaggttggagtgcagtggcatgatcctggctcactgcaacctccacctctggggttcaagcaatcctcccacctcagcctcccaagtagctaggattacaggcatgcaccaccaggcccagctaattttttttttttttggatttttagtagaaacggggtttcaccatgttggccaggctggtcttgacctcctgacctccagtggtccacccaccttagcctcccaaagtgctcggattacaggcataagccagcacaccccgccttattttccaatatttttatctatagtagttttttttgtttgtttgttttttttgagacagagtctcactctgccacccaggctggagtgcagtggtgtgatctcagctcactggaacttctgcctcctaggttcaagcaattctcatgcctcagccacctgagtagctgggattccaggcatgcgccaccatgcctggctaagtttttgtatttttagtacagatggggtcttgctatgttgcccaggctggtgttaaactcctggcctcaagtgatccacctgcctcagcctcctaaagttctgggattattggcatgagccaccgcacctggctaattatagtattttaactgaggttttattttcaaggtgagatagtaaatactctgaatactactgagcaagtattcttaaagaatgctaacttaaaaattactgagaaataggccaggtgcagtggctcatgcctgtaatacagcactttgggaagcgtaggtgggcggatcacttgagcccagaagtttgcaaccagcctaggcaacatggtgaaaccccatctctacaaaaaacacaaaaagttagctgggtgtagtggtgcgcacctgtagccccagctacatgggaggattgtttaagccaggaggtggaggctgcagtgagctgtgatcgtgctagtgcaccccagcctgtgcaacaaagtgagaccctctcaaaaaaaaaaaaaaaaaagagaaataaaatattgcattttaaaaatgcatcaatcttaaagcaaaactgtaaactcactaatgctggagttacaggatcatatttgagtttttgcctttactatgaagacaacaacatttgctactatatatgttgtaaaacacacaagaatcattgctccatgctgcctgggctctaaggtaaattttagaacaattttatatattaaaaagaagctaaaatatgcaattaaaccttaaaaaaaaacgacttactgtaatgactctgagaactccccctccatcattcactgtcactttgtggagatttcttgacacaaggccgtggaggtcttggctctcccacacgattgtaccttcaaagctcttttgtagaaagatgaatagtgagtcaatttccttattgctgtcatttaggttttaagtatgctttcaggcaagatttttagagaaaatttttcccaaaacgtatcatttaaaattttcaccccataactctgacataccactgttagcgtttggtgtgtatccttgaccgttttttccatgcacatataaaaaaccaattacaaagagtatatacacaattttgcatactgctgtttgccatttcccattgtatcaaaagcatttccttatgttgttgcagctgtcacagccattcttcctcatgtgtgtataacatcccaatgagcagatacaccctgatttactcattttcccctactattagacatttggttgctactaaatgtctactaaaatatctactaagtatctactaaaataatgtaggcatgttttggtgtacatgtttatttactcctaacaatttgttttgtacttacattcccagagtgaaattactgggacaagaaagagatatttttatggattttggtatacaccgccaactgctttttgaaagcaacttttactaatttatagggttatcagcaatgtatgagaatgacaactgcactgtattctccctggtatgggatactagtaaacaaaagtttaacctaatatactagatttttacaaaatgattccttatttagttggatttatttttcagtttttgacacagagcctcgctctgccacccaggctggagtgcaatggtgcgatcatggctcactgcaaccttcactctccaggtttaagcgattctcttgcttcagcctcccgcgtagctgggattacaggcgctcactatcacgcccggttaatttttggatatttagtagagacagggtttcgccatgttggccaggctggtctggaactcctgacctcaagtgatctgcccaccctggcctcccaaagtgctgggattacaggcatgagccacggcgccctgcctgaatttaaaaaaaaaaaaaaaagattggcttagttggatttctgattcctagtgatgtttatgaattgcatgttctcttctgaggactgccttatcatgctgctttgccatctgccctctgagttttctatttttcttgttcatctatgcaagcttttaataaagtaattatcttaatcctgtgcacattttatatgctaaaatagtttttcatttgctacttaatgctatttttgaaattcagaagtccataaatttcaccttggcaaatctgacaaacttttcctttgtgattattactattaaattctgagctgagagagctatgcccccctgtcccaaggtctgatatatattgaaatcttaatgtcttctaatttctccatgatcccatttttaattctgtgcacagctggctccttagtcctgctcaggtctcagctccactaccttctcctccgagaggctttctccagatgtcctccagaaggctccaactcccaacttctatcacatcaacctgttttatcttattaataccatttatcactctgatatttcttattttattttattattaaactaactgcctctactagaagacaaacaccttgagaacaggaaggagcttgcctgatcaaccactgcatccccagcatcgagcctggcctgacatgactgacaactcaaaatgtttgctgaataaataatgttgaactaaaaatcaaccagaattgactatagtatagaggattaaatgaaagatatacctctaatactctaaaaactttcatgttaaaatgaagggataaagtactttacaataatgtctcattttagccagcagtatagggaaaccatacaaaattcaatttgataagctaggtcagtggtttataaacatttttttccctctgcacagagtgatataaactttttctttttttttatttttatttttttgagacggagtctcactctgtagcccaggctggagtgcagtggcatgatctctgctcactgcaaaccccacctcccaggtcctggttcaagtgattctcctgcctcagcctcccaagtagctgggattacaggaatgtgccaccatgcctagctaatttttgtattttcagtagagatggggtttcaccatgttggccaggctggtcttgaactcctgacctagtgatctgcctgcctcagcctcccaaagtgctaggattacgggcgtgagccaccgcccaacctttcccttcctttctttccttttttaaaataaataatatttttttcctcctccaaaacagataaaaatattccaagagtccggattcctcaggcagtttatcgctctgtattcagctaatgtattttcttctaaaactttaatagtgatagagtttggaaggattgatagcatatatacttaggataaggaactgataggacttggtgagtacctggacatgagagtgacgataactctcatgattctggtttaggtgacttgaggaaaaggagatggttacccaagattaaaaatacaggcgatgagaacagatgggatggagacaatgttaccattagaatgcccatgggacattcaagtggagaagttcaggaggcaactcaaagcatgtctggagttcacaagagatgctggggctgtaattatagatttaacagccttcagcatacaggcagtaatgaatgaaattgcctgggaagaatgagtaaaataaaacagaaggctaggtagcaaatcctaatgattaatatttaagaggaaagcaaaaaggaaataatgaatcataccaaaagtaaaaactatagtgaccagataaaaatcctcaccttgaaactacaaatctagaaaagatgatgataaaacgagtaattctctgtactgtccattcaattgacatgacatgtgacatgctatttcacagtgggtccttcctggcacccaactccattttgtctgtgactaggctatgatacaacaaacaaattcaatgaataattgaatgtgttaccagaaaaattccctagtcctcccaaatcatcttgacttactcatggaacttaaataacccatcagctgttttgttactaagcaaggaagaagctttatcttccacctgtctcctaaacctgtttctgctccacaacacagtttaatttctattcctcacctctgctctcatacacctactttttattctgatgtaaggcaattatgaagccaggtatctcttaagatccaaaacaacttgtttatggcaattcccttactaagatcataaaaaccaaaataaaagttgggaaaaaatagcatgatacaggttggaaaaatgagatatcatatctatctctcccataacataagcaagctgtctgtaactcctttcacgcatcaactcttttccataaagcttctaatttctcatccaaacaacagagtagcttaaatatatacagtacttctgtgcctataaacattaacaacttcttgtggattggagaaatgactatatataaagaatttcaaccttcacaaaaaataaggatataggctgggcacggtggctcacacctgtaatcccagcactttgggaggccgaggtgggtggatcacctgaggtcaggagttcaaaaccagcctggccaacatggtgaaaccctgtctctattaaaaataaaaaaaattagccaggtgtggtggcaggcactcgtaatcccagctattcaggaggctgaggcaggagaatcatttgaacctgggaggtggaggttgcagtgagccaagattgagccattgcactccagcctgggcaacaggagtgaaattctgtctaaggatgtaagcgtccataatgctaacaataacgtcgctagtgacttaggtgaacaaaaatagtctgctttttactgaaattagttacaggttccaactgtaccattaaggacaacataaaattagagacatatatatatatatatatatatatatatatatatatatatatttttttttttttttttttttgagacggagtctcgctctgtctctgtcactcaggctggagtgcagtggtatgatcttggctcactacaacctctgcctcccaggttcaagtgattctcctgcctcagccttctggtagctgggactacaggcatgcgccaccacacctggctaattttttgtatttttagtagagatggggtttcaccatgttagccaggatggtctggatttcctgacctcatgatccacccgcctcggcctcccaaagtgctgggattacagatgtgagccaccacgcccagccaaaacataaatattttaagagaaacacacagtagtcttcacttgtgaagaatcacttgtgatgcccactgagatttatgcttcagtgagctacacaatgaaaaccttacaggcgacctgcttactggacaagctatactgccgacgtgtgactccaggcaatcaccaagtgtggagggaatacgatgatgaacttcctctcgcaaatggaatacactacctacttctcttctgttactctttgctgatgatatgccagcaaacaatcactatcattcttccgagcaaacaaacccaatcagccttgatgcagtaaaaaaaaggatttaaaattaaacatattttcaacacaaatagaattttgtacaacaggagagaatttttttaattgctaaaagtttattttttctttctattatataaagctaatatatgtttattatggaacatttagaagatagatatacaaaaagaagaaaattaaaatcatccataatcttagctccccaccaggtatagccactattaaataattgcttgctttttgtgtgtgtggttatttttgttgtttgaatagggactgggtttcatcaagttgcccaggctggtcgtctcaaactcatgggctcaatgatctgcccgcctcggcctcccaaagtgctgggaggataagcctgagacaccacacgtggcctgcttgttttttaaaagaaaaaatattatacaaaattaataaaggtaataaaatcaagtctatttagcctaaagcctgaagggagataaaaagcacaaggctatagtcattaaaactcttaataactagacctggtggccaggcgcagtggctcatgcctgtaatcccagcactttgggaggccaaggcaggcgggcggatcatgagatcaggagatcaagaccatcctggctaacacggtgaaaccccgtctgtactaaaaatacaaaaaattagccaggcgtgatggcacacgcctatagtaccagctactcaggaggctgaggcaggagaattgcttgaacccaagaggcagaggttgcagtgagcggagatcatgccactgcactcccgcctgggtgacagagcgagactccgtttctaaacaaacaaacaaacaaacaaactagacctggtgtggtggctcaagcctgtaatcctagacctttgggaggtgagaggattgcttgaggccagaagttcaagaccagcctgccaacatagcgacacacccatctgtacaagaaataaaaaatttaggccaggcgtggtggctcatgtctgtaatctcagcactttgggaggccaaggtaggtggatcacctggggtcaggagttcgagaccagcctggccaacatggtaaaatcttgtctctactaaaaaatacaaaaattagccggtgtggtggcatgtgcctgtaatcccagctacttgagaggctggggcaggagaatcacttgaacgtgggaggcagaggttgcagtgagccagaatcatgccagtgcactccagcctgggtgacagagcaaaatgctgtctcaaaaaaaaaaaaaagatataaaaaatttagttgggtctggtggcaggtgcctgtagtcccagctactcatgaggttgaggtaggagaatcatttgagcccatatggttgaggctgcgatgagctatgatcatgccactggactcctgcctgggcagcagagccagagcctgtctcaaaaaaaaaaaaaataagtaaataaaaattaggggaaaaaaaagtcttaataactacaaaggtaactcactattttggctgagtacttcccatcattagtacccactgccagatataccatcctgaacacaagcaaggaaggttaacccctctcccccaacccaatttttattttgaaaagcttcaaacctatagaaaagttcaaatcaccattcaaatcacctagactcaccaactgttcacattttgccacatttgcctttttgctctctctccacacacacttttctgttgttggatcacttaaaaatacagatatcatgaatttttaactttaagtatttcagcatgtatttcctaagaacaaggacattctaagcgaaaataatattttttatgaactaatcaaaatttgcaattctttctataaggctgaccaagataatggaacagactccataaaactgcgattagcttgaagcattaaagttcattttcttcctctttgctgcaccccatgtgactttcttttggaatacagtttctcaacctcagcaccaatgacattttgggccagataattatttgctggggcgggggtggggtggtgtcctgtggctgcaggatgtttagcagaatccctgtccctttacccactagatgccagtatcaccctacatccagttttaacaactgaaagtgtctctatacactgctctgtgcgcggagggcaaattgcccctggtgaagaaacactgctcttaaagaataggaccccctcaatccagatgaggagtataatgataatgacaacatctattgatctactgaatgcgtggcatatggcagcatgttctaagcagtctacgtgtgttaaatcatttagcccccagaataaccatctgaaatgggtggtgtagcaccttcatcttagaggaggaaatagacacagtgagattaagcacctcatgtgaatgaacaaaccaaagaatggcttcctgcaaaaactgagatccaacactatgtatctgaaccactattcttttttttgagatggcgtctctctgtggcccaggctggagtgcagtgttgcaatcttggctcactgcaacctgtcccccgggttcaagcgatactcctgcctcagcctcccgagtaactgggattacaggagcctaccaccgcacccagctaatttttgtatttttagtagagacggggttttgccatcttggccaggctggtcttgaactcctcaccttgtgatccacccgccttggcctcccaaagtgctgagattacaggtgtgagccactgagcccgacctgaaccaccattcctgaagtaaaaggtaactttgatggtacatactgcacttaaaaaggaaaaaagttcatatgtgaagttaataaaaggatgtaggaaaacaggcactctcatatattgctaatgattgttcacactgatacaaattgctaaactcccctccaggaaggaatcatctgacttaaaaatgtgtatacccttcgacccaacaattcatcctaagaaaataaccagttatacacataaaacagaggtgcagtgatatttactacagtcttttccataacaccgaaaaattgaaactctatcaacacccaaatacagagttaaatgacaatactttcatacaatgtaattctatatagccattacaaataatagagcacatcaaaagatgttcgtgatatgttaaagtaagtaaattataaagtagaatgaacggcataatcctagcaactataacacatagaagcaaaaatgttaaatgtgattatctccaaatatgagattctagtagtgttgttttcctttagcatatctgcattttcctttttttccacccctgttttagtttggcttttatttaaaagtcgttttgttttttttaatttattttttgactgcttttgcggagcaggctatcctataagcagtatgctgagagtagcgtattcagaagtttttaaaatggaagttcagatacaaatgaaaaggagatccctttgacactgacagaattaacatatagtttcaactacttgtactcaattccaaagacccatagtatgttacaaaaatgtgtggttcctattgctgaacacattgtgaatggcacaccacagaatgggtaggaaaaagtttcttggttagtcaccagggccggtcagttgtctagcctccacaccttaacccagctgagatgctgcgggatgaactctacaggtgatctaaagtgaatcccagagatgtctaggaaactgaccccgattgtggttccagagcactgagttcaggaatgtactcggcctagactaaaacagcctagaaaggctgaagctgatgaatgaataatttgttatgtctgatcctgattctgtcacactctgcgaccatactgtgtggcttaactccaggactaatgagggcacctggcaggcgaggcattctttagtgcatatctagttatgactggacctagagggacccagaaggtgacaggtacattttcaggctatcatccacaactgttcaccctttggagaaattttatttaacttggaaacatggcccatctctatcattaacctgtctgcactgacttttttttcttttcattctttagataagcaaattatttaatttttacccaaatggtatctctgtctggtctttccatcaatccacacccaacatcatcctttgtcattaaaacagttgtgtagttctctactccactaaataaactacggaaacatgcaatgtttttcaaaaagtggttttggaacctctgaggcctcatgaagtcctcaggaggtttgaatacagagtgctatgttttagcccatccacagttggtaccttcatctatcactctggagtgctgccctggtacaagaaaatatcaagtgcctgcccctgaaagcacacgcccactcctatgaaggactgcattggtactacagtcttttcctgccatcctgtacctctggtaagatgaattgttccacgggcttgtaccacagcttgttcacctgcacaccacagcttggaggactgaagcgagcaatgaagagggcctcctacaaattgggagaaaaagacaagaaaaaatacttcatgttatacattgcatatgcaaaaagttttcaaacaccttacttcttggtcagctaaatccacaatggccctaaccacggtcactaacatggttctactgtggttttggcatcactgggttttctagtgcagtcatggttattaaataacgatatttaaggtaatcaaagttgtcacgaaattctcaaatgctaaacataatccacataaccttaaaaaaaaaacccaccttgaaagaaaaaatattcagggaagtgagcagtgttgttaaattaagccaacacattatagtgtcaacactcccccaaagggttaaaactaaactgaaagacacagatttttactgggaacaaaagcactcaggaaactccgttcaaaaagaatcttcagaagaaaatataaacaaaacaaaaaagggaatataaaagaggactggagccaggtgcagtggctcacgcttgtaatcccaccactttgggaggctgaggcaggcagatcacttgaggtcaggagttccagaccagcctggccaacatgtgaaactccaaatttctactaaaaatacaaaaattagctgggtgtggtggcaggcacctgtagtcccagctacttaggaggctgaagcaggagaatcgcttgaacccaggaggtggaggctgcagtgagccaagactgcaccactgcactcccgcctggaccgcagagccagactctgtctcaaaaaaaaaaaaaaaaaaaaaaaaaaaaaaaaaaaaaaaaccggactgattttcactatgtctatcgttttcttgggtcctcccatttcttccaggcaacatttcctcattctcatgcctattcttatataccaacttaaccataggggaaacttctgttaagctcttaaaaccatgcaggggttcaaaattaagcacatttcaatggattatgtctatttctttcatgaacaccagttcttagcaatgcagtataagaatagtttttgcatcgtgactacccatgaacccattagcatccatcttagactagtccttccttgaggacaaagattaactcctccctggttaaaaatatggcaactagaagttatatcgacatgatcaaaatattgtatgtctgaaccaaactacttgattgataactcgcacactataaatagttttgttttttgagacagtctcactctgtcacctaggctggagtgagtggtgcaatcacggctcactgtaatgcagcctcgacctcctgggctcaagtgatcctcccacctcaacctaccaagtagctgggactgtaagcaaatgctaccatgcctgcctattttcttaattttttgtagagatggggtctcactgtattgcctaggctggtctctaactcctgggctgaagcaatccatctgccttgccctcccaaaatgctgggattacaggcgtgagccattgcgcctggctgatagttttttttttaaactatatatactaagataaacaagtgtatcaaaaaaattcaagattaattctaatttctagataacagtgatactcagagtactgctatttcaattacctatttgatcttcagtatcaatgaaactgttaactacaatcatatatggactcctatagttgagtatacaaagctcttctcactaatcattatagctggcatcatcagtagaaatcctactcttccctctgtcttatatttatgtctataaacacatcaacaaacgagacagattatttagaggaagaacagggcaaattccaaaaaagaaatttaatctcaaatttatttgtgtatttattgatgagtctctaacattatattcattgctaataatcaacattaataatacaaacacattttaaaaaactgaacagagttctgctgccagtaatatcagaccaattctcctatagatagtaactatgaactctggatgaaacataaaaaacaatgatttgaaggcactggaattcaaacaaacaggcagaaactagagaagaatcagtacttggaagaaggaaaaggctccaaatatgcatctcctccctaccccacttcttgactctttgtctgaggatacaactctagggtaactagaaatttgaatgaaaatctgtagtctttctgcttgaaaattaagaggacagagttggggcaaacacatcaattaataaaaggcattagggggaacctcccagaaaggaaaggatcacagagagagagaaccacaaattcttcatataaactctacccaaatctgtggctgactcatgaaatacacatacaaggcagaacccaagtagcccatccaaggccagagaaactgaatagagattttagctgtttctcactgcaagtgagacaatgtttagtctgtgtccagccaatttagctgcctgctaaaacaaaaaaaaaaaatcaatactctgaggaatataataggatccagagttcctacaatgaattatttacaatatctaggatacaatgcatgagtagcatgtagtcccagctactcaagaggctgagatgggcggatagcttgagcccaggagtttaaggctgcagtgaaccacgactgtgccactgcactccagctcaggtaaaagagcgagaccctgtcaaacaacaacaaaaaaaccaaaacccaaaccaaaaaaccccccaaaatactagacataaaacagaaaaatgttacccatattttagaggaaagataataatcaataaagacagacgctgagatgactcagaataagcgtacacagattttaaagctgctgttataactatggtcaaagctgtagagaaaaatattctcaaacaatgaacacataggaaattttagagaaatagaaacagtaaaaaagaactaaatggaaactgaagcactaaaaagtataatatttaaaataaatctaaaataaaaaattcattggataggcttaacttcagatttgagatgacagaagagtcactaaacttgaatacagatgaacagaagttatctacattagaaaagagaaaaaacactgaaaaaaatgaacagtcttgtgatctgcaggacaataccaaaagatctaacatacatgtaattggaatcccaggaggaatagagagagcgagcgaagtcagaaaaggttctgaagacattaatagttgaaaatcccccaaatttggtaaaatacatacatttacagattgaagaaacatgtagcacgccctgaataaaacagacaaagaaaaagcacaccaggcctggtgcggtgcctcacgcctgtaatcccagcactttgggaggctacttgggaggctgaggcagcactctgggaggccgagaagggcagatcacttgaggtcaggagtttgacaccagcctagcccacatggcaaaatcccatctttactaaaaatacaaaaattagccaggtgtggtggcatgcacctagaatcccagctacttaggagtaataaaccaaatacaggaaaacgttaattgttgtagaatgtagttagtggctatagggtttaccgaataattccttcaagttttcttcatgtttaaaactaaaaaacagatccttcaaatacatttccatgctgctacttcacatgcactctgtgaacaaatcagatttccctacatatcgggaatagagaaacctcactggttttctgttttctgtaaaagaataacttttattccctctatatccttattacaaaaaagatttgaagcagttattagccttgtattacagacttctacagttggaagtaagaggcaataatactcacttatcctaagaatcctaaactttttttatatccattaccaacttttgaaattccctaggttttagggaattttaggttggagatttctaatctagtcaactccttctcttctagatatagcacatttattcacagataatctatccccaaaccagtcttatatcacactacagtgtatttagtcaataggggaagaaaggtgaaagtctctcaaccagagagaattatatagtcttccaatctacttactgtatgtcacaaggaaaagttgatgtttttgaaaaagaaaaaagagaaaaaacctgtacagagcagggcatacctcttgttctgcctgataaagtttgacagtgatgttcctctggaaacccacatcattggcatcgtagaacactccaagactggtaataacgatggggtagagaactcggaaactcacgctgacaactcgatcctcaggcagccccgatgaagtgtcttcggacagactgaacgcttcaatttcctgattcaaaactaagtaatgagaacaggtttatataactgaacaaatgtaatcctttgttttactagtaagaagtagtgaagtgggcttaatgccaaaacctaggtaatcatttgctatataattcacaaatggcaggaatttttaaaaaatgcttgagaaaaatggctgcttctatataaacatttttgaaatttaagaatacagttttcagccacatctaagtaagttaattatcagaactgctttaatagctttttgcataaatgtgtgcatatatatgtataaacgccacaggagatattaaatttaagtcaactggaaggcatctatttggaagggttggataaatagaaataagaaaaacagtactgactgtagtcataaataatcagtaaatttggtcttactgtgcaaattccaaaaatcctacttcttgttaggcaatttaaaatacttgtgatacatcaggcaattattacggtataaataagcaactgaagtcacttcaaataacactgaaaaactcttgctgtacagcactgataaaagataagcatatcaaacacagttttgaaccatcttctatgtaccatttcccatcacatttatatcttcactactacccttgtggttgtggcattatctccagtttacatattaagaaactgaggcccaaaattaagcaattcacctaaggtcatagaaagtggcagatccaggaatcaagtcccatttagtgattccaaagtcagtcccctttccactccctcacagctgtctaatcagtgccaaaacagttcaaataatttttcttttatttcttcttttgagacagtcacccagtcacccaggctgcagtgcagtggcatgaacatggcttattgcagtctcaacctcctttgctcaagggatcctcctgcctcagcctcctgagtagctgggaccgcaggcacacaccaccaggccttgctaattttttgtagagatgggggtctcatcatgttacccaggctggtcttgaactgcaatcctcccgcctcagcctcccaaagtgctgggattacaggcatgagccactgtgcccagccttcaaataaattttctaattaccataaatgaatcagaatacattaaataaagcagttcataggcagggaatatcagtgctactttaataatataaaaccctattttaaaagattatatcaaagttctttgtatcttttagagctgtggttttcaaattttgctgactacacaacaccatcagttaaaaatatttgtacacacacctatttacttacaaaatatatgcatatattgtggtgagtctatatattcagtattaataaagattgtattttcttattttcagataaatagaaattctaagcctgggcaacatggtgaaactctgtctctacgatacaaaaattagctgggcgtggtggcacacacctgtaatcccacctacttgggaggctgaggcacgagaattgcttgagcctgggaggaagaggctgcagtgacctgagattgtgccactgcagtgcagcctgggcaacagagcaagaccctgtctcaaaaaaaagaaattacattttcttcctatactctaggtcatttggttgcccacgtcagacttcctagaagctctttacactcagtagatattcaataaaatgggattaaagggaagtgatgactcctacctaattatagacatgaacaggagggaaaaaagggagaatacagttttttgtcatgggctgggcaagcactaactggagagtctagactacaacataatggacaacaatacaattttttctctttaagatattcagtaaataatagatatccatagtagaaacctctttattaaaagcaataagtcaattataatatagcatttttagatattttcttatctaaaagaattgtgccttgagcttcaagttacgtggacacaggaaatcccgttgcattacagtgctattaaaccttctaccacagccacagtatcacgatgattaatgcttaccatgaccttcaggtactgaaataaccataactgcctttggatcatcgaaaagataagattaggttcaatattaacttagttatatacacatttaaaaattcataacctaggtattacatatatgaaaatgttcttttaacataaagttctacttctttacttttaataaataacagcacttaagataataaaaatatggttaatttaaaagtgaagggcttctttttgttttggtttggttttcaattgtaatttgttggaggatacatcagtggataccacatcagtgacataacattctatggggtttatgatccctttaagactccagtgaggccaggcgtggtggctcacgcctataatcccagcactttgggaggctgaggggggtggatcacgtgaggtcaggagtttgagactagcctggccaatgtggtgaaaccccatctctactaaaaataagtcaggcgtggtggcgggcacctgtaattctagctactcgggagactaaggcaggagaatcgcttgaacctgggaggtggaggttacagtgagccgagatcgcgccattgcactccagtctgggtgacaagagcgaaactctgtctccaaaaaaaaaaaaaagacaagactccagtgaaagccaaaggactttctccccagcacacaattcatacataaaatttgcttacaatgttaactgaattcacagacatcctaagtaagaaacctctattttgtaatacagacctgaatatattgtccaatttatttaaaaagctgtttgaaacccagctttataaaatagcaggctctttaaaataatgttcagtaccttccaccttctaggaactattattctaaatacatcatatgtatcaacttatttcatccttatgtcaatccccatgagggagattcttttatcccaagtttacagatgataaaactgaggcagaggaggtcacacagctagaaaatggcaaagcttggattgagagccatggagactgcttataaaagtgaggtgttacttaattatacagttttaacaaaccttaaaataccagaagtcctaatcagcatatttaagacttggaagtataacctcccttagaaacacagctgaacataatgggaattgctaataaacacagacagttaaaaacttatcaacttcctaaaattggttccctggtgacacagagaacctagttaggatcagctttctttcgttgtctttgtttttgagacagggtctcgctctgtcacccaggctggagtgcagtagcggaagcagatcatagcttactgcagcctcgaactgctggacccaagcagtcctcctacctcagcctcccaagcagctggaactacaggcatgagccacaatacttggctaatgttttttttttcagacatgggagctcactatgttgcccaggctggttttgtgctcctcctcccaccgtggtgtcccaaagtgctggagcagctttctttatcctcaccagaatttttacaaacttttaattttaaggcataaataatgttacttgtgtcttacattttttactattttttcttttacagaaataaattagacaataattctaagagaaagttgattcataatatttgtttcttcaagattattataaattaactggtaaaatcagcagttttccaaaacttcaaaatttggtaattcaggatttatctaagcataaggaacttccaaacgcgtatgaatcacactgaaaaataaagtctcctggatcctaaagttccaattctgtaaagaatctctacagataccccaaggcaatctgtcaaaaatgatgaaataggctgggtatggtggctcatgcctgtaatctcagcactttgggaggctgaggcaggtggatcacaaggtcaggagttcgaggccagcctgaccaacacagtgaaaccccatctctactaaaaatacacaaattagccaggcgcagtggtggtagcctgtaatcccatctacttaagagaggctgaggcaggagaatttcttgaacctaggaggcggaggttgcagtgagctgagatagcaccactgcactccagcctggacaacagagcaagactccatctccaaaaaaaaaaaaaaaaaaaaaaaaaaagatgagacataaatttggatgacagacattttagtctattaaaaacagactccagggcatggtggctcatgcctgcaatcccagtgctttgggatgctgaggctggtggatcccttgagggtaagaattcaagatcagcccagacaagacagcgagacctcaactctacaaaaaatttaaaaaattagccagttttcgtggcatgtgcctgtagtcctagcagggtggtgaggtaggaggatcgcttgagccccggagtttgaggttatagtgagccatgactatgccactgcacgccagcctaggcgacagagcaagaccctgtctctaaaacacataataaaataaaataataaaaaataaaaacagactccatactattaagcttagcaacttttactcaacatcaagcttgtgtatggcagtcaagggaaaagatgacttacctggatttgtgatgttgagtagtttacaggaataaggatcttccctgtcttccacaggcacttcacagccatgagcacctattatgaacttcacaagcacactgagagatgtgttggcattaacatcagttactgatcttcacctcgcacatgcacgtttcctcatgcccatttcagagcttttactttgagacacaagtgtttatgaggattaattctctacctttattcttctagtcagacaaaatgggggaacaagtaaactgaaagttgctaactaccaagttacttatgcatgagtcctttattgcaatgctatattaaagcaagtatgaatatgtctggcctcgctacaagcaaatgttcatatcatttaaaagcaaactatagtaaagtcagttctcatgcccatacctaaaaacatatctatatctaaaattttcctttgctgccttcttctatttcagaaagtgttccttttgctcaagattaggtctttccatccaagaggaaatccccttctctcctagaccttgcttcactggttacccccgtaactagtgactccttccctccacattacaaacatgataaagtcctgactctaattattctcttcaccttccatccttccttgccaccacactttacactgaggtcctacaaagaaattaaaactgcagcctgtttcttacttcccactcattttataaaacaagagttttagctttaatatcaccacctccactgagattccactaatgtaaccaatgagctgctgctaaatcaatagacactcttgaactcttaccttcctggtttctctacggcttaatactgcccagctccctaaaatgctctcttcccttccttctgtggcctgctcagtcatcttcactgcctcttgttccccagcttgtccactgagagtggtattagtctagggctctgcctttgggtcttttctcaatctactcattttttttacttcctctccctaaacaatattatttattctcatggcttcaaatagcatgggaatgattcctgaattagtaactccagttgttttctttttttttgagacagagtctcgctctgtcacccaggctggaatgcaacagtgtaatcttggctctttgcagtctccacctttcaggttcaagtgattctcctgcctcagcctcctaagtggctgggattacaggcgtgtgccaccacgcctggctaatttttgtatttttagtagagacgggatttcaccatgttggccaggctggtctcgaactcttggcgtcaagtgatctgcctgccttggcctcccaaagtgctgggattacaggtgtgagccactgtgtccggacctgaattagtaactctagtttagacccatgtaaaggacctgtaaattcactggacatcttcacccagataacccacagacagctgtgtgctaaagcctgctactactggcttctgggagccaactgtcaacttttcagaaattttgtgagacggttattaaacatagcctttatttaaaattaaattatataatcttataatatatattaaaatcaaaggaaatactcaaattaatcacttaatgttttactacattttactattatgttcttgagatcatttatatttattacatctacatggtggaaatagtatatatggcatgctactgcttatctttcccccactctgtgttcagtgatgtcacattagtcacttgaattggccatagtggaaatattcacaccctagaaactggcaaataatacaaataagggtttggtttattgttttgttgactgtctagacttaagaaagtatagagaaaatgttgataatgcaaattaagcttaatgtgatgtgtctatctatagccactacagagtgaatagttaaaaaaaaaaaaaaaaagtcaaggaagatacgattccagtgttccaaaactattacctgatacagcatagaagtcactgactttattaagtgtaaagctgacatatcttagttgtcactttagtcctcacctcactgtttaacttaaaagaaagacttttgtcacaactacactcttttgttaactgcaaccataagttggtcatagataggagagtctgacaaacaacaaaagcgttctatgagaatcaactggtttcatggaatttacgataaacagtattgtataggttattatctgtcaattacaggctgtatatactttatgtcaataaaatttataataaacatgtatgtacatataagcatcatttttcccagagagccagttagtaaacctttatcagtacactactgcctgtaggaacctcaaggtcaacatatacacaactgagtttctttcccatgaaacctgctcttctcttttagtatttttgttttgattgatgattccactattctccaagtcagaacactagcaatcttcctagcctcctcctccattttctacattcaatgaccttattctctcacaaggtcacccctctgatctctgtagatcagcccctcagcagtccttgccacaacaggtctcgtccttccactcaaccctccacatgcctgttacatgtgatctgctcactgtctgcctctcacagtcatatgcttcccccctcttttctttatatacacctctctactctcctacctctcctggctgtttctctcacactgtgccacaacccttcccccaccaccacaagccctgtgctcaagttatatagaagtgttaggagtttctcaaacaccccgggctattttatatctatttatatcacagcacatacaacattttattatacgattacacctatttccttctactaaatgtcaagcccctcctaacactctatttatctctgtattctaccacacatactacattatttgcttacagaagtacttagtgttgagtttgggtcctttggtgaaatgcaagaatggaaaatatgccataaccacagaaatgcagtttctgttactaattaccaattaaggcagaatacctttcatagataactagcatttggaataaaagtataaacagaaatgaataaatgtgctaactaaattattgcaagtatgtaccaaatttggttttttagccatcttactaggtactcttactagatccacaaaattactgtgtcccaggaaggtgtttctgcctaatatctatttttatacagatagctgatcattctcataacacaaatcaagcacgctaaatttaaagcaagactgttatgatggcaaataaattagtggtgaaatgtctgaatataaactatattcattacatttggttctgagtcattcattcaatagttgttgagtgccttagtctgcaccaagctaggttttaggtattgggaatacaccagtgaaaaaacctgaagccccaatgctcatgaaacctacattcaagtggagaaagacaaacaattttacaactaaatacaatacagatgccagctggtgataagtgttaccaaaaaaaaattaaagccaactaagggaagacacaaacaagataggggtgggctgctatttactatggggctgtctgctagagtgacatctaatcagagacctgaaggaagtgagtcctgaggacattagtgagagaggacgtaggaaatgcaaaggccctgaggtaggggcacttttagtgtatgaaagtacagtaaggcagccagtgtaggggaagtagatgtagataaggtcaaataccacaacaaagacttggagtttcactctgagcaagaaaggaggtcaatggaggggtatgaatagagaattgacataatttgactaattttaaaaggatcactctggctgctgtatggaaaataaaatgtagggggtcaaaggtagaagcagtaagttcagagaaggggacttctgcaataatccaggtgagacataatggcagcctagatcagatggcagtggtaaaggtggtgagaagtcagattctgggtatggtctaagcagcatctggaaggtatgctgatggattggatgtggcaggtgaaaggaaaaatcagggtaacaccaagggttttggtctgagcaactggtggaggagtcattattttctaacagggaaatactacaggaagtacagcttttggaggtggttctaatagtagtgatgattctgaggtctttcatttgctgtgtaataggctctattatcattgcaaccatgaactaaagaaacctgtcttgaaaaggaatgaaagctactatgagtaagcactactagtgacaagaaaattcacaactaggccgggcttggtggctcacgcttgtaatcccagcactttgggaggccgaggcaagcagatcacctgaggtcaggagttcgagaccagcctggccaacatggtgaaaccctgtccttactaaaaatacaaaaattagccgggcatggtggcaagtgcctgtaatcccagctacttgggaggctgaggcaggagaatcgcttgaacccaggaattggaggttgcagtgagccaagatcgtgccactgcactttagcttgagcgacagcaaaactccatctcaaaaaaaaaaaaaattcacaactgcaatttgcttgtatagctactcagtcacaaatgtgccagtgcaattcaatcctgaaagggccttctctgcttatcacctgagtcttcacatacatagaagtcaacttctatgcgtttcttcccctagtccctcactacacaatcttcagaggttgatctcattgagaacagactaaggctttgggcccctaactaataactgagagctatctaatgtcagcatgaaatggattaccaaagctcagttccagaagggtagtcaggaaaaagagcatggcatattacacatactgcagattacacaactaaaaaatactacaaaactgaaaaaaattaaatttatctctgtgaagttagtgaaaagtatatttagacatgcacatgtgtctaaggagagaactgctctagaacagaaccttttaagaattgctattctaaatcaaagcaaaaaacaaacaaaccacactgggtatctaaatactacacatgttaaccagtgaatatactctcttccaattatcatttggcttaaaatgttggttaaatttactttttggcccaaactatatggaagaaaagcaaatgaaacagccatttctcccaggaagagcccacatatctgaatgaacatttctattcaaagtaaggtttttcagaacttttttttttttttaaattaggcagggactcattcccatcatgcaggctagaatgcagtggtgcaatcatggctcactgcagcctcaattttccaagctcaagcaatccttccacctcagcctccccggtagctgggacgacgggcacacaccaccacgcctggctaggtttttcagaactcttatttcaataaaccaggcaaggcaacaactcagaaaacctaccgttgacttaatgtgggatgctgtagcaaatgtctcatccaggtgcttcttatcacgtttcgaagttcatggttattgcgagctgacaacacgccaactaccacatcatagtgagtagatttccactgaggaaataaggccaactgatctagaaataagaacaatacatgagaaataagtcatgtatcaattactatgaagttcaatatgtatcataagtttattacaaaataagcttatgtttgtaggaaattcagataaacacaaagaaaagaatttttaaatcacatatgaacccactatccagagacaaccactaataacattttggtttagagtatttttgtctttcacgtatatatgtatgtattcatgctcacgtaagtatactaattcttcaaaacaaacaagatgtggtaagaatctgtttcaaaaggcaacgtagcataaaaaaatagtaggcattaagagtcaattaggccacagttagaatccaggctctatcatatattaactataagttatttagcttcttgagcctcagtttcctcaactacaaaatgggtataataatacttctcataaagctgttgtaaaaattaaatgagataacatgtataaagctcttggtttggtattaggcatatatgaggcattcaatggcaactaaaaaaaatgtgctttgaaaagtgaggtcctacattaatgttagttattaagtttggcggatgacgctgaaggacttccataccggaaagtaatgcaacccttatttatatcaatgaattctatagccagtaaacctttcactacctacaaaatattctgaagaatgacgggaaagcaacacttttagtaaaaaaaaaaaataataataataaagtaagtcattctgaacggctcattttttactgtcagaaggtctaatgggcagggttacatttccatgtaaaacttgtccttagaagacagaagagaaagatatactttgtccttgtttttcatcaccagttttaaggcttgagagctacaagcttatatatagctctgatgaggtatccatttcatctctttctccagtggtgggaactgatccaaaacgtttccaaaaataaattattgaagcccagactctttactatattaaatgcaatgtttttatataccatgggatctaggtattcagtctaaaagacaacaaaaccaggttgatattttcttcaaaggcccaattaaaataataaaaacagatctttctactaggatagttttaaggatataatacagaaatttttgtgtagataccttattttccacaatagatatatttcttaaaatgtttcattctgggccaggcacggtggctcatgcctgtaatcccagcactttggaaggccgaggtgggcggatcacctgaggtcgggagttcaagaccagcctgaccaacatggagaaaccctgtctctactaaaaatacaaaattagccgggtgtggtggtgcttgcctgttatcccagctacttgggaggctgaggcaggagaatctcttgaacccgggaggtggaggttggggtgagccgagaccgcgccattgcactccagcctgggcaacaagagtgagactccacctgaaaaaaaaaaaaaagttccattccaaatggaatagaggtatttattatttcactctacaatgagtcatgtactaaaacgaattcttttataaagacaatttatttttaaataaattcaaattttcatggattaagcttattaataggccatatttattgaacagttaatctgtgaaaagcactacatatagagtatcatttaatgttcacaaccctatgaggtaggtacttgtttctttttttttttttttttgacggagtcccactctgtggcccagtctggagtgcagtggcggcgctctcggctcactgcaacctctgccgcccgggttcaagtgattctcctgcctcagcctcctgagtagctgggattataggcgcctgtcactgtgcctggctaatttttgtagttttagtagagatggagtttcaccatcttggccaggctggtgttgaactcttgaccttgtgatccaccgcctcggcctcccaaagtgctgggattacaggcgtgatccaccgtgcctggcccagtacttgttgaacaaatgaaacacccaaagaattcagtaacttaagtcaaacagcttggaaatggctgggctaagatttaatcccaggcaatctaacaccattctttatcactgttctattctaaagctatacagcttaatatagcttatctgagtctaaattctgatcttttaatccacaataccagttcaactgaattagcaataagcggatcattgaatacgctgggtaacacatcaattttttttaactcatagctcagaacattttttctcagatacataactatatgatggaagttgtacctagtgctggaactcactctaaatgagtgtctgaattcagagactaatttaaatgactatgtaaaactgacaatatgcctccccacctttttcacagagaaatatgtacattctagtgtcaggaaggaggcaaaacaaaggtagtgaccagccagttctgacattgattccacagccaagattttgcattacgttagtaagaaattatttaaatccctgtgcttcaacttcttaattagagaaaactgatacaaaaaaaattttggatattctatttcatttgtttcaaagtctcatctcaaaagattaaaagctgtagggcaaaaatcacatttaatctaaatgcctcatttatctgacatcatcagaaaataaggatgctgcacaaaagcaaactttcaaaatatttgaaacatcacttttaattccaataatttactaccttatttttgatggctaatcaaagcaaatcttttagaaatagattacatagaacataatttaatcttttcttgatgtctcaaaatcttcatgaaaatttctcaaatctatccctttcttgtcattaattctagctgctgctcagttcggtctgttttttcacctggaccagtacgagggcatcctaactggtttttacctgacttctccatataattgtcaaacaagatttttctaaaaataataaagaaatacaaagataaccatgtgacatgtgaaaatcccatggattatggatggaaacctctttttgatcttattccacctctctgccactctcaatcccccctgcttctaatccatgtctaagctgcttctgttcaactgctttactttacatgcatttctctttttcttgcagagggaaagtaacacggcatatcgtggtcttttagagaactacttcaagatatattgaagtcaaatgtcagaaaaataggttttttaaccacataccattaatgtaaattagtccaatagactcctgagtactgtgttacacagtacaaaacccaaagcagatgcataataaaatacctatgtaagaatgttgctcaaatttctagctccctttaccaatctagctctaaactcttatcaccttttatgttacaagaacagggtacctagttgactccagtgtctagaaacagagggaaaaaaagaaagtggtaagaagtaaacatgatacagaaggacataaagataattcagaaaagaaaaaaggcaaatagcaagcctatgaaaacatgttcaacttcaataagaatcaagtttgaattagagcaatgagacaccagttttctcctacattcaaactgacaaatgtcttcttaaatgattgtaactaaatgatggtacttcaaggaaatgttgttagtgatttcaacaaagtggctactctccgccgggcacggtggctcatgcctataatcccagcttcaattttgggaggccgaggagggcagatcacaaggtcagaagttcgagaccagcctggccaatatggtgaaacctcatctctattaaaaatacaacaaaaattagctaggtgtggtggtgcatgcctgtaatcccagctactcgggaggctgagtcaggagacttgcttgaacctgggaggcagaggttgcagtcagccaagatcccgccactgctctccagtctgggtgacagagctagactccttctcaaaaaaaaaaaaaaaaaaaaaaggctactctttttcattgcgggaaggaatgtaatttggtacagtcttctgcagggcaatttggcaatgtgtcaaataatttagaatggtgtaactttgtccagcaattctaagaactcattctaaagaaataatcagtgatacactcagaagatctttattaatcatagtgtcacctattaatagcgaaaaactgcaagctacataaacacataaaggactcattaaataaattatggtgtagctatatgacagaatactatgcagccattaaaattacatgttaatcatatcattaaacattattctattaatacatcatattaagataaacaggcgataggaactatgtagatactagacggttctgtttatataaagtacaaaagtagccaaatttctgccactggttactatccctggtagtgacaaaacagagcatgaagggaacttctgaagcactgatagttttctttttttaaatctgggtggtgattagttgggtgtgttcaatttgtgaaaatacatcaaactgcgccagttttattctcttgatttattcactcaaatgacagagcatctcctatgctcattgttctagatggcacagatacagcagtaaacaaaatcttcataatgtcaggactaaatcacaatcccaagcaagctccctgagggcaacgtaagggccaagggaaagttttccctctgaaggttcggtgaaaatcactgacaagagatggacaggagaaaaggcatataaatttatttgatcagtaaagatacaggagaaagtgcccatttctgtgcttaggtttaacaaagtatagatagctatgtggaattaagattggacagaaagggtaggatctaatgttaacagatggagttggaaaacccagcaaggcctgtctagattcttcttgtcctctctgagtatacattctttcctactgggtatgggataggaccctctctggtatgaggttcttatgacctgtaataaaagaaggtaagttaggtaatttttatatagaaaggtggtggtgggggctagttagagtaatatgtttaggttttatggctggctttggggaagagggattttagtttctacagctagcctcaggtgagaatgcaaggccagagagaggacagcagcagcaggtcagagacagctgcttctgaggccttattttggggtattgttttcttctgagaccctacagtaagaactatttcttttcttaatatgtaatatatcctgagagtctggcaacctgctcaaccctgcactgtgagtggacatccaaaggtatattaaagtctaagggagggcctggcgcagtggctcatgcctgtaatcctagcactttgggaggccgaggtgaatgaatcgcttgaggtcaggagttcgagaccagcctggccaacatggcaaaacgcagtctctactaataatacaaaaattagctgggcgtggtggcacacacatgtaacagaggctgaggcaggagaatggcttcaacccggaggcagaggttgcagttagtcaagatggtgccactgcactccagcctgggcgacagagtgaaactgtgcctcaaaataataatcaaaaaagtctaaagaaggttgacatcaaaattgattgctcaaaataagcccaagagtcttaaaaatcagaccaaaattccactctgatatgcatgctcttggaagagtcacaaatagatacaaatcttgaaaatgaagaaaacatgtgagcctgtcacagatctaatgataaagacaatcatcatacacactaccaaagacacctcccaaaacaccacactagcacaggcatcagcggccaccagactaccactcctctctcaaactcatggagtgtttactatgaaacaggcactgttgcgggtgtttcattaattgaatcttcacaataagtctatgagatcatcatcttataaataaggaaactgaagcacagagacacaattagcatatagggataattttggaagaactcaccccaggcaaaattacaaagcaagctcaatttgttttctgaccttctacttgctctacatctgtttccattagatactgtgagcaccttgggagaagggactaggcatccagcacagaatctaacactcaagtacttgttgagtgaatatgctcctttgttttggtttctttctttccagataccctagaaagcgaagccttcttttgtcacatcatttttctaaattaaccgttaaataattcctacttaaggcattacccaaaacgagcattttgtaatcaagatatcctatgtttagattccttagtccgatggttatctccacctgcattttcctctgtcaccctcaggtgtactggatttcacttcctctttaccagttgctttccctgactggtttaagggaacctatcacattaaaaaagttgctgattctggtactaaggtgactcacttacttcattctggtccctgctcaactgttacctcttcagaatggaatggacttccctgacctatttaaaaccatctctttaatctcttaacactgctttatcttttttccctatacttatcactaccgctgtgatatttataattatttcctgatgctctgtcttcccttctaaattgtaaactacatgagggcaggaagtttagcttgattactgctgtaattccacacctacgataggagctggcacagagtaggctctcaaatatttgctgaatcaactgcgagccaaagaaccttttttaatattcagggaaggtaaatcgctctttcaaaaaaaacaaagaaactgccattacttaatgagactgaagacagacaaagcagcagaagaggaaaaaaaatacatttaaaaatgttaattcaagaaaagaatacttagcaaaatcttgggtttttttttctcctgttaggcttaaagtacaagggttaaaatgtaaaaacacccaactattttagtttcaacatggtgacagcacaatggtaaaggaattatgggaaattttagcatttaagatgcttccactgcttttagctttgaaagtaccaaaaggaaaaaaggaaaggtaggagtcagtcttgtttaattaattaattaattattttgagatggactttcgctcttgtcacccaggctggagtgcagtggcgcaatctcgtctcactgcaacctccgcctccgaggttcaagtgattctcctgcctcagcctccttagtagctgggattacaggcatgcaccactatgcccggctaatttttgtatttttagtagagacggggtttcgccatgttggccaggctggtcttgaactcctgacctcaggtgatccacccaccacggcctcccaaagtgttgggattacaggcgtgaggcaccgcgccgggccagtcatgtttaacttagattattaaaatatcgatggttgacagctgcagcaaaccaccatggcacacgtttacctatgtaacaaacttgcacgtcctgcacacgtatcccggaacttaaaaaaaaatcccatttattatctgaccagatatacagtactcattcaaagccaaagttaattaacataactagtattgatcttcttacctacgttattaccctgttcctttctatggtctacttcttcatttccttaatctagcctggtctaactactggatggcagataaaggcatcatccttcaagtgcagtaagggagtaggaaaaacttgtctcaaactagaaaactgcctagcaagtctactaagatttcagtttgaagtctactaacatttcagtttttgtttgttttactgaaccctaaacaaccattaaggccataaacagacttaatgacgctctacaaggagattccagcagggctcactcataacaaaagagagaaacctgtaacacacaagcagctgttacaaagcattttttataaatggcgttctcttcttagttcacttcacaaaaacctaaaaaacactgagcaaaaccctgaccccatcaactggttaagtgcatagcaacactgtactttcattaaatcacttaaatagtgtttaattctattcaggtcacacaaatccttttcaaagagctagtgatctaataggaaaagagattgttaccaaaataacctcaacataatttcatataactgagactgttttgaggattgccgaatactttctacttataaggcatagagtgctgaactgcaaacactcaattctaattttaagaacttttggattagaaaacagctgttttggggagagatggtaagggaaaaaagtgccagtatagttacaaaattaagtattacataatatttaaaagagctttctaggtttctttcatgttctagggcaagcccttaaagaagaagacaagagatacagggaaagctaaagtagtgttcagggtggtggaacccactaacaaaacaatccgctgggcaccgtaagtaaagcattctattaggctgtgacgcgaaacaagaacaaaggtttcattcctacgagagattaagttttagagcaaatggacacgatcgttaaagaatttgatatttccatgtaaactgcattagcaggttatgcgatccaaactcacaggaacaactccaactctcggccatgccctatttcatgtctagatttgtttaaccgacttacatcataatccaagaatacgaactacagtatattcttacagcaaagttattccttaaaagcaaaaccgagccacctttgaaaacacgcacacacattatccacggcactaaaaccccagtcttgaccgagaaagaccaacaacttgggggggaagaaaacaacttcagagccagagctcccaaagcagaaagcgctggcggctgaagggcacacgaggttccgctcccgggcgaacgggcggcgtcggacatcactaaccaggcctggggacgggcgaaggacttgcagctgcgggcgccggctctgcgggcgttaaggcaaacggggaagtgagaagcggcggggacacgaaaagagaaaagctccctcaagtttgcccgatgttaacgctccaaggatgaaaagagccgtttgtttcgtctggggaccgtcgcgtttggcccttcccccgcctccaacaattcccggcgaagccccgcggcaccaagccgggcctcccacccccccggcggccgccaacccgcccggccccaggacctcacctgcagggccggccccggaggcgcaggcgggcggcggggagcgcagccgcagccagaggtgcagcgcggccccgagcacacacgggcacagcagcaccagccagtttcgcattggccgcccccgccgcgagccgggctctcccgcgtcccggcggagagggaggggacctgcaagtgcggagactgaggggcggcggctgacgagcgaccactccgagcacgcccgccctcgcgctcggcgacgtctggagggctcctcgcagctcccggccccgctcctccggtccctcagaccgcgggtggccgcggcttagccggccgaagccccgccccctccgcctggccttcccaccggctccgcccaccttttctcccactcgccccgccctctcctcccgcgtttccacacgcgccagccagccggccgggagctgaagtcccgctctgggcccaggcagggggcgcccgcggtttagaaaccacatttcccatgagcctaagcacgcgcttccgtcactcggcggccgcgggggcgaagcgcgaggccccacacagagcatgcgcatcccccttgacgtttgctgccaccccacggcccaggggaggtagtgccggagacccggtgctcggaggctgcccggagccgcgaagggaaatgcgctttgcctcagatttgaaggaaatccgagtggctcttgtgtgaaatcacgcagagctcctctgttccgcgtgctctcttgctcgactgctgtgggaggtgggatcctgctgacgtctccttggcccgtagagtggggcgaggaagcccgagtgtccgcgcctggagcggtgactcatcagggattagctctggtgccgtgggttcccggctctttgcccggttctgtgctctgggaacgcagggtgacagacagcgagctggggactaggctgtggaacacgatgatgacgagccaatcagggtagaactgcacgtgctccgggttcatactggagctgggagcgaaacgggagccgggcgagctgggagaacgtgggctccggggacctggggaagggtggccgcagcgcgccttccagggagaacgccggccccgcgtcttgaggctttgccccgggtgggagccctcctggcccaccaggcccgcgccgaggcagccggaaagcggggacggggcggtgaaggcactggggtgaggatgggagagaaggatgagaacgagcggctgggctatggggcggtttttgtttctgcttttgtttttgagacggagtctcactctgtcacccaagctgtagtgcaatggcgcgatctcggctcgctgcaacctccgcctcctgggttcaagcgattctcctgcctcagcctcctgagtggctgggattacaggcgcccgccactgcgcccagctaatttttgtattttttttgtagagacgaggtttcgccatgttggccaggctggtctccagctcctgacctcaggtgatccgcccgcctcggcctcccaaaatgcttggattacaggcgtgagccaccgcgctcggccgcggttttttttttttttttttttttaagtttccacaagtgtggaaacagaaggtgactgtattattgaaaaaaagtcttggatgacagaagacccaactcaaacaggcttaagggaaaaaagtactttggctcgccgtggctcatgcgtgtaatcccagcactttgggaggccgaggtgggcggatcacttgagggcaggagttcgagactagcctgggtaacatggtgaaaccctgtctctactaaaaatacaaaaattagtctggcgtagtggtgggcacctgtagtcccagctactcaggaggctgaggcaggaggatcgcttgaacccaggaggcggaggttgcagtgagccgagatcgcgccattgcactccagcctgggtgacagaacgagactctgtctcaaaaacaaacaaacaaacaaaaaaaaaataaaaagaaaaggcaagaaagtaataattggttgccagaaaaagtatactatttttatcctcaggaaaggtagtaaatggcctctgttgatattgtaaaattttcattttgtgaattagaatgagttatcctaaaaagaggactaatccctcatttcagcagagctagtcattcgacaaatacttattgagtgtctattatgtaccagacacttttgtaggtactttagatacaccagtgaacaaaataaagatccctatcctgtgttgatggggagtagggcgcagactatagacataataaagaaatatactcaaccagcatgttagaaggttattcctgctctggaaaatataacaattagggccgggtaggggaattgtgagtgtgggattgaaatgacacagattgcagtatcaactagcagtatttaaacaactgttcaaagttacaatgagcactaaagggaagaataaacataagtcatccgaatatattaaataatcaaggtgttgtttcacttaacaacctagaggggaagtttttcactggctctctgacaggcttgtaacaaaaatagttttgaataactttgtaacatccttcaaatcacatcagagtgggagctgtctatagtacttgttcataggaccagtgacctttccacttacctgttttctactgtcccctaataatctcatgactaaagtgagtgaagattgcaagacagtaattcctgtaatcccagcactttaggaggctgaggtgggaggatcacttgagtccaggagttcaagaccagcctgggcaacatagcaagacctcgtctctacaaaaaattaacaattagctgggcatggtggtatacgcctatagttccagctactcgggaggctgaggcaggatgatcacttaagccccagagttcaaggttagagtgagctatgatcacaccacaggactcagtctgggtgacagagtgggaccttgtttctaaaaaaaaaaaaaaaaggtaaaagtgacagtatgtgtaatggaaagaataaaaaaactcagtagtgatataaacagtctgtgcactcaaggggctcatagggtaagtaggaacaagttaacagaattagaattagggagagacaaactagggtggttggtaaccatgatggcaattcaatgtgataagtgctctgagaaaggaatgcacaggatgttagagcagcacaaagcagggggtacagctgtctctactcatgggggattggttctggaccttctatggataccaaaattcatggatgctcaagtcccttatataaaatggtataatatttgcatataacatacacacatcctctcatatacgcgaaatcatctctaaattacttataacacctaatatgatgtctacgcatcacttcattcacgtggattcaatggcatgcgcaaattcaagtttgcttttttcctgaatttgaggttggttgaattcatagatgcagtacccagggatatggagggccaactatatttaactctactcaagggtccccagaggaggctatctcttgaaaatacagggccggggcttgaagtcaaagtggccagttaacagggccagaaagtaggaaggacattcaagagcactgtaggcaaaaaaataaaaaataaaataaataaacctgagctagtgatgacacggcaattagggaaatgtaagcaattggtatgaccttagtgcaagttaggaacacggcaatgatgagaaggtgaacagaaggcagaggccaggttgtaatcataaactttgctaaggaatttggactttattgtgaaggctctaaagaagaatttttttttctgattaccaatgtaatacatgattatgaaaaggatcttggaaaacagaagaatataagaaatcatactacatacaattcatacattttttaaaagttttttcattaaaaaaatttgccattcatactgtaagttagaatttatatccaactattttcacctaacctataagccttcccatatttaattagtagtctcagaaaatataacttaatcatttgtccacactataatttcttatctggtcccgtattattggacatacaggttgtttccattattccactataataagtaatactggcacttctgtgcacaaaactttttccacatttcagataatttccttttctgatattatttttaagccgctttattcatactgctattgtttcaatgtgtatgtctgccttcaatatgtttctcttatctcaccctcatattttaaaaaagttctttattaattcaaaggacaaaacttttcatcaatgagattgaatattcttatgttcgttagctgtttctatttcttttgttaattagtcatgtatcttccttttatccatttgtataagccctttatttttcctcagttttcttgccttctaattttataacttttaggacacaaaaacactttaaatttttataaattcaaatgatcaatatttaatttttttccatattttaggatgattctgatcatgagatctggtcaatattcttgtttgttttatttaatgttttaatccatttggaatttatttaggaatatggtgtaatgcaaggatctcaaaattaattaatttttttcatatagctaactattgtcctggcccattatttccctattagtttatgacatcacctcaatttattaaaaatttttaacataatagtatttgtttccaagccacagttttgcattcatctgtcctttcatcagtaccgtaatactctaatgatcctagttgtataatattttgtaatccagagggcaattctccctctcaatactctttatttctcacatatatatatatttttttttttttttttgagacagaatttcgctctgtcatccaggtctgggctcactgcaacctctgcctcccagtttcaggcaattgtcttggctcagcttttcgagtagctgggactacaggagcgcaccaccacagcaggctaatttttgtatttttgtagagacagggttttgccatgttggccaggctggtcttgaactcctgacctcaggtgatccacccgcgttggcatcccaaagtgctgggattactggcgtgagcccggcctatttctaatgaattttataataatttgtatagttattcgactttcccctaaaccttatgtttaataaaaaactaatgcatggttatcataacaaacacaagtaatgtaatacaagtgtaaacaaaatatataatgttagaatccttcagcccaccccaatctttctttccagacttagccactatagcccagatatttcttcttgtatatatattctgaatttttccaaatttctttacttttccagtgatggaaagggaggaatcaccctccttttcaatccccatgtatgcaatctgtccccttaacctgtataactccagaaattctagtcccctctctcaatatttctaagtaccaaggcgtgttctcttttccacgaggtcatcatcagtctcgttgccacctcttgttccagactgctctagtgttctctatcaaccacctcaactcataaccacttctcgaggccacagccccagattcttctgctttgacccgaaacacagacatagtgcctccgtttatcccccagtcacagctaagacatggctggcatgtttaacagacttgtaaaaggattggccgggcgcggtggcttacccctgtaatcctagtgctttgggaggctgaggcgggcggatcccctgaggtctgggttccagaacagcccgaccaacagggagaaaacccatctctactaaaaatccaaaattagccgggagtggtggcatatgcctgtaatcccagctactcgggaggctgaggcaggagaattgcttgaacccaggaggcggaggttgcagtgagccgagatggcaccattgcactccagcctgggcaacaagagtgaaactccgtctcaaaaaaataaataaatacaagaatttagcctgagaagatacagacagaaaacttttaacttgatatgagataaacttgctcctatggtcccccaatagaggtccctactggctatctcttgccttaagccttaccccagccctttaatgacacttccaagcgccttctcatcccttccatatgagggtcacttcttgctggttctcttttctctagtacagggcccaattcgatcagccagtgaaataaaaattgcccttgaacatctcttagtttaaaatatatagtatgtatgtttttgtatatgtaattctgtaaaagtatttttttattcctctaattcttatttacttatttggtagggatgagctctcactatgctgcccaggctggtctcgaactcctgacctcaagcggtccttctacctcagcctcccaaagtgctgggattacaggcataagccactgtgcctggccctctaattctttatcattaaagtttctcgtcaggctttagttgttcactttcttcctcaaggaaaccatcttgcctggtcacttaatcaacaaatttcactttttttttttttttggtgaatagttgggaaaccttaaaatcattcagatattcttttcaggactcctggcactctgcctcgggtgggtacacgctgccctagtaatgcgtgctatttaaatgattgcttctctttcttttttaagccaatggttgaattcttttaaattaaatgcctgtgatatgacgaccagataatctttgcagaagacaacctttacactagcagacagaatcattaacatttcagtctgaaagcatcttgactcgggcttctccaagaagagtaggaaaatagacactgccaaactgtccttcaaaaatgtgctcaaggagggaggctggtgtaacaggaacagagtgagtggtgaggagaataatcggggatgatgtagtccctagcaagaatatgatataaatcatgataaggatttgggcttttactccgaaatgaaaggggagtagttacatggtggggttttgttttttttgtttttttgtttttttgttttttttttgagacagagtcttgctctgtcacctgggctggagtgcagtggcgcgatctcagctcactgcaacctctgcctcctgggttcaagcaattctcctgtctcagcctccagagtagctaggattacaggcgtgcaccaccatggccagccattttgtatttttaatagaaatggggttctaccatgttggccaggctggtcttgaactcctgacctcaagtgatccgccggcccagctcccaaagttctgggattacaagtatgagccaccgcacccagcctacatggtgggttttaagcaaaggagtgacatgatctgacttatgtgttagcaggaacactcacattgctgtgtggtgaatagactgactgggggtggggaaaaatctaccgtgtggagtagcggaggagatgatgagtatcattcaagtcttgagaaaagctgcagtagcaagagccaaccagaagatggaagagggatcctgggtgcttctatatggagttgatctatctgagggtgcagaggccgactctaagatgctgtggtgcatctccccaattcaggatggaaaatgttgactgcaaaggagtctcagttgaatctctctctctgggaactgcccttggctgaaggtggctgcctcacccaagggtacagctccctcctgagagacaacctgcatccagtgactactcaaggaacggtgtaaagatgtgggtaactctgaagagccatcccgtggcctctcttgcaactgcgtcacagtccaacttctccctccgcccaattctgctttcctcactcccttaccggcattcccaagagcagtccccagtaaacctgtatacaacccgtgtttcagagtatgtttccatgggaacctgacctaagacagcgattctgttaaatgacatgaaagatgatgtcatttctctacctaaaaccctgcaaatggctctccagttctgttctctcacagggaaaccagagtcccttacagtggcctgcaggccgttgtcatctgtaggccgttgtcatctgcaggccgttgtcatctgtaggccattgtcatctgcaggccgttgtcatctgcaggcctgaacccctctaacctcatcctctattcccctccttctcattcagtttgctccagaaccatcctggcctcctttccatcccgagaataggacaggtacattctttcctcgggatctttgcactttgtttcttctgctcttcttccagatattttcatagcttattccttcttcttcttcaagtcaactaaaatgttgccttttccatgaggccttccctgtcccttctattaaaaaaccctgctccaccatccccaatctctattactctattctgtatcacttatcactctttttttgttttgttttgttttgagacagtctcactctgttgcccaggctggagtgcagtggtgtgatttcggctcactgcaacctccacttcccgggttcaagcgattctcctgcctcaccctcctgagtagttgggattacaggtgcatactaccatgcccagctaatttttgtatttttagtagaggtggggtttcaccatgttggtcaggctggtctcaaactcctgaccttgtgatccgcctgcctcggcctcccaaagtgctgggattaatggcgtgagccactgcgacctgccatgtgtcacttatcactcttaaacatactgttcaatttacttatttattttgtttgcggtttattgtcttactgtctacacagggcagaaattttccctcccgttttgttccctgatatatcccagaacctggagaagtcactggcattttgtaggtgctccataaatatttattgaacaaacagtgaatgaatgagtgaatcaatgaatttgggaatctttagcaagttgattgcagtagaactcacaaggtgagattacccaggcatagtctgtagagcgatgatgaagggagacaccaacatttaggtgtgagcagaggaagttaaaattataaaggacattgacaagaatccagactataggaggaaaacaggaggatgtgtcacccaagacaagatgtaagatggcagagggagtgcagacgacagcgtacaacctgaccaacatggtgaaacactgtctctaaaaaaaacaaaaacaaaaattagccgggcgtggtggctcatgcctgttgacaacatatgaagcaagatcaaggcagaaatgtgtctgctgatttgagagtggccaggtaactagcagtttcgaggaataggtagagcagaagggagagtactgtgagttgaggagtgaatgagaagtaatgaagtggaaatggtgtgtgcattactattttgagaagtttggtcatgaagatcagaacgagaaagaatgggagctgggaagagggctctgattgaagaagtgtgtgtgtgcatttagatgggagagataagcctgacttgagtattttaagtgatgtatggaaacagccagtaacaaccatataatttgtaatctaaatcaaggttttgagagaaaaagggggcaggacaaatgctaaaatggataaatgtcaagacaacaggaactatctgcaaaccagaccatatggtctccctgtccacgcctcaagttttccatgcaagtcatttatccttacacttagtgggctatttttttctgacggtaggtggcagtaaagagcttgcctctttttgcctcgtttggtttggtttggtttggtttttgagaaaaatttaattagagattttggatggcaactaagattggtaaaggttagctccacaggcttaaactcaaaataggagatttcaacttagattttactttgggaaaattcatacacgtttttgtgaaaaagaatatctcttggttctcaaagaaaaaataatttttgggtaattataaaatatgttgcattttcacactgagccattttatctttaaaatgatgaacttccatcttcttcctaatacagaataatttccattagttttatcacttctttttttttgagacagagtatcgctctgttgcccagcctggagtgcaatggcacaatctcggctcactgcaacctccgcctcctaggttcaagagattctcctgcctcagcctcccgagtgggattacaggtgcctaccaccacgcctggctaatttttgtatttttttttggtagagatggggtttcaccatgttagccaggctggtcttgaactcctgacctcaaatgatctgcccacctcggcctcccaaagtgcttggattacaggtgtgagccactgtgtctggcctatcccttcagttttagcacacgcattgctatatgcacacatttcttatttgtgtatataaattttcagtcaagtctagcttcagtagactttgggggaccttgctattgaagattataaacattttaaaaaactataggccaggcgccatggctcacgcctgtaatcccagcacttcaggaggctgaggcgggcgaatcacttgaggtcaggagttcgagaccagcctggccaacatggtgaaatgccatctctaaaaaaaataacaaaaattagcctggcgtggtggcgtgcacctgtaatcccagctactcaggaggctgaggcaggagaatcacttgaacctcaggaggcagaggttgcagtgaatcgagatcacatcactacactccagcctgctgggcaacagagtgggactctgtctcaaaaaaagaaacaaaacaaacaaaccaaaaacctatgacacataacagcaaatttcttgttatcaaagataggactagagatgtctaaagataagaagttttaggagttcggaatggtaaagtgaatgagcacaccttattcagggaatcttggcagaatctaatgtcataaaatttaaaattcagaaatctttgtcagagaaaaaacagaatcaaaatattatctgcagatccagcaaacaaatttgagttcaaaactcagatttgcatttattagctgtgtggccttgagcatggcaagcactttacctctaggtctcagattcctaatctgtgaaatgagactcacaggatatacttcagtggattgttttgaatattaaatgagaaaacatattggtaaaatttatacatgttattttcattcttttccctaaacatgaatatgaagacatccagattaaaatgtggcatatgcaacctcaacctttggaaaatatatctcaaatgattaaggaaaaatattaattttaagaattgctttaaaacaacaaaaccaaaaaagccttggtcataccttaattcagtaattcttcaactttacgtctcagatccaatattctaggcactgcttgacacagagagcagttttcttacaaggaaatttggggaccagagggggttctttgcatgtttggataagtgctagaattcaaattccttctcctgagagtcctctgcctttttcgtttaatgaactcggttgctttctttatttcctctttctatcctcattagcgtaaagcaaactctaaaagcaatccacaatatcaatcacatcaaatatcatggaatgtggcctcagtcctggaagatgtctactccatataggtgacttggtacattacagtagattatagtagctgaaaagtatcctttggccagccattgtcaaaactagagtcactaatgagatcacaaatgagaagcattcattgtctctataagacttcctaaaatgcccttattattaagggaagtcctggctttctgccagtatcacagactaatttgttcattagctggttgacttcttggttcttgcatatttcaatggctaaagtttgtagtaagtttgagaaatataaagagaggagtatggggaggagagctggcgggaggtgggtgctggaaatgattaagaccactggaagggaaaaaaatggggtatgatatcaccatggaaacgaagtttacgtattgcaaaaatttgcccaagttggatagcattcattcattcattcattcattcattcattcaacaaacatttactcggtgtctttgcatgcctagaaccatcaaagttacaaatgagaacaaaacaagcttggttcttgtcttcacggagcttccattctagtgggggaaggtacacaaagaacaaacacaagtaggtttccccctggaaagaataactggcaggtttgcaggcattaccacctaatttctttttaaaaagaaacctaaagacttctttgggtgtccaaaggtctaaaattttagaagttcaaaatggcaaagtgaaagagcacacattattcaggcaatcttggcagtatctaatgtcataacatttaaaaatcagaaatctctgtaagaggaaaaatagaatcaaattactctctgtaggtccagcagacaaatttgagttcaaaacccagatttgcatttttataattatttactttagtaaattacttacaatttactaaaattataaataattatagtaaaacaaaaaaattaacaatgagccagcctcccagtgtcgctcaggagacctcacggctaaataagtaatcactgctatcccttcctctccagcagtctccatcaacttgttctgcattcagagactgttcttgggccttcccatacgcagctcacatttgaaactcctgcccctggtgccttaatgcatctgactggcagccacacagcccctccatgtggctcagtttcagtgggtaggtagggaaatgccgatttgtttgcattgttccccacaggctgattacagtaaaggctgtcacacagagctcttgcatacctaacaggagacttggtgacagtgaaaccaagaatgaccaatgactgtgtgtaaaatgaatcaaggtgaggtgtattgaaagcaaagaggtcaattcaaaggcttagaaataatccagacagtaatcaaggaagaaagcagccatgtcactgggaagaaaaacctcttgggacactcagtatattcaacacgatgaagtaattcgccctgtgacatggacaaaaggagctttccatgctctaatgggcagtaggattccataaagtgaatcacgtttaaaagagacactcttaaaaaatgaaatacgtggccataatcccagcaccttgggaggccgaggaaagtggatcacgaggtcaggagttcgagaccagcctggccaacatagtgaatccctgtctgtactaaaaatacaaaaaattagctgggcatggtggtgggcgcctgtaatcccagctactcaggaggctgaggcaggagaatcacttgaatcagggaggcagaggttgcagtgagccgagatcgcgccattacactctagcccaggcaacagtgggagactccgtctcaatgaaaaataaataaataaatgaataaataaatattgttctaatgagcaaatttaaaaaatcctaagtaaaatttggtctctttctcattagtgcttaatggtcttcaatcaccccagtcctactttgagtatatactaaatccctttcaaggacagattctagacttttcccactttggctcatctgaaaggtttctaaaaggattggtccttaatatttcttttcacaacttaatagcgtgatttgagtttatgcacacagaaagagatttgttcgtaccctcctctcctctgatttttaaaccttgttccccttgttcattctgtatgttgagatgtgatcttgcttttaggagatcaaagaaaaagaaaaacaagtttctctcacatgtttgtcttctctttaacaatccacattgtttttatatcggcccaagatacaccattaaaagttctgcaaagcttttaaactttgcagagtagttttagactgtgtgcagagaagtcttgtgccaaattgcagagcctgttttttttttttttttttttgagacggagtctcgctcccttgcccaggctggagtgcagtggcacgatctcggctcactgcaagctccgcctcctgggttcacgccattctcctgcctcaacctcccaagtagctgggactacaggcgcccaccaccacgcccggctaattttttgtatttttagtagagacggggtttcactgtggtagccaggatggtctcgatctcctgacctcgtgatccgcccgcctcggcctcccaaagtgctgggattacaggcgtgagccactgcgcccggcccagagcctgttgtataagaaattaatttcaaatgctagcagagaggatggcattatgttttcaaaatgatgctacattaattcagcaagaaaagtttagagccattctgagtcagaggacaggatattttaatcttaaaagataaaagggcaattccaaatagctgattatgcatagggttcatcattcatattgatgtaagtattatggggcatttcctctgtgatgacagggctagattctactcacacacactaataaacagtttttcctcctggtttatacacaacgaggtgaatgtctctttcccctgatgaactagtgtttggaaacaaaaactataattatcttcagtggagatggcaattggataccccagagaatttgtctgatctttataaggtattcagcagtgaaaatggggttttgcaaaaagccagaagacttgctttggaatcctaactgtgtcacttactaaaattttgactttagataagctatctaatttccctgagccttagcttccttgtctgcagaatgtgaaaaataatgaccaccccataggatgaaaaaaaaaaattaaatctaacgccatatgtgaaagtactcagcattagtcagtccttagaaaatgttagtctcagcctggcacggtggctcatgcctgtaatcccagcaatttgggaggccgaggcagacagatcacgagtcaggagtttgagaccaacctggccaacatggtgaaaccccatctctactaaaaatacaaaaaaattagccaggcatggtggcatgcgcctgtaatcccagctactcgggaggctgaggcaggagaatcgcttgaacctgggaggcggaggttgcagtgaaccgagatcgcgccattgcactctagcctgggtgacagagcaagactccatctcgagacaatgttagtctcccctttcctctgtgagcaggaggaatgaagaacataaagacggttattagctactgctgtgtcacaaaccacatgaaaactcaggaccaactctcagcactgattttttttttttttttgagacagtctcactgtgctgcccaggttggagcgtggagttcagtggtatgattagagctcactgcacacttgaacttctggatttaagtgatcctccccattcagcctcctgattagctaagactacgggcacgccaccatgccaggctagtgtttttgtttgtttgttttagagatgaggtttcctatgttgcccaggctggtctggaactcctggcctcaaacaatcctcccacttcggcctctcaaagcactgggattataggtgtggtgcacctccagcaggaggtatctggacccattcactatcatgaaaacggcatgggaaagacctgcccccatgattcaatcatctcccactgggcccctcccacaccacgtgggaattatgggagctacaaggtgagatttgggtggggacatagagccaaaccatatcattgacctgctggcaccatcaaatatttctgcatgatgaaatttcagctcagttttaagtgtctatgcctacaatcatcatgggactctttctaactatacactgtacatcacatacaacacctgcatccttctctgccacacagatctgctgagatttgcattatggctgaattagccgaaatttacatgccaaaggggcatcgatatttttcatctgctgctttctacgtgtaggacaaggcttatattactggtcctacactttcctagaaaccagaaacatcggtattatgttactatttatagtaatagcaactacatttataggttgtgtcctaccatgaggacaagtatctttttgaggggcaacagtaattacaaatctattgtcagctgttccatacattggcaccagcctggtacaataaacttaggaggcttttcagttgacaaagccacctcacaccattcttcaccttccacttcatcttacctttcattatcatggacctagtagccatctaccctctatttcttccagagacaggatccaacaacctgtcaggagtttcatcagattctggcaaaattccattccatccctactacacaatcaaagacattttgggtctaattctccttctactattactacttatattagttctatttcacctgacctactaggagacccagataatgacactgtggcaaaccccctcaacacaccacctgacattaaaccagaatgagactttttatttgcctatgcaattctatgctctattcccaataaactaggaggggtactagccctagtcttctctattgttatcctagctattgttccaatatctaaacagcaaagcataatattctggccgtcaagccaatacttattctcagcatcatgcactctacccatgtaacagacctgcatatgtacccctgaatctaaaaagttgaaattataaaaagtaaaaacatatacatacatatatgtatacatgtacctacacctatgcaaaaaatatgtagtgttggctgggcatggtggtttgcatggtggtttgcacctgtaatcccagcactctgggacgccaaggcaggtggatcacttgaggtgaggacttcaagactggcctggccaacatggcgaaaccctgtctctactaaaaatacaaaaattggcgggtcatggtggtgggagcttgtagtcccagctacttgggaggctgaggcaggataatcacttaacccgggaggtggaggttgcagtgagccaagatcatgccactgcactccagcctgggcaacagagtgagactctgtctcaaaaaaaaaaaaaaaaaaaaaaaaaaaaaaatatatatatatatatatatatatatatatatatagagagagagagagagagagagagagagagagagtattattattttgtttttttaaattcacctgaatagcatactttatatatattgttctacatacttggtcttcttgctcaacattgtatttttgatacttgtcctatttggtatatgtagacctaatgggttccttttaactaccgtctaatgtgagattgcaccattggatgaatgggccacagtcgatttttgcatttttctactgatgaacatgtatataatattttttatcctctaggctcaatttaagtgctttgcaaattctcattcatgtatctttataacaggtagtagttttgccttccttattttacagatgaggaaactgagacacagagaagctaagttacccactcaaggtcacaaggctagtaagctagtaagtgacctagacaggtcacacacctgtcacatcagaatctgtgtcctaaacctgggcttgttgcctctttgaggtatttccattgctcactgtaacagtcctgtttacttattctcatgtccactgccatgtgtacacgaaagtttctttccagttatacctagaaacaggattgctgggttcacataatatctttcatcatggtgagttttttttttttgttttgctttgtttttttgagcactgttacccaggctggagtgcagtggcacgatctcggctcactgcaacctccacctccctggttcaagcgattctcctgcctcagcctcccgagtagctgggactacagctgtgcaccaccacgcccagctaattttttgtatttttagtagagacggggtttcaccatgttggccaggctgacctcgaactcctgacttcgggcgatctgtccgcctcggcctcccaaagtgctgggattacaggcgtgagccaccgcgcccggcctgcatacttatttgtatgcccaccgccatgtgcaaatgaaggtttctttccagttatacctagaagcaggattgctgggttcacatactatctttcatcatggtgagtttttgcagtgtgaactagagtggggaataaagtgtcataggaacaattctgcggctttgaaggacttcagagccgttaaatagttacttcaatgttttatccagctcttaactttaggctcttttctgtcgtggtaatcatctgagatgaggttaatagaatatgaaactactttgagagaagacagaagacagaatggccatgtcacataagtaactcttctgaatggttcatctcaatgtactacatttatttattttttgtttcgcttttttttttttttttctgaggtggagtctcgctctgttgcccaggctggagtgcagtggcgccatctcagctcactgcaagctccgcctcccgggttcacgccattctcctgcctcagcctcccgagtagctgggactataggcgcccgccaccacgcccggctaattttttgtatttttagtagagaccgggtttcaccgtgttagccaggatggtctcgatcttctgacctcgtgatccgcccgcctcggcctcccaaagtgctgggattacaggcgtgagccaccacgcccggctgttttgctttttgagacagtctcactctgttgcccaggctggagtgcagtggcgtgatttcagctcactgcaacctctgcttcctgggttcaagtgcttctcctgcctcagcctcctgggtaactgaattacagatgtgggccaccaggcctggggctaatttttgtatttttagtggagacaggggtttcaccatgttagccaggctggtctcgagatcctgaactcaagtgatctgccccctttggcctcccaaagtgctgggattatgggcgtgaaccgtcatgcctggccacaaatgtactttaatacagctgcatgttgctgtgtgatctattctagaattgaacattttctctgtataatttctatatatctaactctctatatataatttctatatatctagcctatatatctagatatataatttctatatatctagcctatatatctaactcagtctgctaaaccactgagcatcatgaaaaatgaaaagcagattctgtatgatggcctaactcaacaattccaaacacatttttgcactattacgagcttttggttttataaacttgcagtatatttgatgtaggtctttatatgtttgtgtaagttggctgtaaatgccaagatacacttaatctcttaccatcatgccattctcattcagatataaactatagcaacctcacttggaaaagaatcaacacacttgttgccgtagtaatcaaggccactcattaaaaaagctatcttacagatgagatatccccaatgcccttacccatcaaatggaaatagaattgaagggcttttggttaatccttcctgaagacctttttgctttgacttagtctaaaatagcaaacacataaactataacacacctctcagaattggtaagatccatactgctctttccccaacattggtccatttctggggattcttcagggacacacaaaagaaagaacctgtttgtgtgtctggtttaaaggaatcctgtctgcatgggcttgcgtttgaaggctggttctcagctcaccagttgaacagttctaatcacatctctgtgagccattgtttcctcattgtaaaatggggatagcacccacctcattgactaactcgttcatatacgttggttcaacatctattgagtacctcaagtccctattctcaagttgttcacagtccagtaggggaaatagatatatttaatgatatggaagaaatcataatttttagcaggttgcaagaggcagttttgttggatgagtgctttgatattccctttccgaagctagggctccatgacttgttaagtaattggtgcattgtgctgaaagaaaccaactgtgctgccctgtgtgaattactaaaaggaatgcatctgttcctgggaggcggggagggagggcagaagggatctggccctgcagtggggtggggtggaggagcaccctcagttggtgggggcagacatgtccaagggaacttataaaactgtgggtgacataaaaccctcttccatcacccctgtaaagtctccagcaaaatctacattggccactagtgctttaggtgtaaataagattctggagaattcaaaggcagccagacatcataatcatacattatgcaaaagtggtttccaaactgcaggtcaggatttttcggtgcatgtgaaagcaatttggtgcaccatgcccagcattcaacaagggaaatagaacagtatagaaaacttcagggcaccttgcaaatagtagaggtaatgatgctttctgaaacttttttatgtaggtcctcagctgtggaataaaatgtttttctttttgtaggtcatggtcaaaaagagagaatctcggtattataatacattgtgctgattacaatagcaattttttttttttttttttgagacagagtctctctcctgtcgcccaggctggagtgcattggcgcgatctcggctcactacaacctctgcctcctgggttcaagcgattctcctgtctcagcatcccgagtagctgggacttcaagcgccggccaccatgcccaattaatttttgtatttttagtagagatggggtttcaccatgttggccaggctggtctcaaactcctgacctcaggtgatccgcccacctgggcctcccaaagtgctgggattacaagcgtaagccaccacgcccaggctacaatagtaatcttgatggctcactctgctctcactggtccctagaatccttataaaaggggtcttggttcaacagttccctgggttgaagactagcttctacctcctgttttctccaattctctgttttaaagtcctttggatcttccttttgcatccttgcagagcctctttgggctcctgtctcggcccagctcgccttgctctgagggttgcctttgatctggtcagaactccactccacttctgccagctcgactcccacgttggaggcaggaaatagcactctcttgttcttgcatgtatcaagtcctttgcctgctctctgctcctacagctctttggcctggctaattcctacttattttcaggtcttagcagaaatggagcatttacaatgaagctaatgaagcttaagcttcagggtctgtgccaaaccctgacacccaattttgtaatctggtattcattttcttagggttggatttcatgaggcctcatgaaacctgaatccacttctgggtctcagtttagaaaacctcacctcctaactccttgcagtgtgggtgctgatctcctatacatgcccttgggtcccctgcacccactcccaggacagccctgaccacactcccccataggcttgccagtcttcaccccgaaactcacataaaggaactatgccagtccttgctggtgagtgccaaggtgccctcatagtagacaataaataaaaatgtggtaaatgtctgaacttcataagttgatttggggaaacaatgctttttatgcttcccaaagtattccataaaactgctgacaggggccgggcatggtggctcatgcccgtaatcccagcattttgggaggccgaggcaggcggatcacttgaggtcagaagttcaagaccagcctggccaacatggcgaaaccccatctctactgaaaatacaaaaattagctgggtgtggtggtgcacgcctgtaatcccaggtactcaggaagctgaggcaggaaaattgcttgaaccccagaggtggaggctgcagtgagccgagatcatgtcactgcactccagcctgggcaacagagcgagaccctgtctcacaacaaaacaaaaaaaacaccaaaccaaaacaaaaaatcctgctgatagcaatgaagaggaatgaggattagccaagaagaaagtttcagaacactgacctcccctgccctggcccgtgtttgtggagtgctgctgttcctgattgtgctccatttctgagaggttaaaggaatttgtgtcaattccaccaagtaaagatagcttaattgtctgccccaccacctaaggatctctctggagcagatatttttattagaaaatcagaaacaggccaggcgcggtggctcatgtctataatcccagcactttgggaggccaaggcaggtggatcacttttggtaaggagttcaagaccagtctggccaacatggtgaaaccccatctccactaaaaatacaaaaattagctgggggtggtggtgcgtgcctgtaatcccagctactcgagaggctgaggcaggagaatcgcttgaactcaggaggtggaggttgcagtgagccaagattgcaccactgcactccagcctgggcgacacagtgagactccatctcaaaaaacaaacaaacaagcaaacaaaaaaccagaaacaaaagatatagcatctcctcaaaccgaagagctgtcaaatttgtcaatttttcttttgcttagagttcatgatattaaatgatttgtcttttcctttccttttcttactgaagccttcagttaaagcagtctgactctaatctagccctgacccagttactcttgctcaggtgcagccctgggagctctggggtctcctttctgttctttttcccctcgtggattattcttcctaaaagcggatgacagtggttgagaacacaggctctgaatcaggctttctgggttcacatcacagtttcctccatttacggattgtgtgactgggaacttgagcaagtgagttgattggctagcgaatcaagtcaacatcaggaatgttgcaagcctgcaaatgttaccatggtagcttgaaagtggctttggttgggagtatttactgattagcttgaaatttactttgattggcagtatttactaattgtgtgactaggaacttgagcaagtgacttgtttggctagggaatcagaccaacatcaggaatgtcgcaagcctgttgatgttacgttggtagcttgaaattggctttgattggaagtattcacaccatggaaattggcaaatgctgcaaatcagtgcctgcccctttccccaacctgggcattactatttaccagaacatcaagctcagtttcctcatctataaaatgggagcaataatagtacctaccttgtggagaattttgtgacagtttcatcgtgcatggtaaatacttcgtgcttgtgagctgctcttagtatttccctcattttacaaggtccagtgcctttttgtttcatgtgccccattctgacacagcttcaaacacaggaccagccagatctagcacatgccttggcaataaacttattttttattttttgataggtagtcttgctctgttgcccaggctggagtgcagtggcacaatctcagctcactgcaacctccgcctcccaggttcaagtgattctcctgcctcagcctcccaagtagctgggattacaggcgcctgccatgaggcccagctaatttttgtatttttagtagagatggggtttcaccatgttggccaggctgttctcaaactcctgacctcaggtgatctgcccgcctcggcctcccaaagtactgggattacaggcatgagccagtaacaaacttaaaaaaaaattacttagctagattatttagtcttcaaacagccagctcataactgataggaaatgtgtggtcttaggttgtttataaggcataccctggtgacacatatgttataaaattagaattcttctaaatctagcgctgattacttatgttatatatatttcatttggctgggtgttagaaagaatttcttctttgagatttctattattttttctcccaattaaggcaaagactgtaaggatagtttattacagcatttggtggttcagtaaacaaacatgctctaaaaaacctaaatagctgtgttgaagtaaaacatgtgtcccaaattcacatgaattatatgcaagttaatactttggtgagcaaataaactcttggtaatatattgctgtcacctgagggctaaaaatataatatatattataaatatctgactcaatctgatcatgaatgaattgatcacttatgtgtatttaaatataatggcaaagcttaagctcagtattctcttaaatgagttcatttactctcaataggtttgggggcctttatttactgaaaaaacagattcacgattattggaatatgtgttttttttttaatttttagttttttgagacaaggtctttgaattaatcacgtgtgtatttaaatataatggcaaagcttaagctcagtattctcttaaatgagttcatttactctcaataggtttgggggcctttatttactgaaaaaatagattcacgattattggaatatgtgtttttttttaatttttagttttttgagacaaggtctttgaattaatcacttatgtgtatttaaatataatggcaaagcttaagctcagtattctcttaaatgagttcatttactctcaataggtttgggggtctttatttactaataaagtagattcatgattattggaatatgtgtttttttttaatttttagttttttgagacagggtcttgctctcgcgcccaggctggagtgtagtggcccaatcatggctcattgcagcctcagactcctgggctcaagtaatcctcccacctcagcctcccaagtagctgggactataagcacatgccatcatgcccggttattttttccttttctgagatggagtctaactcagtcactggggctggagtgcagtggcacaatctcagctcactgcaactttcacctcctgggttcaagtgagtctcctgccttagcctcccaactagctgggattacaggtgggtgccaccatgcctggctgatttttgtgtttttagtagagatggagtttcaccatgttggccaggctggtcttgaactcctgacctcaagtgatccacccacctccgcttcccaaactgctggggttataggtgtgagctagcgcgccgggcctgtggctattaaaaaaattttttgtgtgtgaagatggtgtctccttttgttgcccaggctgttcttgaactcttgggcttaagtgatcctcccattttggcttcccaaagtgctggagttacaggtatgagccactgcacctggtcagaatatgtatatcttaatctaactttatcagcatttaaatgacaggaagtgaaaatgttattaatgcacaattgatcacaaaaccatcacaggttctgcaaccaggatgagtttatatgagaattcttcatccaagatgcttggaagttcatctcttcaaaggattgccctcttcggaaacaagtaatagcctgctttgatgatgtttacaaaataccacatgtcaacatttaagaagacaatggttttcaaaggaactggaaactcctttcctggattgagaaggcagactctatggccactgagactccttctccttcaagatgctctgaggtcaacaagtaccttgtttgcctctgggaattctttcccttgcagtagtaaaccttttccaggcctttttctatcactggaattgcgtctggtctcagcaacaagtttcaggaaaattaatatacataggtcccccttctttctcaggcagagggacatccccagaggatgcaggactaccatcatgagagtggactggtggctttttttttttttttttgagacagagtctcactccgttgcccaggctggagtgcagtggcgtgatcttggctcactgcaacctccgcctcctgggttcaaccgattctcctgcctcagcctcccaagtagctgggattacaggcacacgtcacaacacccggctaatttttgtatttttgtattttagatggggtttcgccatgttggccaagctggtctcaaactcctgacctcaggtaatctgtccacctcagcctcccaaagtgctgggattacaggcatgagccaccgcgcccggccggactagtgactttataagaagagcttctcccactcttccctgctcctgatccttcagcatgccagagttgggcttccggagtctcatgtggtcagtaacgttattactaatccaacttgtgctcaagcaaccttggccccactggaaaggtttgtctccaccactgctgacgagttcaatctaggtgggaggcagtggccgtcaccctggctaagcatctgcaatgtccttctgaccacagcccaccacctctcctgctcataaggctcctgccctggacctcccaggcctgagctctgctgcccattgtgtgttctggtttgcagaattaggcttctgctatggtctctgctatgatttgcatatttgtctccttaagaactcatgttgaaacttgatccccagtgtgggattattgagagacggggccttttcaaggtgattgggtcatgagggctctacccttgagaatagattaatccattaattaattaataattaataaattaatggattaatgggttatgagagtgggactggtggctttataagaagggaagagagacctgagctagcacactcagacactcgccatatgatgccctgagctgtctcaggactctggagagagtccccaccagcaagaaggccctcaccagatgcagcccctcaaccttggacttcccagcttctggaacagtaaggaataaatgtaatttcttataagtaacctagttccagatattctgttataagcaatagaaaatgtactaaaaccactattaataaaacagtctctactgcaaattcttttctggaaagtgctagttctccagactcaatataggaacccagattttgctctagccagcaggcccatcatggggctggggcctggccctgtgagccttcccagtggctttgtcccagctacgtgaatgtgtgttttcatgctctcccatctctatgtctcctgtccccaggatgactgccaacctgccagcattctccagcatcacccaccaaggtgccctcaaactcctctgtcgtcctccccagctgctcactgttttcatgtgaaccttgagtatcaactattttcccacctcctccaaggggagagcatagcaaagtggttaagagcctgtgctctggcactggatagcctggttccagcttcacctgttacgacttatgtgactttggcaagtcacttaatctctcatgcctcactttgccatctttaaaaatgggtttaatcctagtgctcacaggtttgtcatgagcatatataaagtgatatttgcaaagtacgtagaagacggattggcacctggtaagctctgtataaggatttgatcattgtgttagtttgctagggctgccataacaaagtactatagactggatggtttaaacaacagaaatggatttccttacagttctggaggctggaagtctgagatcaaggtgaccacagggttggttgcttttgaagcctctctctccttggcttgcagacagctgtcttttcttcatgtcctcaaatggtcttccctctgtgtgtgtctgtgtcctcatctcctcttcttataatgataccagtcatattggattaaagtccaccctaatgacctcatttttgctttattatccctttaaaggccctattttcaaacacagtagcctctctttttctgtggggatacattccgagacccccagtgaatgcgtgaaaccattgatagtaccaaaccatatatatatatataccatgtttttttctatacatacgtacctatgataagtaagagattaacgacagtagctaataataaaatagaacaattttaacaatatgccagcatcactactcttgtgctttgggtcccttatgaagtaaaataagaattatttggatacaagcaccataatatcacaacagtgataaccaagacagctcctaaatgactaacagcatggggtatctacagggtggctatatggattaagggatgattcacatcctgggtgggaccgagtgggatggcatgagatttaatcatgctactcagaatggaatgcaatttaaaatgtatgaattatttctggaactttccatttaatatttttggactgcagtagaccatgggtaatggaaactatagaatgtgaaactgcagataagggggaactactatatggttatattatgaggtattagggtttaggatttcaacatacgaatttggaaaggaggtacaattcagcccaaaacaataactaaatgaataatttgtgcctggacactgccaagctcctgcagccattgctatagactgaatgtttgtgtctccctgaaactcatctcttgaaaccccaccccctaaaattcaatggggcctttgggagtgattaggattagatgaggtcaggaaggcaggattagtgcccttgtaagagtcctgaggcagtttgctcccctctgctctgggtcacatgagaacacagtgagaagagggccatctgcagcccaggagaggcctcacgagaagctatgctggtgccctcatctcagacttccagcttccagaactgggagaaatacatttctgctgtgtataagctactcagttggccgggtgcggtggttcatgcctgtaatcacagcactttgggaggccaaggcaggaggatcacaaggtcaggagtccgagaccaacttgaccaatgtggtgaaaccccgtctctactaaaaatacaaaaattagctgggcatggtggcttgcacctgtaattccacctactcgggaggctgaggcaggagaatcacttgaacctgggaggcagaggttgcagtgagccaagaccatgccactgcactccatcctgggcgacagagtgagaatctatctcaaaaaaaaaaaaaatctactccgtctatggcatttgttttttatagcagtgtatactggctaagaccatgcccttttgactatctctggctggccccgcgatggctgtctagagtgatttctccccagcgttagcctgggacagcagctggacatccttcaccagctccatcagagtgacagcagccggctctccccctctttcccttctaggtccctgcatgacctggccttgtagaggaggggcccagcctttggtatcttggtccactgcttactcattcaaaattggcagaggtgaaaactggaatataacagagaaatcagctcaccacaaaaagacagcactacttgttagtatagttgaggcttgaacaacaggggcttaaactgcgtgggtccacttatatgtggattttcttccacctctgccgcccggagacagcaaagccaactcctcctcttcctcttcctcctcagcctactcaatgtgaagatgaagatgaggatgaagacttttatgatgatccactttcacttaatgaatagtaaatatactttatcttctttatgaccttccttccttcccttcccttccctttcctttcccttcccttcctttcccttctctctttctttccttccttccttcctccctccttccttccctccctccctccctccctccctccctccctccctccctccctccctctctctctctctctttctttctttctctttcttttctttccttctttcgtcctttcctctgtcacccagactggagtgcagtggcacaacctagctcactgcagcctccaactcctgagctcaagctatcctcccatctcagcctcccaaagtcctaggattacaggcataagccaccatgcctggctctctttcttacagttttcttaataaaatttattttctctggcttattttattgtaagaatacagtatatgatacacatgacataaaaaatgtattaattgactgtttatattcttggtgagacttctggtcaacactaggctatcagtagttaagtttttggagagtcaaaagttgtgtgtggctgggcgcggtggctcacgcctgtaatcccaggactgggaggctgaggcgggtggatcatctgaggtcaggagtttgagaccagcctgaccaacatggcaaaactctgtctctactaaaaatacaaaaattagctgggcgtggtggcgtgtgcctgtcatcccagctactcgggatgctgagacaggagaattgcttgaacccaggaggcggaggttgcagtgagccgagatcgagccactgcactccagcctgggtgacagagcaagactccatcttgaaaagaaaaaaaaagttataagtgaatttttgactgctaggaggagggaaaggggttggtgctcctaatccctgcattgttcaagggtcaattgtggttagaaacaaagtcaagtcccagccaccagagagatatttaatggttaatattgggttaatactgtggccccttcctagaccctgaatgttttcccaaataagtacttcgacctccaaaatgacttttgcccaggctggagtgcagtagcacattcttggctcactgcaacctctgcctcctggttcaagagattctcctgcctcagcctcccgagtagctgggattacaggtgtgcaccaccaggtccagctaatttttgtatttttagtagagacggggtttcgccatgttggccaggctggtcttgaactcctgacctcctcctgcctcaacctcccaaagtgctgggattacaggtgtgcgtcattgtgccccgtccttcgaaaggcttttatcatcacctcttgaaatagcaattttgaagtttgagagctttcattacagacttgacctccccttctggtgctgattatgggaaagtgctatctttccggcatatcatgagttattttcttcataattcagttcctggagtgagggggtcttagcttgtactcctgtataaacagactgtgatgttgatgtgttatgaaactggagcgcgatgggcacccagttactagctggtaagtgttactgtctctccttccctccatgcatcttcggcaaatgaccaactcttatctgaaattctgagtctttgtgtggactcgttaccacaataattatggatagggtaaatacagttaatgcctatttactgagcatgtgttatgtcccaggcatgtgttaaatacttatgtgatttcatgaatcatcaagagctgcctgtgaaataggtgttattatcctcattttactagatgaagaaatgagagctttggacagtggcaaagccagtagatgtcagagccaggatttcaacccgagcatctctgattccaaagcccaggctctttgccattctgatttttggtttttggcctcctaaatacctcctggctcaatttttatttatctatcaagcaaggtgtcttctttcctcttggattttcttcttcctatgtaatttttttgttttgtttttttgagacagagtctcactctgtattttaggctggagtgcagtggcacgatcttggcttactgcaacctccgcctccaaggttcaagtgattctcctacctcagcctcccaagtagctgggactacagatgcgcaccaccatgcacagctaatttttgtattcttaggagagacagggtttcaccgtgttgtccaggctggtctcgaactccagacctcaggtgatctgcccgcctcggcctcccaaagtgctgggactacaggtgtgagccactgctcccggccgtaatttttaactaaaggaagctgtgccaatgtggatctgcacttccaaatgttacacaccagtaagggctaagatgaaacaactaattatttgatcaggagaaaggtattagaaaagtagcatcaaaggccaggcacagtggttcatgtctgtaatcttagcactttgggaggccaaggcgggaggatcgcttgagcccaggagtttgagaccagcctgggcaacatcgcgggacctcgtctctataaaaaatagaaaacttaggcatggtggcgtgtgcctgtagtcccagctattcaggaaactgaggtgggaggattgcctgagaccaggaggtacaggctgcagtgagccacgatcgtgccactgcattgaagcctgggtgacacagcgagaccccatctcaaaaacacaaaacaaagcaaaaagaaataaataaagaagagtggcatcagctgcatagcactggatttgtccaaaccaatgaattcctttattttgccccagggattggtttatatgtaaaatcaaattgaatgaagtctaatataactgaaaaagaaaagatgagataaaatgtactaaataatgagaattttaccaaatgatttggaaagaacagccagagaatgcatacttgtgcgcacacctggccatggtaataataggtctcttttctcacggaaacacttcagatactccctactcctaataacaggccttatgtgtgaactaaacggaccatgttaccttcgtgtttcatgggacaatgtttctttcctcttcaagctgttctttcacttcttagcagcagtggccctccccggccttaattaccacaatgaaaccagtacacagctacactgtgtgaaggtgcatttatagaatgcaggtgctttttgatttttaaatggcaagaaagtataacaatactatgaagtcaatagtgtgcacactccagcctgggagacagagcaagaccctatctcaaaaaaaaaaaaagtgtgctttcatggttaattagtagctgcttttttttttttcttttcttgagacagagtctcactctgttgcccaggctggagtgcacactatgagtaattagtgagtaactaataatttttattagcgagtgtgttttgcggatattgaccattagtgttcttctagttgaagttcaacaatgatttttcatgtcattagtcatagttatagtccatgtgggaacaatggcatattttatatctttattaagtgtccttttggttatagggtttgtaggtttctccttgaaaccttctcctatttatgggggcctagagctaattattagtggtgctgtaggttgtggtattgtgttgatttttggtgtggcttttgtggggttgacagtctttttggttcacttgggtggcatgatggttgtttttggctataccatggcaatggctgctgaggaatatcctgaaacatgagggtcaaatattgacatctgaggggctttactattatgagtattaaaggggttgctgtcggtttggtgaatagttgagcatgatggggtggggatcatgattgattttaacagcatagagagttggatgatttttgagggggagggggaggggttgttgcatgaggatcctgtgggtgcggctgccttgtatagttatgggtgttgaatagtggtagttgctggttgatcattatttgttactatttacgttgcgattgaaattactcggggtaatagattagataattaggagtagggttaaaagggatgggataaaaaaagagagaaagtagagtttaattaggcctttttgagtagacacagtaatggaggctgaaatttgggtttgtgaaatggtctttggtatagacttttctagtcaaattaggtctagtagtagtgaagccagattttggcttgtggataggtttgagttgggggttgtatggtgaattgtgactgaatagaatcctagtattttggagaagttgaatgtctgtagtgggtattttagtttaaggttattagttatgagattaaactccattgctagtaagaagcctaaggtggtcacacctagggctgtgagcttcaggtggagtggtatggttgtttggggggatgacgcaggaataatactgttggtgaggaggaatccggcgaagatgctgctgattgttaggtgtttaattaggaaggggttattttcgttaataataaccagagtcatgaagtaaggttgccctattagagcgaagaaaataatatgggtactgtagacagctgtcaaggaggtggcaataagcgtaatagaaagggctcaggcattggtgtatgatgtgtttgcaggttcaataatgaggtctttggagtaaaagcctgtgaggaaggcatacctgtaagttgtgaggctgctgataaaatgggaggaggaagtgaggggtagagtcttgaatagccctcctatttttcggatgtcttgttcttcactgaggttatggatgagggacgctgaacatataaataatatagttttgaaaaaggcatgggtgcagatgtgaaggaatgctagatgcagctgattaatgccaattgtgactattataaggcctaactggcttgaggtggagaatgctatgatatttttgatatcattttgtgttacagcacaggtggctgtgaataaggtagtaatagcccccagacataatgtaaaggtttggattgataggttattttctattaaagggtagaagcagatgagcaggaacactcctgctacaactatagtgctggagtggagtagggctgagactggggctgggccttctatggcagatgggagtcagggatggaggccgaattgagctgactttcctgctgctgctaagagaaggctaattaatgggagggagttgggggtagggtctagaatttattttttgctgatattctcatgtgttggaggacaggaggaatcatgctatagctgaaataaagccaatattgccgatgcggttgtacagaactgcttggctgctgtattagcatctgctcggccgtaccatcagccgattagtaagaaagacatgattcctacgccttctcatccaatgaagagctgaaagaggttgttggcggtaaccagaattaatattgtgatgaggaaaataagtatttgaacaattgattaatgttagggtctgagtttatatatcatattgagaattctataatagatcaggtaatgaacagtgagtgttactgggataaatattgtggagaattagtctagcttgaagcttagtgagagtttgagagtttggacggtcattcagtgtcagtttgagataatgacttcttggtctgtgcatatcaacattgttgtaggaatgaggctaataacgaaggcacatgcgatagatgtttttacgtaatttgggtgtgaaacttttgcgggggttggctaaggtaatggtaatcggtaagattaaggggattagggatgttatagcagtggaagaatacatgtttgttgctttatttggagttgcaccaatgcttttggctcctaagaccaacggatgactctaatcctttaaaagttgagaaagccatgttgttaggcatgggggcacgagttagcagttcttgcatactttctcagtaggtaagaagttgcaggcttctatgattagatctgcaatctaatgttttggttaaactgtagctacagcatgcaaaccccataataagtttagggtttaaagataataggaagatagacgcaagatgtataagtattaatgtgttctctcgtgtaaaggaaggtttagtactgttaatataatatgcaagtgtccctcgttgtgttgtgattagcatatttagggagtaaagggctgtaattagtatattaagtcctataagcataatagtgatattagatcagaagaatgaggccacggtcacaaagagttctactagattaatggtgtggggtaaggcaaggttagtaagatttgctagaagtcatcaagaggctattagcagaagcagtgtttgaaggcgttcggtaagtaatagggttcacctatgggcctgctcgtagtttgaatttgctaggcagaatagtaaggctgaagtgagtccatgagcaattataagggtgactgcacctgttaagcttcaaggggtctgaatgaggatagccatgataacaagtgctatgtggcttacagaggagtaggcaatacatgattttagatcagtttgtcatagacaaatagagcttgtcataactctccctcatagggacagtatgaggaaagggtatgctatatgttctgttaggggattgaggagaagagtaagttgtattatactgtagccacctagctttaggagtcctgctccaggtactatcgagccgcaataggggcttctacgtgggctttgcggagtcataggtgaaacctgtatagaggtatttttactataaaagctatgatacatgctagtcatgtaggattgttggatcaggaggctaatggctcttgggtagtaagtattattactagcatgtttagtgaacctgaggtattttgagtataaacaagtgttacaagtagaggaagggatcctactagtgtgtaaaatagaagtatgagcttgcattgaggcgttctggttggttgcctcagtgggtgatgataattagggtaggaactagtgtggcttcaaaggggatataaaatataattagttctgtggctgtgaatgctctgattaaaaaagtcagtagggaaatcaatatagaaatatagagcttttttcatgggggtgattcattggacaggtgatattggcttctagcaaaaactgtaagaggcagtagacaggctattaagattagaagcggtgacgtcagcgggtcagaagagaaaattaatgagaggttggatgggttatcgctgaattggttaaaaaatagtaggctggcgaggctgatgagtaggctgtgaataatcatgttgattcagattatagaatttttagagaatcatgtcattggtaacagtataattgttggaataataatttttagcattgaagtaaatttagattttgtacgtaatccaggccatatgtgttggagattgaaactagtaaggcaaagcccactgcagcttcgcagggagcaaatactaggaggatgatggggattatgggtgctagagtgaaatgtatgcttaaagctgtaagagtatttatgataactattgatagtattatgccttctaggcataacagggatgatactaggtgggatcgatagactaatatccctagcagtgatatggtgtgtgctaataagggcatttggtaaacatggtctatcataatctaatgagtaaaaatcatttattttggcttaaactatttaccaattcatcccggtctaatcctttttgggctcattcatgtcaagcctaggattaaagtggtaattgtataagggctgcgctgattattagtgtcaggttggttatttgaagggctcatggcaggggtagtagtagagtgatctctgagtcgaaaaggaggaatgtgatggctactaggaagaattttatggaaaagaggaggcaggcggaggctattgggtcaaatctgcattcacaggggctggatttttctatataagtattacgctgtgggagcaatgcaattgttattagtaatagggccagtaaggtgttggttactagggctagtgtcaggttgattactctcttggatattattgaaactgattggaaatcaatggtattgtttatactaaaagagtaggatcctcatcagtagacagagacgtgtaagaatagtcatactacatctacgaagtgtcaaatcagacggcagcttcaaagccaaagtggtggctggatgtaaagtggaattttaattggcggagaaggcagatagtgagaaatgttgatccaatgatagcgtgaagtccgtgaaagcctgtggctgtaaagaacgttgagccgtagtttccatcggagagagtaaagagattgtgcagtgagcacaatctcagctcactgcaacctccgccttccgggttcaagccattctcctgcctcagcctcccaagtagctgggattacaagcaggcaccaccatgctggctaatttttgtatttttcttagagatggggtttcaccatattggccaggctggtctcgaactcctgacctcaagtgatctgcctgccttggcctcccaaagtgctgggaatacaggcgtgagccactgtgcctggccctgcattttttctttaaatgaggtatggaggagatgagagccttttggctcttttttttttttttttttttttgagactttttggagtttcactcttgttgcccaggctggagtgcaatggcacgatctcggctcaccgcagcctccgccttccgggttcaagcgattcttgtgcctcagcctcctgagtagctgggattacaggcatgtgccaccacgcccaggtaattttgtatttttagtagggacagggtttctccatgttggccaggctggtctcgaattcccgacctcaggtgatcagcctgcctctgcctcccaaagtgctgggattacaggcgtaagccaccgtgctggccgagccttttggttcttaaatgcctcagtctgacagcaggcagggtagtggtgttgtcaagtggactgattcaaattcaaattcagtcacttagtagttgtctaacatctggcaagttacttaatttgaattcagtttcttttcttttctctgtttctctctctttgagacagcatctctttctgctgcccaggctggagtgcagtggcacgatctcagctcactgcagccttgacctcctgatcccatgtgatcctcctgcctcagcctcctgagtagctgtaattacagacatgcattaccatgcctggctaatttttaaatttcttgtagagatggggtcttgctctgttgaccaggctggtcttgaacttctgagctccagcaatctgccctcctcggcctctcaaagcgctgagattacaggtgtgagacactgcacccagcctaaactcagcttcctcatatttatatgaggaacctacatctaccaaatgaggataaagaatatcacaatgcaatttgtaaagatttaaaaactcctggctgggcacagttgctcacacctgtaatcctagcactttgggaggccgagacaggcagatcacctgaggtcaggagtttgagaccggcctggccaacatggtgaaaccccatctctactaaaaatacaaaaattagccagacatggtggtgtgtgcctgtaatcccagctacttgagaggctgaggcaggagaatcgcttgaaaccggggggtggaggttgcaatgagccgagattgtgccactgcactccagcctgacagagcaagactctgtctccaaaaaaaaaaaaaaaaaaaaaagaagttaactcttttgcttaagacctggcacatgatgttcgcactcaacaaatattggttcccccgcccccctttccttggttactatttcagtcttctaagggttcattcacacccctaaggagaagcacttaatgtcaagaaaggactagtagtaactttcatgcatttattcagataataccttctgattgccatcatgtgccagatgatatgttaggtactgggaatgagtaaaaccatataaaccaaatggtatccaagataggtgtcaatcagtttagaaagttttttgtgctagggttaagaacacacccatgacacagcctcaggagctcctgacaacatatgcccaaggtggtcggggcacagcttgattttatatattttagggagacatgagacatcaatcaatatatgtcagatgtacattggttcagtccagaaaggcaagacaactcaaagtggggaggggccttccaggtcctaggtagataagagacaaactgttgcatgcttttgagtttctgattagcctttcattgaataaacagtttacagcagtggtcccttacccccaggccgcggaccagtatgggtctgtggcctgttaggaagcaggaggtgagcagccagtgagtattaccgcctgagctccacctcctgctagacctgtggtggcatgagattctcataggagggtgaaccctattgtgaacggtgcatgggagagatctagattgctccttatgagaatctaactaatgcctgatgatccaaggtggagcagtttcctctgaaaccatcccgcccaccccacatctgtggaaaaaatgtcttccacaaaaccagcccctggtgccaaaaaggtttgggactgctgatttacaggactagtcacttatgccttagtctggcttagtgaaacaatagggcagagcaagcaaatcagatgtgcatttgtctcacatgagcagagggatgactttgacttctgcctgtcctttgtctgcaaggaatttcctcatgggcaaattgtgagggagtgcggggcttgcgggggtggtggtggtggagggtggggtgggtatgtagctatcttacttaggaatagagtgggaggcaggtttgcccaaggcagttcccagcttgacccttccctctggcttagtgatttcggggagatttcttttcctttcacacctagaaccccggctctcagagggtttatggcattgtgggggagacagatcttccttgagtcatcacttacacaagtgtacaactgcaaccatgacacgggtctcaaaggagagcctcgcagtgaataagaacctagagatagatttgacctcgtcagagaggtcagagaaggcttgagtcttcagtgatgcttgagtcaagatctaccaaataagtccatctggcaaagagaggagggaagagtgtgccaggcagaggaagctgcaggtgcaaaggccttgtggcagcagggagcatggctagtaggtgggtttgaatcatgaccagcgtggatggagtacagggttttcagggggagtgaggtgtgaaagtgacgctggagagtaagtaggagtcagggcaggcagggccttggaggccaccctgggtcactagtgaatctttgaagtaagtggctacaataccagcatgcggttaatgattgtatgtgggtttgaacatttacaagttagtaaattatgtatagctgaaactgaagcaagttgtgagggttttcctagaaaccagatggaatgcaggatggtactagtgtgtccctgttttgtccacacatcaacaaaagcattaaaactgggcagacgcccagctcatcctccacctctgctgctctgggcctacatcctggggacggcggagcagtgcgccacccaggagatgtggctggaagctggggagtagagggcatcctctgatctttcatgaaaacagcccatggcagtgcacggtggctcccacctgtaatcccagtgcttgggaggcagaggtgggaggattgcttgagcccaggagttcgagactaacccaggcaacatagtgagaccctgtctctacaaaaaaataaaaaaaagttagcctggcatggtggcatgcacctgtagtcccagctactcaggaggctgaggctggaggattgcttgagcccaggagctcgaggctgcagtgagctgtgatggcgtcactgcactctggcctgcacaacagggcgagatcccatctcaagaaacaaaaaacaaaaaacaaaaaaaacccgcccatgatctggcgtcttaccccccgaagagctgaggagatgtaagtgtgaataattctgtctaatggattgctatcatccacgttcttctcagtgttaagaacagaggtcccaatccagaccccaagagagggttcttggatctcatgcaagagagaattcagggccagtccacagtgcaaagtgaaataaacttgctttattaagaaagtaaaggaataagagaatggctactccatagacagagcagccccgagggctgctggttgcccatttttatggttatttcttgagtatatgctaaacaaggggtggattattcatgcttcccctttttagaccatatagggtaacttcctgatgttgccatggcatttgtaaactgtcacggtgctgacggcagtgtagcactgaggacaaccagagaggtcactcttgcggccgtcttggctttgctaggatttagccagcttctttactgcaaactgttttatcagcaaggtctttacaacctgtattttgtgctgacctcctatctcatcctgtgacttagaatgccttaaccgcctgggaatgcagcccagtaggtttcagcctcattttacccagcccctattcaagatggagtttttggttcacatgcctctgacatcagatcaatgttgcttgttattactcttattattgtcatctcaaatctgaagagtcaccagaacaaacttccttctgccctttggtttgctccctcccctggctcccagcagcaggggggctgctgacaattcacagattagtagttgacttccatgggggctggagctcaggatcagaggcaagcccttttgactcatggtcgtggggtcccagcgtgaagctgctctgtgattgccctggaactcaacatgtcagagctgccacagggagatggcagaggctgcttggtagctgagaacaagggagacgccctgggagatgctcagaaacaatccgaggttcagaagcagggccagagcccccagggatgtgagcagagtggaaggagcaaggcatggccatcagtattccggccccagtgtattaatacctacgggctgggcgacctgggcatctgagcttgcattcagaggtgtcataggagagccccctggggcctgtgctgcggctccctccccaacggtggtgtctgatgatagggttttgcagcaggctatctcctccatccattcctgatggtcagaaggcaggagagcctgagaggacaacatctctgccatcaagtgggaactcgcagtgggattcctcactgtcttcccaaaagacacaatttccacagcatttgcgcatcttgttcacagggccctacctgtgtggtgctgatggcttattctccatccagatagccgaggatcgtagtttgtattttaaaatgatgtcaagcatgctcttaaaatgccccactagcgatgttagttatcattaatgtaatgttaatgatatccaaagaggagtaaaaatttgagcaaagtgccaaaaaagtaggattcttgattgctagtcacaaagcccaactttttattgaagtataacatacacacagaaaagtgcccagatcaaaagtgtacagctccaagaatgttcacaaacggaaagcacccaggtaaccggcaaccagatcaagaaacagaacaccccagaagcaccacctcatgcccgcttctggttactgtcttcttaggactgatctctacttgcaaccgcatggatgaattttgctgggttttaaactttatataaatggaatcctatggtgcatttttgccttatctcgttcaacactagggttggtgaatacactccaagttgggggtggagttgcagctcattcccattgcagtctgggattccatcgtgtgaatataccctaatgtgcttatccagccaacatgggcattggggtgctttcctgttcggggttattatggagagtgtttttgtgaagatttagagcatgtctctggatgaacacatgtacacatttctgtagggtatacacctaggggtggaattgttaggtcatatatatttacatccaactcaagctctttcatgaaagaagaaagaatgtactggatggagtttgctggctcaaagaattgacagaaaactagaagggaggtctgtaggaagataggtggaggcggagacagctcagcgagtccaaggagtggagcagaaatgacattcccaggacgctgccatccctggacattgctaccagtggacacaccatccctgcagcctgccagccctacccacctgccttgctgtatgactaccaaccccggaccacggtggcttccttgaaatgagtctcagcatcccttcatttgtgtcacattctccaggctcatagccccaagcaagggtccaggtagtccaccccaggtcaatgaccacttcccgactggtatggggctggaagcggggtgtgcctgagagacaggaaatacttcccttcttcagcttccacggtgggtactgcacaccactaagtttatatctaaggcatgatgtccctgctgtaggaagggaggggagatgctggacagttaagctgaaaacacaaaaatgacaactgtccccacagctgcactccacaatgcaagcaggctttattccattcatcttccactgacagagtgggggagctcagtgacatgtctgtggatctcacagctcatgtgcagaaatctccatctaagaagagggaactaggccaggcgcggtggctcatgcctgtaatcccagcactttgggaggccaaggcgggcggatcacttgaggtctgggcttcaagaccagcgtggccaacatggtgaaactccgtctctactaaaaatacaaaaattagccgggtgtggtggcgggcgcctgcaatcccagctcctcgtgaggttgaggcacaagaatcgcttgaacccaggaggcagaggttgcagtgagccaagattgcgctactgcactccagcctggacgacagaaagagactctgtctcaaaaacaaaaacaaaaacaaaaaaagaagaggcagctggattcaggatcactctaggaagggtgacccgtccccaaatgccataggtctggaagaggtgcagtaaaaggacagaaaagcatctcacaggggaaggtaaggaagagaggaggaaaaggaaaaggagagagaacaaaacggaggctgaatctggagggacggggcatgtaaaaacaacagggagaaggtttggtggaagaggaaagcagcatttttctgacctgattttgatgctctctgtacggccccgctttctcggcttctctgatgtgcctttatgacttgtgcttcgcttcatcgggttaatgatgttgacgtgaagcacagaataaagagatcctggtcataactgcactatcaaaggatctgaggtcctagcgtcacatccagcatacaattctgctctagtttgagcatcttaacaacactggtattattagtgagctgataatgaaactaagaatgagttttaacaaaagaagcaaggaacaaagatgtcctaaatccatttacgagggcagcaagtcattaattggtctggaaattacatttgcctctttgcaggcaattttatgcctccaacggaaccatggtctctttgaagtcatccattcttccctatattataccacggcatttagtacatttatttgttttaaatgataatcagagctttcatctatgtagcatctctgtttcctcccagacagaaaggcaggataattaccattaaacccaatttgcaggttagaacatttcaggcacaaatggcctgttctctatcacacagcaagtctctttcagaactagggagagaggcagtttccaaataaacagaatagaacaaacttacacaaagagctctgctcccactgtgtattctcctctttcatcgggatcatatgagtttggtttaggtaggaccttcaggttgatcttagacaatccaagagctaattcatcgatgtctagcctttccttggggcatccatgaatcaccttccttaaactaccagaatacggcttcctcctggagaatgtgggaagtgaagtgtgccacgggttactgcaacaaaggtgtttgcttcacggtgtgcagttatgatagtttgtgggtctccctacctgcaaacaggtagacctggaaggtagcacagttcagggggctaagggaactctggggccgggctgcctgccctcaaatcccagtttttctgcttaccatgtgtaaccttgggcaaactacataaacgctttgtgcctcagtttcccctcactctaagacatacggccgggtgcactggctcacacctgcaatcccagcactttgggaggccaaggtgggcagatcactcgaggccagtagttggagaccagcctggccgacatggtgaaaccccgtctctactaaaaatacaaaaatgagccaggcatgttggcgtgtgcttgtcatcccagctactagggaggctgagacatgaggatcacttgaacctgcgagtggaggttgcggtgagctgagattgtgccattgcattccagcccgggcgacagagcaagactctgtctcaaaaagataaataaataaaataaaacagacatgcacttatggtatttattgttggaagattgagtaccttaatgcacaccaatgctcagatgacttgggggcacataggggactgctgtcaccatgcctcactcctgcagggaaggggctgccctactaaaaccccagcgggcccagtgctgtgtccagaacaggtccttatattactgcagcccacaatggaactactgagtaggagccaaaagaggagggagcaggaagaggtggcatttggagaggggagaccgcacccacaggtctgccacagcgcgtcaacggtatggggtacttttacagtcaagttgacttcggtgtccgcccaccatctacctttgtaggaccactgaaacaagggacatccaccacggcccacagccggggcgccacggccccaggaggatatgctaagaaaaccattccacggccgggtgtggtggctcacgcctgtaatcccagcgctttgggaggccgaggcgggtggatcacgaggtcaggagtttgagaccagcctgaccaacatggtgaaaccccgtctttactaaaaatacaaaaaattagctgggtgtggtggcgcgtgcctatgatcccagctactcaggaggctgaggcaggagaatcgcttgaacccaggaggtggaggtcgcagtgagctgaggtcacgccattgcactccagcctgggtgacagagcgagactccatctcaaaacaacaacaacaacaaaaaaaaaacaaaagaaaaccattccaatcctgtgggttgttgtctttttactaggatgatggaaatgcaggaaatacagaacctctgcagct

SEQ ID NO: 1969 - DNA, 229133 bp, Homo sapiens
gcagtgttcctatactacataatttgtccaaagtatccattcatctattgccatcaagccatcattattatagtgggtgtaacactaatttggtaagcgagagatggtgtgattacttccacagcagttactccatcatttctgaactttcaagtcactcaactttcatattaaaaataggtttggtctgacaaatcttttttaaaagcctccatttgaggcactttcagctgccgaaaaaacttgtcctttctataacctatctttaatgctggccagttttaacaaatggctttacagcttttgttaaagaaagttttgtctacataatgtgatgccgtaccattatcaaataataagaagtcaactataagtaatctagaatcttcattaccaagtgatttgttcagaagccagttgtcattttagttattaattggaagtacccaaattaaaataataatgttatagataaatgaaaaacaaaagtaacagaagtggtatttctcagtgcataaatttggggatttgaagaagataaggacatttatgttgaaaaacattccatgttgaataaaaataagataacaaagcatatataaatatagcctgtactgcatatgaaaataagcccagtaaagaattgtagccttgaggcatttcttttttttcttatttagttttaatttttgtgggtacctagtaggtatatatatttatggggtacataagatattttgatacacacatgcaatgtgtaataatcacatcactataaatagggtctctatcccctcaagcattttatcttttatgttacaaacaatccaattatacttttcagttatttttcaatgtaaagttaaattatttttgactatagtaaccctgttgtgctatcaaatacaaggtcttattctttctagctatttttttgtacccacttatgatctccacttttccccccaacaccccgactatccttcccagcctctggtaaccatccttctactctccatctctatgaggtcatttgttttatttttagctgccacaaataagtgagaacatgcaaagtttttctttctgtgcctggcttatttcacctaacataatgacctctaattccatctgtgttgttgcaaatgaccagatctaattctttccgtggctaaataatactccattgtgtatatgtacaacattttctttatccattcatctgttgatagacacttaggttgcttccaaatcttggctattttgtatagtgctgcaataaatatgggagtgtggcatatctttctgatatactgatttcttttcttttgggtaatgtatctaggagtgggattgctagatcacattgttgctctagttttaggttttcgagaagcctagaaactattctccatagtggttgtactaatttacatttccaccaacagtgtacaaggattcacttttctccagatcttcaccagcatttgttatcgcctgtcctttggctaaaagccattttaactgaggtgaagtgaggtgatatcttattgtagttttgatacgcatttctctaatgatcaatggtgttaattgagcaccttttcatatacttgttagtcatttgtatgtcttccattgagaaatgtctattcagatcttttgcccactttgcaactggattatttgattttttcctatagagttgtttgagctccttatatattctgattcttaatcccttgtcaaatgggtagtttacaaatattttatcccatgctgtggattgtatcttcacttcgttgtttgtttcctttgctgtgcagaagctctttaacttcatgtgatcccatgtgtccaaattgctttgatttcctgtgtttgtggagtattactcaataaatctttgcccagtccaatgtcctgaagagtttccctaatgttttcttgtagtagtttcattgtttgaggttttagatgtaaggatttaaaccattttgattgatgtttgtatatggtgagagacaggggtctagtttcattcttctgcatatggatatccagttttaccagcaacatttattgaagagacttgtcctttcttggcaatttagtgaataatgggtatactgtaactgtatggatgtatttctgggctctctgttctattccattggttgatgtgtccgtgtttatgccagtgccatgccattttggttactatatctctggagtgtaatttgaagtcaggtaatgggattcctccagttttgtcctttttacttacgatagctttggctattctgggtcttttgtggtttcatataaattttgagactgctttctagttttgtgaagaatgtctttggtattttgatatggattttattaaatctgtagattgctctcagtagaatggacattttaacaataaagactcttccaacccatgaacatcgaatatctttccatttttttgtcctctttaatttcctgcatcaatgttttatagatgtcattgtagagatttctcatttcctcggttaatatgtaggcatttaattttaattgtagctattgtaaatgggattactttcttgacttctttttctgattgttcgttgttcgcatgtagaaatgctactgatttttgtctgttgatttcatatgctgtaactttactgaatctgtatatcagttctaatcgttttttggtggagtctttaggttttttcaaatataagacctatcatctgcaaacaagaataagttaacttattcctttccaatttgggtgccctttatttctttctcttgtatgattgcttaagctaggacttccagtactatgaaaaattacagtggtgaaagtcagcatccttgccgtgttccagatcttagaggaaaggctttcagttttttctcattcagtatgatactagctgtggatctctcatatatgacttttattatgttgaggtatgctccttcaatactaagttttttgaggtttttatcgtgaagggacgttgaattttatcaaatgttttcccagcatcgatggaaatgattatattttttgtccttcattctgttgatataatgcatcacatggattgatttgtatatgctgaagcatctttgaattcctaggatagatcccacttagtcatgacaaatgatattttaatatgttgttgaactctattttccagtatttagcttagaatttttgcgtcagtattaatcagtgatattggcctgtagttttctttctttttttttttttttttgatgtgccattgtctcattttgatatcagggtaatattgacctcatataataagtttggaagaattcactcctcctctattttttggaatagtttgagtagaaatgatattagttccttagtgtttggttggattcatcagtgaagccattgggtcctgtattaatctgttttcatactgccttaaagaacttctcaagactgagtaatttataaaggaaagaggtttacatgactcacagttcagcattcctggagaagcctcaggaaatttacaatcatggcagaaggcaaaggggaagcaaggcacctccttcacaggcagaaggaaggagaagtgccaagtgaaaggggaagagcccctcacaaaaccatcagatttcatgagaacttactcactatcacaagaacagcatgtgggaaaccactcccatgattcagttgcctccacctggttgctcccttgacatgtggggattatggggattatacaattcaagatgagatttgggtgggacacaaagcctaaccatatcattccaccctggctcctaccaaatgtcatacgcctttcacatttgaaaaccaatcatgccttccaaaaagtctccaaactcttaatcatttcagcattaacccaaaagtccaagtccaaagtcccatctgagacaagacaagttccttctccctgtgagcctataaaatcaaaaacaagttagttacttcttagatacagtgggggtacaggaattgggtaaatatacctgttccaaatgggagaaattgaccaaaacaaaggggctacaggccccatgcaagtccaaaattgagtgggcagtcaattcttaaagctccaaaatgatttactttgacttaatgtctcacatccaggtcacactgatgcaagaggttggctctgatggccttgggcagctctgcctctgtggcttcacaggatatatcccccctccaggctgctttcacagggtggcaatgtttgtggcttttccaggtgcacagtgtgagctgtcagtggttctaccattctagggcctggagaatggtggccctcttctcacagctccactaggcagtgcccaagtggtgactctgtgtggggactccaacctcacattttccttctgcactgccctagaagaggttctccatgaaagcgccactcctgcagcaaacttctgcctggacacccaggcatttccatacatcctctaaaatctaagcagaggttcccaaatctcaactctggacatctgtgcacctgaaggcccaacaccatgtgtaagcttccaaggcctggggcttgcactctctgaagcaacagcctgaactgcatgtggccacagctggtatgcagggcaccaagtctcaagattgcagaaagccacaaggccctgagctgatcccaggaaaccatttgttctcctaggcctctggggctgtgattggaagggctgccaggaagacctctgacatgctttggagacattttccgcattgtgttggtcgttaacatttggctccttgttacttgtgcaaatttctgcagctggcttgaacttctcctcagaaaatatgtttttctttactgtcacatcatcaggctgcaaattttccaaactttaatgctctgcttcccttttaaacataagttccaattccaaataatctctttgtgaatgcataaaactgaatgcttttaaaagcacccaagtgacatctttgctttgttgcttagaaatttcctccactagatatgctaaatcatctctcttgagttcaatgttccaaagatctctagggcagggacaaaatgccactagtctctttgtgaaagaatagcaagaatcacctttattgcagttctcaacaagttcctcatctccatttgagaccacctcagcctggacttcattgtccatatcattattggcattttggtcaaagccactcaacaagtctctaggaagttccaaactttcccacatcttcctatcttcttctgagccctccaaactgttccaacctctgcctgttaccctgttccaaagtatcttccacattttcgggtatctttatagcagcaccccactttctgtagtacaaattcagggtatttgtttattttcatactgttataaagaactgcacgagactaggtaattcataaaggaaatagttttaattgactcatagctcagcatggctggggaaacctcaggaaacttacaatcacagtggagggtgaaagggaagcaaggaaccttcttcacaaggcagcaggaaggaaaagtgctgagtcaagggggaagagccccttataaaaccatcagacattgtgagaactcactcactatcatgagaacagcatggggaaaaccacccccacaattcaattgcctccaactggtctctcccttgacaagtggggattatgggaattatgaggattacaattcaaggtgagatttgggtggggacacaaagcctaaccatatcgggtcctgagcttttctttactgggaggctttttattaccacttcgatctcattacttgttatttgtctgctctgatgtcaaatttcttacttgtccaatcttagaaggttgtatgtgtctgggaatttttctatttcttctagatttttcaatttacaggcatatagttgctcatattagccactaatgtttctttgaatttcagcagtatcagttctaatgtttcctttttcatctctgattttatttaggtcttgtctcgtttcttttagttaagtctggctaacaatttgttaattttgtttatcttttcaaaaaatgaactttttgtttcatagatcttttgtattgtttcttctttccatttcatttattttttctctaatctttattaatccttttcttctactaattttgggttcacctagctcttgtttttctagttctttaagatgcatcattagattgttcatttgaaatttttcttcttttttggtgtactcattcatagctatactcttccctcttagtacttcttttgctgtaccccataggttttagtatgttgtgttttccttatcatttgttcaagaaatttttcaaaatttttcttaatttctttattaatccactcatcattcaggtgcatattgttgaatttgggtgtgtttgtatagtttccaaaattcctcttgttattgatttctagttttattccactgtggtcagaaaagagtctagatttttttttatttttttgaatattttcagccttgttttgtaacttaacatatggtgtattttttagaataatccatgctgaggaaaaagtgtgtcttctgcagccactggatgaaatgctccctgaataactattagatccattttgtctgtagtatagataaagtaggatgttctttgttaattttctgtccagaagatctgtccaatgttgaaagggggtgtgaaagtctagacctattattgtattgaggtttgtctctctccttagctctaataatccttgctttatagccctgggtgctgtagtgttgagtgtgtatatatttacaactgccacatctccttgctgaattgacccctttatcattacataatggccttctttgtctcttcttcacattttgtcttgaaatctattttgtcttataaaactactccaggtttttatttattttatttatttatttatttatttatttatttattttgagacagggtttcactgtcatctagcctggagtccagtggggtcaacatagctcactgcaacttcaaactcctggactcatgcaatcctcctgcctcagcccctgaagtagctgggactacaggcatatgccatcacacccagttaatttttgtatttttttgtagagatgggggtttcactatgttgcccaggccagtcttgtattcctgagctcaagtgatccacctgtctcaggctcccaaagtgtcttgctttttgggtttccattggcaagtaataactttttccagccatttattttcagtctatttgtgtctttacaggtgaagtgtttcctgtaggcaacaggtcattggatctttactattatgaattcaaccactctatgtatatttattggaaaatttagtccatttacattcaatgttattactgataagtaagaactgactcctgccattgtgttatttgctttctggttatattacagttttctcttctttcttttcttccttccagtcttccttttagtgaaaattattttctctggtaatatgtttagtttctttttattttctgttgtatctattctatgttttttcatttaaggttaccatgaggcttgcaaatgaatactatcttataacccagtatttcaaacagataacaacatctgcatatataaacaagtgaacaaagaagctaactaaaagaaaactagtaaaaactatatatcttaactttgttcccacactttttaactttctgttgtttctatttatcttactggtctgtttcagtcttgaaaatttgttgtagcttttgttgactggttcatttgttagtctttctacttaagattagaatagtttatacaccaaagatacagcattataatattctgtgttgttttgtgtattcactattatgagtgagtttcataccttcaggtgattattgagtgagttttgtattttcaggtgattattgattgctcattaatatatttttctttctgatttaaatactccctttagcatttattataggaaaaatctggtgttgatgaaagccctcagcttttgttttcctggaaaagcctctatttctccttcatgcttgatgaatatctttgccagatatacaattctagaataaaggtttttttcttcttagctttaaatatgtcatgccactctctcctaacttgtaaattttccactgaaaagtctgctgccatacatattgaagcatcattgtatgttgtttcttttctgctgctacttttagaatcctttccttttcattgacctttgggagtttgattattaaatgccttcaggtagtcttctttgggttaaatctgcttggtattctatagccttgtacttggatgttgatatctttctataagtttggaacattctctgatattatcttttgagtaaactttctaccctgatctctttctctacctcctctttaaagccaataactcttagatttgcttttttgaggctattgtctacatcttgtaggcataattcattcttttttatttttttcttttcagtcttctctgactttgcctttttcaaatagcgtgtctttgagctcactaatcctttcttctgcttgatcaattctgctattgaatgactctgatgcagtcttcagtatgtcaattgcactttttaactccagagtttctgcttgattctttttaactatttcaatatcattttaactttatctggtagaattatgaattccttctctgtgttatcttaaatttctttgagtttcctcaaaacagcttttttaaatttctttgtctgaaaggttacatatctctgtatctccaggattggtccctggtgacttatttagttcaattggtgatatcatgttttcctgaatggttttgatacttgtggatgtttgttggtgtctgggcattgaaaagttagatacttattgtagcgttcacagcctgtgcttgttggtacccatccttcttgggaaggcttttcatatattcaaatggacttgggtgttgttatcaaagccatatctgcattagggaacaccccaagcccagtaatgttatggttctttcagactcatagaggtacccctttggtggtcttggatgagatctggaagaaatctctggattaccaggcagtgattctcgttctcttcccttactttctctcaaacaaatggagtctttctttctctatgctaagcctctggagctgggggtgagtaacataagcacccctgtgcccaccaccactgagactgtgctgggtcagacctgaagccactacagcactgggcctcaaccaatgcccactataaccactaactggctaccatctatgttcactcaaggccctagagctctataatcagcaggtagaaaaactaaacaggcttgtgtctttcccttgagggtggcaagttcacccaaggacctgggcaggctcacagatgccatctaggagccagggactggagtcaaaaaccttagaaatctatctggtattctattgtactgcaaatgagctggcacctataccacaatacaaagtccttcccactcttcctttgccttcccatacaaggagcctctccctatggctgccaccaccatcatcccatgggggcttctgccaggcccacaagtgttcatttacaggccaagggctcttcagtcagcttgcagtgaatgctgccaggcctggaactcaccactcacgtgagtaggatcccctctgcccctgggaaggtccagaaatgctgtttaagagccaatgcctggaaacaagagtccccagaagcccacttgatgatctaccccactatagctgagcttgtacctcaggtgcaagacaaggtctcctttactcttccccctactttttctcaaatagaaggagtctctcaccatagccaccacagctggaaataggctgggtctgacctgaagccaacacatctcagagtctcacccaagatccatggcatactatgagggaatcactgctgggtattcagaacccatgggccctttcgtcagcatgtgatgaggcctgcctggactgggtatttctcttctaggcaacaggttcccttttggcccagtgtgtgtctagaaatgtcatccaggagctagcgcatgtaatgtcaaccaggagttaggacctaaaacagctcacttggtgccctgtcctactgtggctgagctggtatccaagaaacaagacaaacttatctttacttttcccccttctctccttaagcagaaggatgggggtctcttttagagccacaagctgtgctgcctggtgttaggggaggagtgacaacaggcactcccttagccaccctggctggggtctcattagtttgcatgatgcccacaagtccactggctctgatccccactcagcagtaggatttgcctaggacttgcagtccttgtggcctagcctgcctttcaaatttatttggagtcccagaaaactttagcccatggtagtgagtcttgccagaattcaagttctagccactgggatgggcaattgccctctggctagggctcatctaaacgttccttccatgggtaggcatcagctgagttcagcccagttttgctttctgatgtgacaagacagcactgagttcaatacaaaatctcacagttgctgaactctccttcttccaagtgcacagattctctctctgtgccatgtggctgcttccaggagatgggaggcagcattagtgattcaaggctgtatttcttttcatcttcagtgcctctttcagtgatatgaagttaaaatcaggtattgtgagtgctcccctgatttttagttcttaagaaggtgcttttttgtgtagacaatttttaaatttggtgtttctttgggggtacaatcagtgaagacttctatttggccattttgctcctagtcatctgagctctccctttcatttttggatagacaattattgtaacatcgaacacttcatctgagatataaatgttttggtggggtgataacacacctacgcactggaacaacagatatgcattacttcgtgcaaaatttgctgagtaaaatcccaaaactagtataaacacagacacatagaacaatggaacagaatagagactccaaatgtaaatacacacatttacacacaactcatattttttaaatttaatttaatatttttatacattaagttctgggatacatgtgcagaacgtgcaggtttgttacataggtatacaagtgatgtggtggtttgccacacccctcaacccatcatctatattagttatttctcctaatactatccctcccctagtcccccaccctgacaggccctggtgcgtgaagatctcctccctgtttctatgtgttctctttgttcaactcccacttataagtgagaacatgcaagtgttcggttttctgttcctgtgttagtttgctgaggatgatggtttccagcttcatccatgtccctgcaaaggacatgaactcatccttttttatggctgcatagtattccatggtgtatatgtgccacatttttttaatccagtctatcattgatgggcatttggtttggttccacgtctttgctattgtgaatagtgccacaataaacatacatgtgtatgtgtctttatagtagaatgatttataatcctttgggtatatacccagtaatgggatttctgggtcaaatggtagttccggatgtagctccttgaggaatccccacactgtcttccacaatggttgaaataatttacactcccaccaacagtgtaaaagtgttcctattcctctacatcctctccagcatgtgctgtttcctgatttttaatgatcgccattctaaatgacatgagatggtatctcattgtggttttgatttgcatttctctaatgaccaatgatgatgagcattttttcatatgtttgttggctgcataaatgtcttttttgataagtgtctcttcatatcctttgcccactttttgacggggttgtatttttcttgtaaatttgtttaagttctttgtagattctggatattagccctttgtcagatggatagatggcaaaaattttctcccattctgtaggctgcctgttcactctgatgatagttccatttgctgtgcagaagctctttagtttaattagatctcatttgtcaattttggcttttgttgacattgcttttggtgttttagtcatgaagtcgtttctcatccctatgtcctgcatggtattgcctatgttttcttctagggtttttatggttttaggttttatgtttaagtctttaatccatcttcaattaacttttgtgtgtaagtgtgtttttggttttttgtttttgtttttgtttttttttttttttgagacggagtctcactctgtcacccaggctggagtgcagtggtgtgatcttggctcactgcaacctctgcctcccgaattccagtgattttcctgcctcagtgtcctaagtagctggcagtacaggagtatgtcaccacacctggctaatttcttgtattttagtagagaaggggtttcaccatattagccaacatggtctcaatctcctgacctagtgacctgcctgccttggcctcccaaagtgctgggattacaggtatgagccatgatgcccagccattaatttttgcatatggtgtaaggaaggggtccagtttcagtgttctgcatatggctagccagttttcccaacccatttattaaatagggaatcctttccccattgcttgtttttgtcaggtttgtgaaagatcagattgttgtacatgtgtggggttatttctgaggcctctgttctgttccattggtctatatatctgttttggtaccagtaacatgctgttttggttactgtagccttgtagtatagtttgaaatcatgtagcatgatgtctccagctttgctgtttttgtgtaggattgccttggctatataggctctgttccatatgaaatttaaactagttttttctatttcctaattctgtgaagaaattcagtggtatcttgatgtggatagcattgaatctacaaattactttgggcagtatggccattttcatgacactgattcttcctatccatgagcacagaatgttcttccatttgtttgtgtcctctcttatttccttgagcagtggtttgtagtcctcgaagaggtccttcacatcccttgtaagttgcattcctagatattttattctttttgtagcaattgtgaatgggagtttactcatgatttggatctctattattggtgtataggaatacttgtgatttttacacactgattttgtatcctgagaatttgctgaagttgcttatcagcttaaggaaatttggggctcagatgttcgggttttctaaacatacaatcatgtcatctgcaaacagagacaatttgacttcctctcatcctatttgaataccctttatttctttctcttgcctgattaccccggccagaacgtccaatactatgttgaataggagtggtgagagagggcgtccttgtcttgtgccagttttcaaagagaatgcttccagcttttgcccattcagtatgatattggctatggatttgtcataaatagctcttattattttgagatatgttccatcaataccgagtttattgagagtttttagcatgaaggggtgttgaattttatccaaggccttttctgcatcttttgagataatttttggcattgcttctgtttacgtgatggattacatttatcgatttgtgtatgttgaagctgccttgcatcccaagaatgaagttgacttgatcgtggtggataagctttttggtgtgctgctggattctgtttgccagtattttattgaggatttttgcattgatgttcagcagagatattggccttaaattttctttctttcttgtgtctctgccatattttgctataaagatgatgctggcctcataaaatgagtagggaggagtccctcttttcctatcatttgaaatagtttcagaaggaatggtaccagctcctctttgtacctctggtagaattaagctgtgaatctgtctgatcctgggctttttttggtttgtaggctattaattactgcctcaatttgagatcttgttattggtctattcagggatttaacttcttcctggtttagccttgggaggattatgtgtctacaaatttatcctttttttttttagattttctagtttatttgcatagaagtatttatagtattctctgatggcagtttctgtttctgtgggatcagtggtgatattacctttatcattctttgttgcatctatttgattcttctctcttttattctttattagtctggctagcagtctatctattttgttaatcttttcaaaaaaccagctcctggattcactgatttttttaagggttttccgagtctctatctccttcagttcggctctggtcttagttatttcttgtcttctgctagcttttgaatttgtttgcttttgcttctctagttcttttttttttttaactttttttttttttatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgacattccccttcctgtgtccatgtgatctcattgttcaattcccacctatgagtgagaatatgcggtgtttggttttttgttcttgcgatagtttactgagaatgatgctttccaatttcatccatgtccctacaaaggatatgaactcatcattgtttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttatagtcatttgggtatatacccagtaatgggatggctgggtcaaatggtatttctagttctagatccctgaggaattgccacactgacttccacaatggttgaactagtttgcagtcccaccaacagtgtaaaagtgttcctatttctccacatcctctccagcacctgttgtttcctgactttttaatgattgtcattctaactggtgtgagatgatatctcatagtggttttgatttgcatttctctgatggccagtgatgatgagcattttttcatgtgttgtttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcgaaaattttctcccattttgtaggctgcctgttcactctgatggtagtttcttttgctgtgcagaagctctttagtttactgagatcccatttgtcaatttcgtcttttgttgccattgcttttggtgttttggacatgaagtccttgcccacgcctatgtcctgaatggtaatgcctaggttttcttctagggtttttatggtttcaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcgggctctttttcggttccatatgaacttgaaagtagttttttccaattctgtgaagaaagtcattggtagcttgatgcagatggcattgaatctgtaaattaccttgggcagtatggccattttcacgatattgattcttcctacccatgagcatggaatgttcttccatttgtttgtatcctcttttatttccttgagcagtggtttgtagttctccttgaaggggtccttcacatcccttgtaagttggattcctagatattttattctctttgaagcaattgtgaatgggagttcactcatgatttggctctctgtttgtctgttgttggtgtataagaatgctcgtgatttttgtacattgattttgtatcctgagactttgctgaagttgcttatcagcttaaggagattttgggctgagatgatggggttttctagataaacaatcatgtcgtctgcaaacagggacaatttgacttcctcttttcctaattgaatacccttcatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatctattgagataatcatgtggttttcgtctttggctctgtttatatgctggattacatttattgatttgcatatattgaaccagccttgcatcccagggatgaagcccacttgatcatggtggataagctttttgatgtgctgctggattcggtttgccagtattttattaaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttatacctctggtagaattcggctgtgaatccatctggtcctggactctttttggttggtaaactattgattattgccacaatttcagctcctgttattggtctattcagagattcaacttcttcctggtttagtcttgggagagtgtaggtgtcgaggaatgtatccatttcttctagattttctagtttatttgcatagaggtgtttgtagtattctctgatggtagtttgtatttctgtgggatcggtggtgatatcccctttatcattttttattgtgtctatttgattcttcttttttctttattagtcttgctagtggtctatcaattttattgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttctgtctttgttctcattggtttcaaagaacatctttatttctgccttcatttcgttatgtacccagtagtcattcaggagcaggttgttcagtttccatgtagttgagcagctttgagtgagattcttaatcctgagttctagtttgattgcactgtggtctgagagatagtttgttatagtttctgtcctttcacatttgctgaggagagctttacttccaactatgtggtcaattttggaataggtgtggtgtggtgctgaaaaaatgtatattctgttgatttgtggtggagagttctgtagatgtctattaggtctgcttggtgcagagctgagttcaattcctggttatccttgttgactttctgtctcgttgatctgtctaatgttgacagtggggtgttaaagtctcccattattaatgtgtgggagtctaagtctctttgtaggtcactcaggacttgctttatgaatctgggtgcttctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatactgttatgtgtgaatctgatcctgtcattattatgttagctggttattttgctcattagttgatgcagtttcttcctagtctcaatggtctttacattttggcatgattttgcagcggctggtactggttgttcctttccatgtttagcacttccttcaggagctcttttagggcaggcctgctggtcacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgagggtaacctgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcattggctcctgaggcttctgcattcttcacatagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagacttcttctctcagctcgtcaaaatcattctccatccagctttgttccgttgctggtgaggaactgcgttcctttggaggagaggcgctctgcgttttagagtttccagtttttctgttctgttttttccccatctttgtggttttatctacttttggtctttgatgatggtgatgtacagatgggttttcggtgtggatgtcctttctgtctgttagttttccttctaacagacaggaccctcagctgcaggtctgttggaataccctgccgtgtgaggtgtcagtgtgcccctgctggggggtgcctcccagttaggctgctcgggggtcagggatcagggacacacttgaggatgcagtctgcccattctcagatctccagctgcgtgctgggagaaccactgctctcttcaaagctgtcagacagggacatttaagtctgcagaggttactgctgtctttttgtttgtctgtgccctgccccccagaggtggagcctacagaggcaggcaggcctccttaagctgtggtgggctccacccagttagagcttcccagctgctttgtttacctaagcaagcctgggctattgtgggcgcccctcccccagcctcactgccaccttgcagtttgatctcagactgctgtgctagcaatcagccagactccgtgggcgtaggaccctccgagccaggtgcgggatataatctcgtgatgcgccgttttttaagccggtctgaaaagcgcagtattcgggtgggagtgacccgattttccaggtgcgtccgtcacccctttctttgactcggaaagggaactccctgaacccttgcgcttcccaggtgaggcaatgcctcgccctgcttcggctcacgcagggtgcgcgcacccactggcctgcgcccactgtctggcactccctactgagatgaacccggtacctaagatggaaatgcagaaatcacccgtcttctgcgtcactcacgctgggagctgtagaccggagctgttcctatttggccatcttggctcctcccttctctagttcttttaattgtgatgttagggtgtcgattttagatctttcccactttctcctgtgggcttttagtgctataaattttcctctaaacactgctttagctttgtcccagagattgtggtatgttgtgtctttgttctcattggtttcaaagaacttatttatttctgccttaatttcattatttacccagtagtcattcaggagcaggttgttcagtttccatgtagttgtgcagttttgagtgactttcttaaatctgagttctaatttgactgcactgtggtctgagagacagtttgttatgatttccattcttttgcatttgctgaggagtgttttacttccaattatgtggtcaattttagaataagtgcaatgtggtgttgagaagaatgtatattctgttgatttggggtggagagttctgttgatgtctattaggtccacttggttcagagctgagttcaagtcctgaatatccttattaatatttggtcccattgacctgtccaatgttaacagtggggtgtttaagtctcccacttttattgtgtggaagtctaagtctctttgtaggtcgctaagaacttgctttgtgaatctgtgttactatattgggtgcatatatatttaggatagttagctcttcttattacattgatccctttaccattatgtaatgcctttctttgtcttttttgatctttgttagtttaaagttggtttaatgttggtttgttttatcagagacaaggattgcaaccccctgctttttttttctttccatttgcttggtaaatcttcctccatccctttattttgagcctatgtgtgttttgcatatgagatgggtctcctgaatacagctcatcaatgggtcttgactctttatccaatttaccagtccatgtcttttaactggggcatttagctggtttacatttaaggttaatatattatgtgtgaatttgatcctgtcattacgatgctagctggttattttgcctgttagttgacacagtttcttcatagtgtcgatagtctttacaatttggtatgtttttgcagtggctggtaccagttgttcctttccatatttagtgcttctttcaggagctcttttaagacaggcctggtggtgacaaaatctctcagcatttgcttgtctgtaaaggattttatttctcctttgcttatgaagcttagtttgactggatatgaaattctgggttgaaaattatttttgttacaattgttgaatattggccaccactctattctggcttgtagggtttctgcagagacatctgttgttactttaatgggcttctctttatgggtaaaccaacctttctctctagctgcccttatcaatattttccttcttttcaaccttagtgaatctgacaattatgtgtcttggggttgctcttctccaggagtatcttcatggtgttcattgtattccctgaatttgaattttggcctgtcttgctaggttgtggaatttctcctggataatatcctgaagagtgttttcctacttggttccattctccccatcactttcaggtacatcaatcaaatgtagatttggtcttttcatatagtcccatgtttcctggaggctttgttcattccttttcattcttttttctctagtcttgtcttcatgctttatttcattaagttaatcttcaatctctgatatcctttcttccacctgatttattcagctgttgatacttgtgcatgcttcacgaagttcttgtgctgtgcttttcagctccatcaggacatttatgttcttctctacactgattattccagttagcaattcctctaatcttttttcaaggttcttagcttccttgcattggcttagaacatgctcctttagctcagaggagtttgttattacccaccttctgaagcctacttctgaaaattcatcaaaccaattctctgtccagttttgttcccttgctggcaaggagttttgatcctttggaggagaagaagtgttctggtttttggaattttcagcctttttgcactggtttttcctcatcttcatggatttatctacctttgatctttgatgttggtgaccttcagatgggtttctgtgtgcacatcttttttgttgatgttgattctatggctttctgtttgttagttttccttctcacagtcaggaccctctactgcaggtctgctggagttcgctggaggaccactccagatcctgttgccgggtatcaccggcggaggctgcagaacagcaaagattgttgcctgttccttcctctggaagatttgtcccagaggggcacccacctaatgccagctggagctctcctgtatgaggtgtctgttgacccctgctgagaggtgtctcctcatcaggagccaggggggtcagggacccccttgaggaagcagtctgtccctcagcagagctcaagtactgtgctgggagatctgctgctctcttcagacctggcaggcaggaatgtttaagtctgctgaagctgcacccatagccgccccttcccccaggtgctctgtcccagggagatgagagttttatctataagcacctgactggggctgcctttctttcagagatgccctacccagagaggagaaatctagagaggcactctggctacagcggctttaccaagctgtggtgggctcctcttagttcaaacttcctggtggctttgtttacactgtgaggggaaaactgcctactcaagcctcagtaatggcagacacccctccccccaccaagctcaagcatcccaggttgacttcagactgctgtgctggcagtgagaatttcaagccagtgtatcttagcttgctgggctccatggggtgggatccactgagctagacaacttggctccctggcttcatccccctttccaggggagtgaatggttctgtctcactgacattacaggtgccactgggggggggaaataacctcctgcagctaactcagtgtctgcccaaatggctgcccagttttgtggttgaaaccctgggccctggtggcataggcacccaagggaatctcccagtctgcaggttgcaaagaccatgggaaaagcatagtgtctgggctggagagcaccattcctcatggcacagtccctcacatcttcccttggctgaaggagggagctccccaaccccttgcacttcccaggtgaggtgacaccccaccctggttcggctcaccctccttgggttgcacccactctctaacctgtcccagtgagattagccaggtacctcagttgggaatgcagaaaccacccgccttctgccttgatctcgctgggagctgcagactggagctgttcctattcggccatcctgccagccactccaactcatatttttaacaaaggtgccaagaacatacaatgaggaaacgacagtgtctttaataaatggtgttgggaaaactggataactagatgaagaaaattaaactatactcctatctcccatcatatacaaaaatcaaattgaaatgggttaagaacttacatctaagacctgaagccatgaaagtactagcaaaacacatcagggaaatgctgcaggacattggtctgggcaaatatttttgttcaatctcaaaagcacaggtaaccaaagcaaaaatagacaaataggattacttcaaagattctgcacagcaaaggaaacaatcaacaaaattaagagacagcccgccaaatgggagaaaatatttgcaaactacacatatgacaaaggattaataagcaaaatatataaggagcttaaatatctcaatagcaaaaaacaaattatccaatttaaaaatgggcaaaaggtttgaatagacatttctcactagaagatatacaaatggccaccaggtatatgaaaaaatgctcaacatcactaatcatcagaatgatgcaaatcaaaagtacaatgagatatgatctcaatgaatggcttttatcaaaaagacaggcagtaatggatgctttcaaggatgtggagaaaggggaaccttcatgcactgttggcaggagtgtaagttagtatagctactatagagaacagtattgaggttcctcaaaaaactaaaaatagtactaccatatgatccagcaatcccactgctgggtatatatccaaagtaaaggaaatcaatatattgaaaagacacctgaaatcttatgtttattgcagcactatttataaaagccaacatatggaatcaacctaggtgtccatcaaaagatcaatggataaagaaaatgtggtatatatatatacagtggaatattatccagccattaaaaaatgtaatcttatcatttgcagcaacatgatggaattggaggtcattatgttaagtgaaataagccaaacacaagaagacaaatatcacatattctcacttctatgtgggagctaaaaacaaaaagtagatctcgtgaagatagagagtaggctggtggttaccagaggccaagaagggtagtggagaggggatattgggtagaaatatacagttggatagaagaaataaaacctagggttagatagatctgtagggtaactatagtttataataatctattgtataattcaaaatagctacaagaaaagaatttgaatggttctgtcataaagaaaagaccaatatttaaggttatgaatatcccaagtatactgatttgatctttacaaattgtatgaatgtattaaattatctcatattccctgaaaatatgtatatctattacgcatcaatttaagtaaataataatatgcataaaaaatttaaaacttagagttgaaatttcaatacaaaattattgaatcaagtgaaatatcacaactcttctcttaaacttgttgcatttaaacatctggttggccgggcgcggtggctcacgcctgtaatcccagcactttgtgtggccgaggcgggcagatcatgaggtcaggagatcgagaccatcctggctaacacggtgaaaccccgtctctactaaaaatacaaaaaaaaaaaattagccgggcgccgtggcgggcgcctatagtcccagctacttgggaggctgaggcaggaaaatggcgtgaacccgggaggcggagcttgcagtgagccaagatagcgccactgcactccagcctgggcgaaagagcgagactctgtctcaaaaaaaaaaaaaaaaaaaatacgtctggtaatcgtgagtctgttgttactacttttaagtatttcagtcctaaaacactaggtgagcttttttccatagattctctatttaaatgaacattttagtggtggtatgcacaaatcattaagaaagtgaaaaataattgatgtttatataaggatcctgtattaatttgctagggctgccataacaaacatattatcaacaacagaaatgtattttctcactcttttggaggctaaaagtccaagatcaaggtgctggcaggattgccatctcatgagacctctctcttcggtttgcagatggctgccttcttaccatgtccttataggaccttttctctgtgtgtgcacatccctggtatctgtttctcttcctataagactcccagtctgatgggattatggtcccacttttatgaccttatttaactttaattacctttataaagttcatatctccaaatacagttacattgggggttaaggcttcaagatattaattttgaggaaatacattttggttcataatatatccatttccagtattacctgttgggtgcatttatgggatccaacatcaataaacatttaccatcaatttcatcatcatcatcaacataaccatcaagtattttgaaaatacctagaaaatcacttaaaaatcacttaaaaattccatttgtatgtggctattacagtttatgagggaccattaggtacatcttctcattcaattctcacaactattctaacgttaaaaagtcaagattattatcctagtcttaaaggtgcaaaagagacacagaaaggcctcctcaagctgcagaaaattccctcgctgcaactgcagagaacaagagccttggaggttatctgtcatggagaggaagttccataaattgaagcaggtcaatagtcaccatctaagccaataaataaaaaatccacccccaggactttccagatagataccaaagcttggtggttaccaaggtcaggaatccatatgctgacccaatttccattcccttgtttatgaatctcccttcccctttctccatttggtttggaagtaaatggaagaagaattgaagcagaccagacaagaagggaaatagtcacttattcacaattttacacctgaaacctaaatttgccatgatttttcattggaatttgattgctacaaatttcaaagatatgctgccttttaaaatctaaataggatttcactgaatagaatacaaggaaattcaagtgactaaaattctttcacatcattattagagtataattctatttagagagatttgtgataataaactgctacttgatacagaagttctaaggattggagagatatagttgcacagagctgtgaatagaatcattttccaaaaagcgacattcataacaattccagctggggagaataaatggtacattcatgcatctacatggtcatcaccatcatgatgtttaaaaaagaaaagctgtggtgtttgactgctatacatgcatttatgctaagcgtctcttcttttacagtatctgctaaatcagtggttctcaattggacaggtaacagaagctgatcagtgagaaaagccaaaagaaggagatttcatttagctggggaaatttttaaactacaacacccactctccatatgtgccagaatcagaagcaacagaagaggaaaagcatctgtaatttgatagagctttctagaggattccactatcctccaactatttttattcttaactcgctgttttgagtaatggaggactactacttttctgacaggtcaggggaggaaaacacccattttataattgaggattttagacccagaaaaaaatattgagatcacagtacccagtttcctcattttatagtttaaggccccacattgcactagtttttatagtttaagtatagttgcacaattaaaacagctttttataatcctttgtgtatatagccagtaatgggattgctgggtctgttcacaacagcaaagacttcgaaccaacccaaatatctatcaatgatagactggataaagaaaatgtggcacatatataccatgaaatactatgcagccataaaaaaggatgagttcatgccttttgtagaacatggatgaggttggaaaccatcattctcagcaaactaacacaggagcagaaaaccaaacaccacacgttctcactcataagtgggagtcaaacaatgagaacacatggacacagagaggggatcatcacacaccaggacctgtcagcagtaggggactaggggaggtacagcattaggagaaatacctaatgtagatgacaggttgatgggtgcagcaaaccaccatggcacgtgtacacttatgtaacgaacctgcacattctgcacatgtatcccagaacttaaagtacaataaataaatttaaaaaaagaatttttatcacttaaaaagagagcttttttccatagcaaactaatctacaatagaaagttgaatccatgaatgtttatttactgcatcctttggcaaaacattactgagcaattggatatattatttctaattctgacatctactctgtactctgtgagataaatattttccctattttacaaattgggttgtaaattttcccaagatctcctaagtagtattggtggggttgggatttgaacttaggccatataactccggagcctgcactcttagccaatatgcttctctagttgctgcttgccatgtacctggttctctgttatattctgcaaatataataatgggaaaaatatcctactttcatgaagctagcataaattaaaaatataccaattattaagtatatactttcacattttgataagtaccacaaataaaaaacacaagatattataagagggaacatcttaatttgtgaggtcagaaaagagaagtgatacctaaactgaggttaagaaggggccatacacgtgaaaagaatttaaggcataggaaataacatatgccaaggccctgagatggaggagtttagcctcctcaagaaactgaaaggctgatatgagtaggatgtgggtagtattcaggagagtaatgccagaaaagatgaaaaggcaggcaaggaaggaaaaaccatgcagaactttgtattccttgttaaagggtctgaatttctctctagataggtgatgccaatgtctggggaggaggtggggcacatttcctgcttccttgatgtgtaggccacttgaatattgcaactagtttttctcctgcttattgccatctactagggtctttgtcatccccctttttctatgtatggtcttcctttccatctagactctatcatcattcataatagcttcaacacttacaagattatccactagtgattctaatttattttgtaccattccaccacagtcacccacactatggttatatcctattccttatgttttatcactggaaattgctccaccttcaaaaatctcaatttcaaacattacagttttcagtcaccacttccaaatcctctagaacacttgcttaatacccccactgccaaaattcttgaacctgatcaaaccctctgtcccgtggactccaccattttctcaccatcagcacatcttcttttctccgcactaaatgtaacagtagaaaataaaagccctggttgatgccaatatttaaggtggtcaaccaaacagctgaacattgatgaaagacatcacacaggtaaattaaccaactttgtataacattcataaccacaaagcccgctggacctttaaaacacttgcaatctgacaatatttccccacggtttttgctacattgtgaggtgactattttacatctttttctcacttttctatttgtaatgatttgtctcatttagatttcactttatgtatatggagtaaataaaagccattaaacaagagctctctcatcttcatgtcgccaaatctgtaaaccttcctgcactagcacccacttctgctccttccctcttcttaaaagggagaatgtgtctttccttctatcagagttcacaccttgtttttttgaaggccatctcttttgccttctgaagggcttcactctggcactatcccctctgtttcatatcataaatattccatttctagtgtttgttcttcagagaaaaaaacacaaacctccattggccccacattgcacttgcacttcatttcccttcttctacttctctttttagtagaacctctcagtattgtccacttcttcagccctgttcactcctctctgaaggtctaccttctggttctataagcccgctgctggagtctgtcaaagtcattgacaccaccttgttgccaaatataatcatcaattatctgttcttatattagtcctcctctcagtagcatctgatataattaaccactcctgacctgaaatgcctgtctcctttgattctacaacaacataccccctgattttcctcttacctgattgagctcctcgtcaatcctctttccaggtcctccttctccatctgatctctgattcttcctcttctacatgtcttactctaaatgtaatggttctccactgctttgtccagggtttccttatcttttctctctctctttctactctctcccagggtgaattaaatagcattcatgtactgatgacttacaattttacatgtctggcctcaacctatcctctgaccttttgacctgtatattaacgtcccacttgatatctatcaaagagaaatgaagtaagacagattttattcagattactgcagtaaagaagagagaattgagtgcaaactgatctgaactccaccaaaacaagtcaggagactttttaaatactgggatatgctttcttaaggggttggaggtcaggagtaggaggtggtgaggggttggtgaatgtgattaggatatctgagtttgcacattggtgagtataggaggagaaacaaactcttcttatctataggacagaaggaagtattgcaaattaaagcaagatgtccatcaaagttaggctctttcccttccacatgaactgagagtcagaaaaactacctccctagatgtttatatttccaagagatggctctcaggctcttaaggagagcctgagatataaacatttatgggtgaaagaagatttacttatcaaaggggcagataaaggatcgacaatggcaagttttctaaactgctccaagaaaagggagactaggagcctatggtcaggttttggctggaacaaatgataaattattttggcagtattgagctttctcaagaagactggggttatcctagggacacggtcttgggctgatagaagccactagagtttggtcaagccttttagtgcaggaagttggactaaatcattcacaccaagaattttgcagctgtcacctgtttacttaatagttgataggcatctcagaactaatctgatcagaatgcacctcttaatttcttcccagatatgaccctatcctagtttgccctacattgttgtatctgttgcctcatatttacagcatatcttttcttatccccacccacagcccagcaatcaattagcaaatttgggccctaattggtctagttattctctccctgtctactgctgtcactctgattcaagacaccatcatttatcctctaggactctggtctgatatacatatatccagtggaaatcactgttcattaggtcaaatgtccatcccaggtgtggctgggcagtatctacaggggtctgtgatgggcaggcacagtgacttatatttctaaggtaaaagctagttcatttaggttctagggcatgaactgtaatttcccaatctgtgacaactccccttcctcttacagtctccctgggcaatatctattctttggtccttctttcatgcaatactttaaaatgtaaatataaaagacaatgttgtttatcacagtttttaataggaactaaaaccccacacaaaaatatagatatgtgaacaagtaaaattcaggtatcaaccagtaaggggaactccaagaggcagtttcagggtgcacattccaacaggcccttgtgtactcaccaggcctacaaacagccctactgtgtacaagacctcaaagggataaagatattcatgtacctagaataagccttagtgacccatatgctagcactgctaagcatcactcaaagactctatctgtgataattcagcattgccttccaagtatggtctgacttcctcttctatgaccctggaatctgtttttgcaattgccagtgatgatgaataagtgcataggctacagtgcatgtttaaggcatgctttaaaaagcacatcattatttcaaaaattttaaagattcctaaaagagcatcctgtgtgagtaaatccccataacaccttgattgttaaatgataataaagctaattatcattcacataatctttgcatttatgaattctaatttctacagtgaataacacttcatcaaaatagcttctgacaattggctcagttggaagaattcatctaaacacttaagacaaaaaaaacagcttttcattgtgttgacggggttttgagccttagtcaaaataattgagatagtacagataaaaaaaaaaacaaaaggaaagacaaattggaaattgtgtttgattaaaatgtaaatttcttattgtagtgatgttcttatttatggtaacacattgtagcacttcagtttggcagcatttgttgacctatctctgttcagcagctaaaacttaacataatagatgcaaaattgcttctttaatttacattttcaaaagaaataatctaggtcacttttatgttacttgcatgtaaaatcaactcctttaacagaaagcaggcatctttgaaaatattgccaattttctaactcagagtatgaagattataaaagtaagaactctgcatgatttttaagctaatagctagttcttacttcttgagacacttattttccaacttatggatctaccagattttcagttgcttttctaacttgttttctactgcctttgggtgatttcactgtttattggtagctaattcatagtaaacgaaggcattgaggtagaaggcaaactcagtcaaattcctgagttttccagtaataatttcattggaattaatagctgataggtggtttgttcatttacatgtacccaatttcctccatatctgcattgatccttggcaaaaataactgagaaatgattatagtcaagaagagcttgctcttacgaagttaatacacattcaccatataagccagcaatcttcctcctagacatttaaccaagagaaatccaggcatatttctacacaaaaacctgtatataaatagttacatcagctttagttattaccactaaaaaccaaaaaaaaaaaactgcccatcaactggtgaatggataagtcagtagcatctgtatgattcaatttaaatgacattttggaagagacaaaactggatgaaaacagatcagtggttaccaaggactgtgagcctggaaggaggataactgcaaaaggccatgcagaaccctttggtggtgatggaaaagctctgtactttgacttcagtggtggttacagaacacagcaaacatttgtcaaagttcattagaactctatacacgacagggtgaactctactctacatagattatatctgagtaaacttgctttcttttaaaaagtacagaacattgtttttgatcttagggagcttacggatggtaaagaaggcaagatcagagaaaaatacgattcacaataactgaatatgtatatatatgtgtgtgtgtatgtgtgtatatatatatatatatttaaagtagaagatcttacgagacatttgctgttataacatccccttgtgtgatttctcttgggtttaattatgaggtaaatggaatgtaaaattaccatgtatgaagtcatattttctgaggctttgctaattgtggcacttcaacactcaattacttttgaagcgtgtgagaatgaaaaagattgagttttctaattgtggttggtgaaatctaatcaaattctcaggagtgaaaatagatttttgcatcagtgagacttgccttgtggaaagaaagggtaatcttttctagggttaatcttgtggctgtacatgatgttactttatcacagttatgcagttgtcttatcacttatcacggaccttcagtgaaatcactggcaaaaagacccaaaattagtattttggatggatgacttccaacttttaactgggttatagcagatgctccatactgagctatgcattcaattatataggtttttctttcattttcacaaagtctcctggaaccctggtgcatgctgtcttgattcaccatcacatagcagtgtagatcagtaatctccatttctccaaatgcatttcaatacttctctctccattcccatctctctgggccctaactgataattgaactcagaattgcagctctcaaggtgcttgcaaagggatataatctgagttactcccaagcaataccttccccaaaatcaggcaaagaagatcatctatgaaaattgcctcagtgcagcatgttccaaaccctttaaatagactcacactgggaggtacattttgcatcatgaccctgtacatacaatggaagtaaatattaacatatttctcaaaacactctgatttttcaaactattcttgtttattatatttttttaagttggttgcaacgctctgaaataattttacccactaacagatgcaaactgtagtttgaagatcactgccataaaagatataaagtttagcattcatctaaatattatctaatctaaataatagttcactagggggcatttcaccttggccactttaaaagtacccctctaatcccccacccccatgggtctgaattgcttttactgagttgtactttggcttgatgctataaggcaatatgagaataattcctatgttaattgctgataatgctattgagaactttgttcactacactacacagtctcctctctctaaggaccaagtgtagaaatctttctgttgtccctgtaaggaataatggtgattaacctaggataccagattatttctccttatgaaaaaacctagtgtttccttactcacattgccagttagaagccctagttttgcatccactgcctacctctaacaagtacttggggttttgtagctacaatttgaggatttaatctcactcctaatttagttttactgtcctttattttttcctttgtgtcacatgtcttgctggtctaacattcattttaacttgttttctttttaatatctttttgtgtcactttaaatctttgtgaaacaaaagagaaaaagataaagaggaaagagcaaaggaagagagagagaatagtttccatgtatagcaagaagactcaaggtttttaggtctttattccttacattttcaaactaaaattatatgaaggtacaaattcagaacactttgtcctacctgtatcagaaacaataattataagagaaaccattttgttgatatcttaaagttaatattaaataattttacagctttactgaagctatttcatatgcaatataaacaatgcctggaccagtaaggaacaacttcaggcaaaatctgtaattgtatatgatttgccataatgccaaagagtgcagtattttcttcatggccaagaaaagtgttgaaacactatttggtgcctaaactgaaaagagagtttcttctgaaagaagcaaataacaggcatttaccagtggccaaggtgactgtggcttcaaatacatttctaagtaacgaaatgtcaggatattagaagacagataaaatcaaccatgaaaatgtgtgtttggctctatttttaaaaaaaccttcttgacgtagttcaaaatgaaggaaattatttggtgacaccaacaatgaagtaaaattaattttttgatgatgttttggaaaatcacattaaagttagactttttaaagtaacacccaagctgaaaagctgacttattaagtctatattgattgagtaggtcaaatattaatatccatcccactatttttgagcagattttatgctcttactatactgtgtttgttaatttcaggatactagtacataagtaatcaatggcaacaccattttctttaatagcctgtctctaagagctaaatgaactattctgatgctactttgactttactgtttccccttcctaccctcgatccagtttttcatcacaactacatggttatatcaaacagtgacaaaaagcagacagcaggaacaaaaataatcgtatggagcagtttaaaaacagatatttgtacatatttggcaaataggtaccttttcattaggtaaacagtagtaggaaaagagattgataaaaggactgtaattatgacatacaatatcagattaattatttgaatactttatctccatgtataaggaatagtctatgtatgactaggttttagttatgccaagaaattaagtaataacgtgacagttaataaataactttgttgaagaaagatctagtgaaaagggattgcttccaccatcctatagcactctctttttggaatcatgcctctgtgctcccctggtttacctcccagatcttccagtcttctttgattgtcacccttcagtctctattggctttggacctccctcacttcctcaatccaacctctaactgggagtctgtcagcactaagttttggcccacttctactcataatacacactctccctggatcatcctagctatcactggagctttacacaccatctacttgtatcccaaatgtacattctagttgcaaccattcctatgcactctatcataatcattcattctgttaatatttattcaattattgggtgtccacaatatactaggtattatcttgggtactggagatataatggagaattgacaaagtccttgccttcatggggcttatttttaagtgggcaatcagatcataaacaaaataaagtaaaatattcatatatgttggaagcattcattgctgggggaaaaaattaagcaggatatggggagagagtgttgaagttgaaggtagaagccattctagttgagtgatcagggaggaatttctgaggaggtaatatttgatcagagacctgcatggagtaaaccataagggccaagcaaagatcatggaaagaggctatctagcacaaggaacagtgagctcaaatgttctggaacacgaatagcatggtgagtttccatgatgagtaagaagacaaatgtacctgaagcagagtgaatgagggaaagaaagcaggcagatggaatctgagagcagaggccgaaacaagacttgtcagccattataagaactttagattttattctaaccaggatacaaaaccaatagagggtttgagcaagtgaatggtgtgttttgaactagttgccaacttgctatctctacttgaatgtctcacaggtatttccaacttaacatgctccacacagaacttttaatcttccctcaccaaaaaacaaaatataatcatcctactccttcttcagttttcccccattttagcaaatgataccaagaactatccaatttttcaagccagaagcttgcaaaatcattctgaattcatctatctcctttagctctcatagtcatcccatgctaggaaaaaaaaaagaaaaagcctatactttttatcttcaaaacagatgactcttctacttgcttctctgtgcatctcacagagaatgtcaccaacctagtccaagctgtgatcatccctaactcatgtttctaaatcacatcacaggggacagatcttttataattttgactttctattaatagctttcccatgcttaaaggaaaagccatcctctttgccatgatctacaaggccctgcatgattagttccagggccagtcttttgcagtttcacactactctttccaaccttcctgtgctccagccacactgacctttatcatttcctcgtacacatctttctgaccttagggcatttggcttactactctaaatcactctctcacggctggctgtttcttattccttccatcttaaccaacatgtctcctcctcagggaggagttccctgtccacccaatccagagttgtacttccctatcattctctatcacaacatcctgtctttttactttatgtcacttctcatacttcataagagcagagaccatgtctgtctcattcaccattgtgtacacagtctcagaatcatgcctggtgcatagtaggtacttaataaatattgaatgaaggacaagttagtattgatgtctccctgtgtcatgaaaaaatgttagcaaacatccaagatcacgtatcttttttaaaaaataaacatttttctaaaacaacagctggaaaaaacaaaattaaagaattaaatcttattacctattttacttttatgtaaactcggttacatatttccaaggaggaaaaaaaagattctaagaaataattaaaagtagaactaaaatagcagcaattttttgaaaaccacacatttcatgcatcaaatattttttgaatgaaagggataacatttgagtctcttctgtgtcctagataccatcctagacatgttctctatctcataacactcatcctcacaaccatcctgtatcttagaaaccattctgcctaattaatagatgagaaaactgaagctcagaattgtccagtgacctgcctaagattatacgaccaattaggacagaagcagaattcaaattcagctgccaattatgttgcagataccatctgaaaaaattctatttttttctaatcataatattttaaaaatcaataaatgtcaatgccatttaatcaaaacttaaaacattgaatgagaaaatgttttactctgacctacagcatgaaaagaaaaagtaaaataaactctttgggcaagcacagtgcagaacccgtaacaggtcaatggctgtttatcatttcaaagatttctcaaattttggttatgggtttctctatcctaaggtaaacattcttttcattaaacctgtaattttattttttccttgtatgaattcccttgcttattagtttctttaatagtaacgttcagtgttttaatgacagttagtacctattagcattttttgtaagatttttttcaatggcaaatataccacctatatctttataagttagtcttccagtagccattgaatgtatgatagaaataatctattattttcctgaagctgagtttctatttcctattcttgttcagtgagctcaaatatgcatataaagtatacatatctgactgcccaagaagggtgcatcttcctggcatttcattattctgaggaaaagatgtcatcaataacccattatgaattaagaattacatctttttctaatctcctcacagttcctgaaacatggtggcacttaaatattatttgttgaatgaatgaataaatgtataaatgactgacagaatgcacatgagcagatggaagacatacgtggatttttactttaaatatcaaactctccttttcagccagaggctatcgacttttttagaaagttgttccttttttaaattcttaatattttatcatttaatgcttaaaccaatttttatcttatagcttcatatccactataaaaacacttcttatttattatagaaaaaaagaaaatatgtgtaagagacagaacatagaaatcatcaataatgcccttcttctcccacacatagccaaataatctacaaattaaaaaatagcactcagtactaaaaaatagtattcagcatttaaaaagaatgacaaattatttcttatctaaaaatacaatattaaacatacaacaaacaattaaaatgctcctcttattttccaatttggtatttgttaatcccttattggcaataatatctgctgtgttctatttacaacttactatgcataatatactgatatactgagataggttttttgcagacatggcactgtgtgctcttcataaggacctttaaaggaagtaccattctccaccatttttaaaaatgaggaaacaaaggcttaggaaggttaaacaaaggcttagaaaagttaaacaatatagaagtaattcaattctgacatgaggtgcagctgggattctagcttaggctagtcagatgctaaaatctacactatttccccacagtacttggctatctatattaagtagaactacatgatattgccaatattcaacgattttagacattaaaaatggaaattgcatcttattctatttgacacaaatataattcctttccattattactctagaatcaagtcccatgacttgcacaggcatcaaaatgtcaggttaaaagcaggtctgagaggatggggggttcaaatcctggcttccccggtgactagctgtgagaccctgagcaaatcatcttcactacagggttatttttctgttgaaaaaaatagcattgcccttccctgcatacttcataggaattcactaagagaaaaatagaatatacaaaactgtaaaggatataaaacttaaagtgattattataaacaaaccttctaaataaggaaaccaacaagccacattcctaagttacaaatgtgaaagaggagaattagaaaccagtgtataaggccctaaagagccctctacagtgctgtttgctcagtttttgataagagtgtcaaggccaaagccaatccttcagaactctgtggctagtgattctgatagcaaggatcaatagcctaaatgtcaaccagatgattcaaagtgcttacacaaaaatttggctttatatgcaaaacctcatccccattcctggaaagagctcaaagctgtataagaaattgttattggtatactatgtaaaagccctaattgagatttcaagaagctcccagctttctgagcatcctacataaatccaaagagaaagaaatattatttccgctggcaaaatatcaaatcccaagaacatgtgcctaacctggaacaggcttctttaacaaggacttacaagaactctgagctgcccttgaggattcatcttttcttttcttttcttttttctaaacaaggtcttactctgtcgcccaggctggagtgcagtggcgtgatctcggctcactgcaacctccatctcccaggttcaaaagattctcctgcctcagccttcctagtagctgggattacagggacctgccaccatgcctggctaacttttatatttttaatagagatggggtttcaccatgttgaccaggctggtcttgaactcctgacctcaggtgatccacccacctcagcctcccaaagtgctgagattacaggcttgagctaccacacccggccctcttttctatgctttctggaaatggcagttatacagcatgagagactctttcccttctctgaaaatatttttccagtgtgatttatactcaagaagatttttcttccttccaggccttttggaatgtaagataacatgagttatcatattttctaaacaataaagcccgatacaaatggaaggaatctttatgatcacttcctgagttagacatagaagccacagttctctctgtacccttcatccaagcaagaatttaaaggagaactcaacacataagttatataaagatttatattttttatttctgctgcaatagaagaagatgtcttcaactattaggtttatataactaaagaatttgtatagcatattgatccaattttaaatctggtttgaagttggcatatgagcttctctcgttaaataaggtaagcatcaaaactcctgcatatttttttaaattcctaacttgagtccattttctctacatgattattcagaatattttccactctattaacatctgtttcatgcttgccttcactacccttaccaatgacctcgcctcctacagtttcttctatggtaatatctcccctcccctacctgtcttctcctcaactctcctcagaagagagtgggaatttcttcttttccaaagtggactcttccactgggggttccatttatttctatataccctctcttccttttctcctttatcttcacacattcccttcccatcagatggaagtcttccttatccctaagaaaacaaaataaactagaagcaaacaaaaaagcaaaataaaaaatgtacctccattttattccccctttgagttaacattccatgttacatattccttgatatcaagcccttaaaagagttatggacactcatttcctgaacttcttagccacgtgctgttaaccctgtaatatgattcctatttacccctttcatgaatcttctaaaagtcttgtctcagagatctttaatgcgctcctaattactatctaattaattttctcaatcgacaacctacaggacctcttggcagcctaacattgttgatcacatcctcctagatattatccttatggttaactctttgaactatcttaacgctaattcttccttgacattctgactctttttaaagtttttcctttccatttcctcaccccctagttactgatttttcttacagttgcatttttagattatgtgtattttctcattatacataatcacacggatttgtactttaattatcctatttgtactgatcatttcaaaatctttagtttgtcttggcttctctcctaagctccagatccaaatttccatctgttttggacatggtgacacatataccacatatactactcctcagactcaacacatgtgattaagacgttgggttcactagcagacagaagacacctcaaaatctgaccctacttttttataagctgtattactttaaagaggaattagcttctctgagccatattttctcatctataagtttgtatttacagatgagaatgtgtatttatagatgagaatttatacttacagatgagaatatatggcttggagaagttaattcctctttaaagtaatacagctcatatattatatctatatattatagacaataaaaaggttatgaggattaaatgagataatacatataaaatgcttagtataatgctaaagtcatactcagtgtttaacagataaactgccactattattattattattatcatcaccatcattttctagtttgaatttattacagcccagctgcctctcctcctctattcttctctctctgaatagtgcaacactctcccaatcatactttctataattctcagagcctctagaattctctagaatctttatctcttcccttttcctctaacaaacccttatctaatcagtcagtacattgtgtcaattatttctctacactgcctctcatacccacagcttcctatttattccaacagaaatcgtgcagtccctatttcagtccttcacccctgctgccttgcattattgcaattgactcctaactggtcttcctaaacccaccgccaacctaacccactattactgtctaaacagcaagtgctcttgttcctccataatcagacccaagttctcctttatcctccccacctcctgagccctcctgtacccacctgagtgtctcttttccttcctgggcttcctgccttatgtttttgtttacaccatactcctaacctgcaaactcctttcaaatctgactgtggaaatgcacatgcatttactagcccacctcctccacgaagccttctccaaagtgcttgtgagacacagcagagactttcctctcagtggcctgcaggcctcccaagcatggaaataagggaaaatattgagctctttcaagagaaattgcaggtacctagctagccttgagaagttaagcaacttgataagcatgaaggtaaaatagtaacctaaaacaatagccaaggaagctagaatcacaagatgtttggttccccaatagagactaaagataacatcttcacatatgtctctgagtttttttttcaggaacccagatccccaacaaacaactcgtccccacagtagacctcagataaaagggaactggggactgaactctgaccgtcattctttgttctcagtttcttcctgaggagcctgaagaaagtcacattcatgaaccagagctaacattcttttctgctgaccccaaattttcaagcaaagcttctcttcattaaccaatggcaaatcagaaaatctttgaatatacctatgacctgtaagccctcacttcaagatatcccacgcttttaggtcaaaaccaatgtgtaacctccttatattgatttatgattttgcctataattcctcctttcctgaaatttacccttgcctttaaaaacccttacctgcaagccatggagaggagtggggtcaggatttaaacaccagctgcctgaacctctttgcttggagccctgcaaataaacaccttcctttctaccgctgcaaacctcggtatggacatttggtcttactgtgccaggcaagcagaccctggttcagttctataacactcatagctaatattacctgaaaataaatcaaaaccctaagatgtaatgacagtatgatctcaatttatatgtgtacttgtatatgatatgtaaacatactgaatagaaatagggcaaaatgtgaacagtggtcctttacaggtacgataatctggagatgtgctatgaatcggagaaattcttattttgttttgtattttctaaattattcaaaagagctaatatttctatgtactaaaatctttatatgtattaactcatttaattttaatcaaacccgctgacgtatttgcattattgtcctattattgaggtatatgggggtgaagcaacatgcccagagccatgcatctatcaagagtagtctggctccagacctgtgctcttaagcactccactgaattgtactaagggttttaataattggaaaaaaaaatatttttaattaccttttcttctgtctctgacctccacctactcctaaccctgacaccaccaagttccaaattttccttccatttccttcctagagaccaatctcagctaggtgttaagaagaaaagctatctgattaagaaaatttgcatgaattgttaattagtaattgccatcctaaatcctaattgcatcttaaaaagggtgcttgttaacataagtgaatccctaattagtggaatttctgttgctatgactaagcaattatgtctactactgacagtgtgtggaggcgaggaaagtatcttggaaaagaggattttcttcttactccttaaagtttaaggctgcctcatgtacaaggtctccctcagtctctcaaattcatccatcttcccacacaagtttggtttaaagcaccaataagccctacccttaggcctatgtaaaagcctatcattctgatgctgcagaagccaccaagaaccaggctaagaaccaaaggtcaccgtttgtgacacaggagtcttcataggaaatgaagacccaaagaaacacttaaacccatatgtttttttatagtaggtttgatgaagagtgtacagttgcagagaaatataatagggcaaagaacatgaggtaagtgtaataaacaggaggtaatttagcaaggtctgtttgttcagattcctcactgtatcccttcatcttccaagataaagatgctgttttcctccaggtatagggtgggcatctctcacatgagggtcttttgacctgctttagaggaaaatggaagagggaagtcagagagctcttccttcttctgtaaatcccttcggcttaaaataattcatatgcccaggtgctatatttttataactggcaaaagagtctggctgctcgctgcttgtagaaagaagccaaaataataacaagatgtgatagaaaggaagcaaaactttattttgctagcaaggggaagagtaggcaaaaaaaaattcgcctttaacttggggaaggaacgcaggagtttttaaagagagggtttggggtgcagaagaggcaggggttgggggagcgaggaggtcccaggtggcatgatttgctctgatggctcatcttgaatgattgtccccatctggtgaaggggcccatctgatgaaggggccaacaccaccatgggcccaaccaggttacaaattaatctcaattaatcttaccttggatctctagctgggagtgtgttctggccttgaagtaatcttttgttggagagagaattccagaatatctggtctgtatcaggatccaatacctgaagattctaaggaaaaatatgaccagataagtaagaatggtatatgcttaataaacatctacataaataaatgcatataaggtatgggagcataaagtgccaaagggaagggagtggagaaaagaaaacattttgaggctgtaaaacacatttgtactttatctcagagctacgtcttgaaactggggggaaaggaggaaagggggaaaaaatttaaaatatgatttgaggctaagctgctaaactgctcagctacattttggggtagcatctcctgaaccccactgtgatgtcaacacacataatcaagagggaaatgcaatgaaaaaaatcatattccttcttccttctgccagtttggaagagagctttgttgtatatattcaggaaatttgacacaaaggcaagaactttgctctaataggcttctgcaggcagcaccaaatctcagtgggaagagaaggatggctggatggtggcaaagctgaaagggaatctcagtcattctaagattttacatatccagtggagtcccaaaggtgggaggggagaaaatctagaagcaagtataacccacagacttgcataccacccctccccacccccaagaaaaaggaacaccacaacagggggagcagatgaagtgaagaggttggacaagctgaagtcacccagaaattctgaatatctaatgcacattttctcctggcttaatgtgtgacattcatattatccaatagctttctgttatttaaaacttttaaggaagttcatagtgagaacagctatggcagagatacttgctgctcatcaggcattctttgcttccctacatttcccacccccttgcagttaggtggagccacacgactagctctggatgagatgttacaagcagaagtgcttttgtcactgcaggaggaggcacttaaaaaccagcatgtgattcttggctctcctctcctaacacatagactgaggaatctacacgttccagatggtcagctacaacatggcagagcctccattaccctgggcccctgtaagaccatgcagagaagagtcgcttcccccagtctcccatccccacatagctctgactgcccacactgatatgcagaatggacaaaagagttttgcataaacttacgttgtgttaagccattgcaatttgggggctgtttattactactgccatggcctatctaatcttgactgatacagtggttgcttgtggaaactggcatagatggtctacacatacaaagtatgcacaaataaacacacacacacacacacaacatacacacgtatatctcacagaaaaaaaagttgactgttgactggaaatttcaccatggagaaccccttaatgaaaagttgcaggtttaaagagaagacagccataaaacagcagttcagaaaacacgtgctggacaatatgggttcagatgtcaattctttcacatactagctaaatgacgttgggcgtgttgcttaacatctctgggtctcagtttcctcaactgtaaaatgagtacaagaatagcacctacctcagagatttgtttgggggggggcacagagtaagcactcaataaatgctatatataactaataatcttaaagataataagaaaggctgaataataaatgcattcctttaacatctctctcttacaaaaatggaggtaaggctgaagattttttcaataactgataattattatgatttatcatttatgcatctttttctttgttatggcttacatttccaaactcagaatcaactctctgcttcaaaaaaatctaacatgactatagtcaataactttattatacattttgaaataacttagagtgtaattggattgtttgtaactctatggctaaatgcttgaggggctggataccccattctccataatgtgcttatttcacattacatgcctatattaaaacatctcagtcatcatataaatatatacacctactatgtacccacaaaattaaaaaaaattttaagtacttttaaaaatctaacaggaccacatttttggattacaaatattttagcagctcttatcttttcttttataaaagaagtacatcttttcagaaaaaataagaacaagtgatagtgatttgctatgccacttaatgattatttccagaaaagattacagcgtgtaaaagattgcaataagaagaaagaaagagtgcagtttcaaataaaggtttgactctgaaatgggggtaccaaacattcataaaagtcagttctctgacttactgtcacacctcaaacctcatatttatcaaaaccttcagcactgataaagcaatcaaaatgaaaagaatgcaacagtggtcccaaagttgtgtcttatctaggtgttaccctgaacattatttcaactcttcttacctttgtgactctgtttccacattggaatgagagtgaaatgattttgcttctaccattgtagaaagctgagaaattgaatcaagactatgtttcctgacgaaactctaactgtaaaattacgttgattgatctttaggcaccaattaaggtgggtataacctcaaaggcacttggcattccctgtatccaaaatgtctctcctactggtaacctcatcttataccatcgtaactcactcctctccaaagactattattttcctcattaatccccacttatgcccagaaataactcatcatccttcccaccatgccctctctagagctgtacggacttccagtatcatcctgtcattacagaacatcacagaaattgttgtccacatagttgaatacatagacaaaggattagaccgtatatacatgatgctaattcattttgcctatacagctatttcaacacaacagccagggtcttttgttttaatgaattttgtttgagttctgttctctcattaaatagtgaggtcctagaggacagacagcaattttgtgccatttacccttgcaagccctcacattatctaaaaaaaagctttatttgctgaaattaaatcatcaaggcaggcataacaactaagttactcattcagtaacaagtgaagttaggtcctcattgtgtcatgtgatttgaatatttattactgatataaccagtatacttatcattaattagcccagttcatcattgcactgtgattctgaggctaagcacagaggtgttcaattaagcccaatagatcatcaaagtatcatcaaaactgcaataatcattctggagagccagttttctgtactactgtactgctgatctatggattgtgttaaaactgtaaatttccaaattcccattaaaatcctagttttcataattgaagtgtcagcatcaatttcttagcatcaacatttccacaaacccaaaaacttgatatctatctctttagaaacctaaaatattaaaatcccccacaatttttatacgatttttgccccctctatcatatataataattctgccccttgcacacacacactgagatactttctgaaatactgagaagtcacctatgatttgccctctgtataatctgatatgaaagtaatgtacaagcagcaatctggttctgtctccagagattctaaaataatatccaaacaccattcactcacagaaacgtaatgtgctcagagttttctttttcttttgtttctttcatgtcctctcagtattaaatgaggagagacaaccccacaaagcctgatttaacctctcatgatacagctgagtaaagctgctcattagactcaaaaaacagaatattatcaccactaatcagccacaagaccttgggtaactcctatcacatcactgagcctcagtttctcacctgtaaaatcaactgaataccttccttctttactacacaaagggtttttttgaagtagacaatatttttgaaacacacctcaaaaaataaatggcattaagtgtgcagagaggcaaaaaatataccaaatttttttattcattagaagtttagaatttctttttttttctttttttattattattatactttaagttttaggatacatgtgcacaatgtgcaggttagttacatatgtatacatgtgccacactggtgtgctgcacccattaactcgtcatttagcattaggtatatctcctaatgctatccctcccccctccccccacccgacaacaggccccagagtgtgacgttccccttcctgtgtccatgtgttctcattgttcaattcccatctatgagtgagaacatgcggtgtttggttttttgtccttgcaatagtttactgagaatgatgatttccaatttcatccacgtccctacaaaggacatgaactcatcattttttatggctgcatagtattccatggtgtatatgtgccacattttcttaatccagtctatcattgttggacatttgggttggttccaagtcttcgctattgtcaatagtgccacaataaacatacgtgtgcatgtgtctttatagcagcatgatttatagtcctttgggtatatacccagttatgggatggctgggtcaaatggtatttctagttctagatccctgaggtatcaccacaccgacttccacaatggttgaacgagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcatagatgtcttctttcgagaagtgtctggtcatatcctttgcccactttttgatggggttgtttgtttttttcttgtaaatttgtttgagttcattgtagattctggatattagccctttgtcagatgagtagcttgtgaaaattttttcccattttgtaggttgcctgttcactctgatggtagtttcttttgctgtgcagaagctctttagtttaatgagatcccatttgtcaattttgtcttttgttgccattgcttttggagttttagacatgaagtccttgcctatgcctatgtcctgaatggtaatgcctaggttttcttctagggtttttatggttttaggtctaatgtttaagtctttaatccatcttgaattaatttttgtataaggtgtaaggaagggatccagtttcagctttctacttatggctagccagttttcccagcaccatttattaaatagggaattctttccccattggttgtttttctcaggtttgtcaaagatcaaatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccacatgaacttgaaagtagttttttccaattctgtgaagaaagtcattggtagcttgatggggatggcattgaatctataaattaccttgggcagtatggccatttacacgatattgattcttcctacccatgagcatggaatgttcttccatttctttgtatcctcttttatttcattgagcagtggtttgtagttctccttgaagaggtccttcccgtcccttgtaagttggattcctaggtattttattctctttgaagcaattgtgaatgggagttcactcatgatttggctctctgtttgtctgttattggtgtataagaatgcttgtgatttttgtacattgattttgtatgctgagactttgctgaggttgcttatcggcttaaggagattttgggctgagacaatggggttttctagatatacaatcatgtcgtctgcaaacagggacaatttgacttcctcttttcctaattgaatatcctttatttccttctcctgcctaattgcccgggccaaaacttccaacactatgttgaataggagtggtgagagagggcatccctgtcttgtgccagttttcaaagggaatgcttccagtttttgcccattcagtatgatattggctgtgggtttgtcatacataggtcttattattttgagatacatcccatcaatacctaattcattgagagtttttagcatgaagggttgttgaattttgtcaaaggccttttctgcatctattgagataatcatgtggtttttgtctttggttctctttatatgctggattacatttattgatttgcgcatattgaaccagccttgcatcccagggatgaagcccacttgatcatggtggataagctttttgatgtgctgccggattcggtgtgccagtattttattaagggtttttgcatcaatgttcatcaaggatattggtctaaaattctcttttttggttgtttctctgcccggctttggtatcaggatgatgctggcctcataaaatgagttagggaggattccctctttttctattgattggaatagtttcagaaggaatggtaccagttcctccttatacctctggtagaatttggctgtgaatccatctggtcctggactcttttttgttggtaagctattgattattgccacaatttcagagcctgttattggtctaatcagagattcaacttcttcctggtttagtcttgggagactatatgtgtcgaggaattcatccatttcctctagattttctagtttatttgcgtagaggtgtttgtagtattctctgatggtagtttgtatttctgtgggattggtggtgatatcccctttatcattttttattgagtgtgtttgattcttctctctttttttctttattagtctcgctagtagtctatcaattttgttgatcctttcaagaaaccagctcctggattcattaattttttgaagggttttttgtgtctctatttccttcagttctgctctgattttagttatttcttgccttctgctagattttgaatgtgtttgctcttgctttcctaattcttttaattgtgatgttagggtgtcaattttggaactttcctgctttctcttgtgggcatttagtgttataaatttccctctacacactgctttgaatgtgtcccagagattctggtatgttgtgtctttgttcttgttggtttcaaagaacatgtttatttctgccttcatttcgttatgtacccagtagttattcaggagcaggttgttcagtttccatgtagttgagtggttttgagtgagtttcttaatcctgagatctagtttgattgcactgtggtctgagagacagtttgttataatttctgttcttttacatttgctgaggagagctttacttccaactatgtggtcaattttggaataggtgtgatgctgaaaaaatgtatattctgttgatttgtggtggagagttctgtagatgtctattaggtctacttggtgcagagctgagttcaattcctgggtatccttattaactttctgtctcgttgatctgtctgaagtttagaatttctaaatggtgtaaacaacaatgtctaagattgctgtattaatgaatgaattactctatgagaagcaggatagcacaatatgaacctagagtagataaattgtcttcgataattgcttaaaggccagggtgagtcagggatgggaggattgttgacaattaaatttcaaagcagagaggagatcttgagctatgattttaaacagaggagtgtcgtttggtaatgaatgattgtctcatacttagagaagatactggctttttttaagccaagaaccacatggttcagtctcagcagtataatgagaaaatatagtgcaacagtaaaatgtcattttaaaattaactcaagttctttatatacatttcttgaacactgtgaagggtatgtgtagaccaaagcaaaactttgttaaaactctttcttcctttctgtttaccccccgcttctgacactaccctcacataccataacagtccttgatttaaacactctggagaacattttttgttcatctgggaatcatctaccctggctagatatcaccataagaatatcactcctccctcctgtcatgaagctggaggtccaagcacctgcatgcacagcccccatgctgccaccaccaataccaccctcctgcaagtatcattggtcttcaactcctaataatttgttatgataattgtgataaacatctcccttgctctctccatttctgcaagagtgggaaaaggttgtaggcacttttatcccatcatatttatttaaggttagatttagtatagtgggtttgaagttctaaatataggggggaatggaaaggcagagaaagctagcttgacattcaatgggaaaatgtgagcaagcagccaaggcagggttgatacaaacccaggagccatgatgaagacagagaccaggggctctctagtttatctggccacaaatgtttgaatgggaaggttactgaaaagtagccaaacccagtatcagacttcaaaattaggaatgaaaaagaaatgtgtatgtgagttatgtttcctacgtctcttgagcatgggtcttaagagcttcttcaggagttccagcaggggaaccacagacattcaaatatttttaaacaaagtattgtgcttctctctctctctctctgtttgtgtgtgtgtgtctgtttgtgtgtctgtttgtgtgtctgtgtatgtaagacttacaaaacatttaccatttgccaggcattattcttagtactgcaacactatgagagagtactagtaagatccccttttttcagatgacaaaactgagccactgaaaaattaagtaactgacccaagtggtacagctggagggctcaagcacaggcaatctggctccagtacctaagcatttagacactacattatcctggctcctaatcaatggcactgtcttgggaaggatgcaggtagcacagaaacatacttaaggagtagaaagatgaggatatattcagtcttgttacaaaagccaaaggagtagtaatttcaaggaggaaattacaaaatatgtcaatgtgcagaaagtcaagtcaaaaaaggcctggaaaagtgtctgttggatttgacagtcaaagagtaactgttggcctgtgccggtccagtttacatggaatagaaggaaataagctagagtgtccacagtgctggagtgtggagaggttttactcagatgggaagaaacagaggaaggagaaatgcattccctcaagatggagagttgtaatgagacagaatttcttcccttctttttcttctcttctccattcttaacacacttctaaagaaggaaagacagaataaaataatggtgcagatcataatgaggcttttagtggtgaggacatgggtacatggaaggcttaagaaaaatgctctgtttgtaagacttttcattaaggatagactgaagatcggcctgtatctgtaacagagaagagactgtgaaagttgatcatacaaatggggtcattcttgtcctatacaactaaaacagagttgagatgccaggggccaggccgcagggaagcactcagggcacagaacattactccaagaatgtatttctccacaagcctggctgctgaaactgcctgctgcaacctcaaatcagttttatctaatggctactgaaacaactgctacaactctaagactagttttacccacagctgtcactcaccagtcagagcttactagcccccaaaactttattcgtgttcatgaactttcttacaaaacaatacataacattctcttttttataaaacctccaaccttctatttcttcttcagacataccaaagacaacctggtctgtgtgtatgtatgccccaaattgcaattctgtcttcccaaataaaatgttttacatttagagatttgtctctatattttctttgacttcaacaagatggaagaggggagggaggaatgagcctactacatagagatggtataccacaaaaaccaggagggagaacagggcctgaacttcctaggtaatacaaccagattttgacccatgcactgatcaaatctttcattaactgctgagatgaggtaaacaaccattagcaggctgcagtagaagctcagtttaacctccaggaatcagtttccacaaactaaaaaacataagagatttaatcatctctgaaaccctctgcattttttaaattctatgaccttatgagtattatccgagaatggccatggtcaaagatatctgaattactccataactgtaactccccttcacctacattggtttccatagttacagggatataaaataaagtcactgttgaagccaaggcaggacctgacactaaacttgtcaaaggagagaaaacatcaagttcaacatctgtggcattctttctagctcatcctgacacattttggcagaaaacttgaactgccacagttcaattattcagaatgtcagcctataaaaatccaaacctaaaagttttattaaagccatgatctgctacaaataataatagaaacttcatttaaaaaaactttatttgctgcctagttcatttaatgatgtgacataagaaagcattgtatattgcaggacttctgacactgacacttaaaatgtctgttaaaaaaaacacaacaacttgcctcagacacaggccatgtgtttcaccaaaagttgccaggaattagagaaaataatcaaagtagggaagagaagtttttgttcactgtttttacaggagcactaagaatacttgaatgccaatgatggaaaaaaaatggaaagaacctcttctactcactgttgaaatgacctttctaaatttcagggcattaaaataaataagatatatgctacatagcacaggaaaatgtttaaagcaaaagttcactttttgtgccttcatattactttgaaaaatgccagggaagagccgtaagcaaagtgataaatgcctactaggtttgattaactagatttttttttttttttttgagatggacttttgctctgtcgcccaggctggagcgcagtggtgccatataagctcactgcagcctccacctcctgggttcaagcaattcttgtgcctcaacctcccatgtagctgagattacaggcatgtgccaccacgcccagctaatttttgtatttttagtagagacagggtttcaccatgttggccaggctggtcttgagctcctgacctcaggtgatccacccacttcggcctcccaaagtgctgggattgcagccatgagccactgtgcccagcctagatttttacacataaaaaaatatgtgtcagatttgaatatatagtaattagttagttcctgagctgatatgctaactcagtgcattagagcctggtatttctaaatttaacactaaaagctcaaactgccatcttgtaaatatgtgccactcactaccagagaaagtgtcactcactatcacagaaagagagaaggcgagctagacagggcaatacaatccagtgcgattacttcccacagcaattcagcaggcattctttgcgactactcagacacaatcatgatctctttatttaaagagcagaacgtggtagtattttaaatagcatggccccataaccaatctgtgaaggtctcttattgattataattctaaatccaagctcttggagatcagttatccaggttagaaaagtttgttgacaccaaggaaaatatcttcattttgatatctctaaaattccacttttgttgaaatttctccataggcatatataattattggcctgttccaaaagcatcttgaagtgccaacttcagaatatctttctaggttcagtcttacaatattagtaatccatttcttatggcatctatgtagactgcctacctccatatagtcttgggaatgttgatgtgttcatgaatataaaatacgtacctctcccaaccactcaccatacttataacagtaagtttccttatgggtgtgacataaaacacctcaaatcagttcataattaataaccacactacaaattagatcaccacactttaggctaagttaaaatggcaggttgtgatatgactctcctgagtctctctctcataggaatgtgacagtgggtcatcttataggtggacaagtgagctcagttctattttcagcttcagtagcataaaacagaaatttattttaagaatgacattaactgtgtacatatgatattattattgtaccattattattggggaatatccacagcactcattaactggtgaatctcattccatatttttgttcattaaaggtcctcttgtactaattttttaattcaaattcaacctgttacagtgaggttctccaagaatgccagggattggtctaattatataaatgcatactgagattgcacagaatgtcctccagccccgtagaagaatataataagatatataagcacatttaatgaaagtctgaccagtaaaaaaaggttatcaagttaataatagccagattcaggaaaaaaaaaggcactttttatctaacactgttcaagacagacacaagcaaccccatcaccagtgagattttctccactggggtctggtaatatgttattatacttcctcagcatttagtagaaacatctcagtaagccattctgttgttattaccaagaacacacctgggttatctgagtaatatgagaagaaagaagttagtctattctaacaaagcacctcaaagcaacacaaaaatatagtagcttgaatgaaatagaggtctcttactctctccccacacagtctagatgtaaataatcttggcttggcacagccaactctactgtcccctacacatgcctctcaaagttgctccaattctcaccattccccagtgagtgacaggaaaacaaaaagttgagtaggacagttttatcttcaaaattttgctacagaagagttgacttttgtaacccagtgaatccccaaatttaacctgcaggttataggcagagggactttcctttagcagatctgtatttctttccatctctgcttccaaacctaacttggctgccttcacctctcttttgcaaaaagcaacgataaagagtttataaacatcaaacttttgagtttttccatgcagttatgctagaccaacagactcagtgagcatgtgctctgctttccaagttattgtagacaaaattgtatcaaatatttttcaacagtttaagtcaacatcaccagagtctacaatatttattgctttgcaacccactagcagactgctaagcatagttctggttattgttatgggtatgaccccacttccgggtaccattttctgtattaattagatgctataattttggaaaaccccaaaacacagtgacatatatatgcatacatatatatataacatatatatgcatacatatatatataacatatatatgcatacatatatatataacatatatatgcatacatatatatataacatatatatgcatacatatatatataacatatatatgcatacatatatatataacatatatataagataacctagaaattacacgcatttctgctcaaattcaattggattaaacttatttgcatggctacacctagaaacaagtatgttcttaggtggtgaccacctgctctgctaaaaccggccagagagggattatattattcaaaaggaaaaggagaatggttaatgaagagcaataagtagtctctgtcagacagggatttcagaatcctcgcctactgttattccattgttctggttctttgtgtaagcaggtctcttaagagtctgaaaagcagggcatacaatatgaaataacaaatccaaaccctaagactcgcctttgatgagtttacatagatcacggcccttgcacatctccaatttagcttcctcaccataacatttcaaatctaataaggaggaggaaagaaggaagcctgctagcatataaatatattgcctccattttagaatgtttgtacttaaagagttcctgcattatcttttcttcatattgaatttcttagaattctgtgtcactcagcacccattagccacagcacagtttccagatggatctaggccttgccaacctttttagctcagaatactatcctccccaagttccacaaacaccaaagctgatgattcacaggaatgtggcttaatcataatacagccacacaaatatgctatacagcattctacgttaaaatggaagacaagcccccccactgattatagtacactgcccattaagccagtactgagccatttaatctttttgaaggctacttcaacccattctatttccagaaccataatccacactcatcttctcaccagtaataaactcacttctcaagtatcatgataccaggaagtgtgtatcttgcataagggactcataaaaggtctatcacccattattaattaagtataatgctattatgcatcaggcatatgtgaaattaatagcagtgagactgtcatcaagggacaataacctctggttcaactaagcaaatcttgctcctagacctgcaacagaatggtgactattctcttgtaggaaatgatgacttaatcaagatgttctcaagactcaatctgagtggttctacctacaacagaattgtccccccaatgacagcttcattggccttccctcaaactctcataagtgcatttccaattctccagtaggtcccttgtgaactataaatctaggggaatagcgaggtgttcttggcagttatttttaaaaattcacaaacggcagccaccccaacactaattaaaggaatatgatttatcttgacttcttattttctttaattaacccctgtttaggaggagaaaacacacacaccctgtgcaccagaacaccgaatactgtcaacaaaattctttgtatcatatggatgatacaaatagttatggtatgatatctatatcatatgggttgataaatatataacactctccatctacacccacaagaaatattctcaaccagtcagtaacctttctcatgaatgccagaagtagccctagaatcattctttatgcaaaactccaggcaattgtcatcaattagagctgctcctcagaacaaaacctatctaacactcttacaatttaacacacacaaatacacacccactgtggtccaaggtcacacagcaaataagtggtacatctgagactaatgtccaggactcttatttcctgagactgacgctttcttccacaaggtatcgtgatggctatttagtaaattaacaatatttgcaacagctttgaaagccttcatttgccaaagagaaaattattgaaagaaaaaggaaaatcaattcgtagctccctggataacattttagaagatctgtacttcaaaaataactgctaaaaactcttctaaatgttaagaagttaaaaaaaatagttccctgaataacctttttaaagatctgtacttcaaaaataattgctaaaaacccttctaaatgttaagaagttaagaaaaattgctattaattaaatgttcaattaatgtttattatgaatatcgtattgtaattaggcaagtttgtgacacagtagagtgtatgcatgtgtgcttcatacacgttatagtacattcatgctcccttatataatcaaagtttgtggaattcaatgccaattttatagaccttttacagtgggcataatgagcaatagtctgataaatcaggagaaatagatggaatctacccttatcttagagtatgggctagtcagtaacctctctgcacctcagttttctcatcgttcagttgaaggtatctctatggtccctgtggtatggaaaaactttcctctaaaccatgtttttcctctattctcacaccacaacaatcaacacagaagacttttgtgaccaaatgtatgggtggttttccccatacaccaaacagcagatagcagctgggagtcctccaattcagttcagacactatctacctggagatagtgtcagatcccccaagttgaaggctccatctccaagactgcccctctccacacacacacactggtcccaagtcccggcctgtggaactctgaccaactagctttaagctgggattaccataacaccctcttcaggcttgattaatttgcgaagcagctcacagaactcagggaaatacctacatacatttgtaggtttattataaagaatattgtaaaggatacagatgaagagacacataggacgaggtatggggaaggggcacagagcatccatgccctccctgggtgcatcaccctccaggaagctccacgggttccactatctgaaagctcaatgaaacctgtcctcttgcatttttatggaagtctcatgacatcgccattccttctcccaggtttagtgtgggacccactcctgggagagtcttaagacccacagtcagaaagaggggggaacgtcagagtggaaagaaggcagaggaagttcagaggcctgcccctgaggcctgacatacccaacattataacgcaaaagactgtaacagggatatgggtgttatgggccaggaactggggatgaaaatcaatgtatatcataacaccgcagtcccctaaagtactcaagagctctatcattcaaagcataattttgttgttttaaacatattatggaatattaaacttgctttataatgtacataaaatgtcaacttatttgacaccacaatttaaagaaattatacacttccttatgtttttaagttgacatctaaatttatctcaaacctaatagttacaaaagatgcaatttctagtatattgcatatcaggtataagatctaaatatattaatatacttgaagttgcagatttagcccattcaacttatgaaacatgtctgctgtatgtttatgagacatatttctgaaacaatttgtgaaacatctgctgtataaaacctcactggaaaagccagttctcgtggtcaagcatattagtcaaatcagatttattgccatacaaagccaaacttacatttttcaattcaaaaaaaagtcagtatgtactccataacacacattctacttctgaattctaattctaatttacataaacagagaaaaggttagctagagcctttccatgattttgttacctaaataaaatcaggcatttctcatatacacatgtatcttttgtatataattttattatatatacacaatacatataatttcattgcaattgcttatgtaaatatgtttttaaccaaaggctcttattcaggagctttacatattcaaacactcctctttttagcccctaacttttttataccctgggaaatgcatcataagattcaggatggatgagaggtgcacattttttttttttgtaaagtaggaggtgaccattgtgaaaagagtggtaggaatggagaaatactgactgcaggagtggttttcagatagatcagcttaaggaagagacacaatggaagctgagcatcttcagaatgatttccttaaagctgtccaagccatatacccctggaaagtcttcaaatatcctcaagggtatgcatactctgtttaaagatatctgaactgggattcctttatgactgaaaaaaatgtacagcaaattcttatgtcccttattattggaaaaaaatgagacagaaaattcaagaaagcatttacttctccaggctcttttatcctcaagtcctcaggacaaaattgcttgccataaccacaaataaaaacagcaaagaggcttcataatagaagccactcctactggcagtggcttcccagtttgcttgtgataaggtttatgaggttgagtctgtgcttttcataaaagaatgccatggctaattagcaatatctggcaggatgtggaaatgacagcctaagtgctacatcagtcctcccaccctgtcagcataacctaacaaaacaactttatttgaattttattcagtttcctatttaacctttggttcctgcaattctgagcataggtacattccaaagaatacatgtttttaaagtgggtatgcacaggtttttactttatcatatacataatatacgtaatagcatatgtaaattttccccaaataagaagaaaatgcatttattaatcaattgagaagacaatatttatccacttatttattactagatagtcttggaagagcatgaatatgctttattcactaattagaaactgctttagctttagtattcctggaaaataaagtgcaaggggataatcaatgaagagatgcctgaactgattaacagggactatgtcatgaaggaccttgtgagccacgggactgattatttaagcaatagatgttatcaaagagttttaatctgctcacatcatcagatttatactgtggaaggctccctctggtggcagtgtagggaatggatcaactaaagtaggtaagacagtaaaagctttggagagacttgaggtattctagatgaaagataatattgaggaaaaatagtagtaattgtagcaggaataacgaaaagtggaaagacttaagactgtaacagcatctcctagatttgataatctgttggaggtaggcagtagaatggatggtgatgtcactaacttggggaattaaaaatagaacaggcttggaataaaagatgacttcagatttggacatatggaattagaaatacttgtctatagctgagagcagaggtcaaagtcagaactaaaaacagaggatctgtggcatagagacgataattgaagctgtgggagtcagtgtggtgaaagtggggcacatgtgtggtgtggggtaaaaaggagggctaactgaggaacaacaacatcacagggatgttcagaaagatgccttgcaaaggagacagcggggtgactagagagtcaacaaaaaactagagcagggtgggtcacaaacagcaagggaagcaaagtcttcaaaaagagagtaatcacagtataaaatgttgacgactggaaagttaaaaaggacaaggatatgtggactggaagcatgcccaggttcatgttgttgcaaatggaagagtatgtgttagtgagaggtttttccctgacttggtaacttaagagagggtgcaacgggttgagaagcaatgagaggtgaaagaggaaaaatttgggtatgaagaggcaaagagaactgcattagttagggaggaatacagggctcaaggagaggttttttatgtacataatgaactgattaacaatactacagtcaagcaaattaacatattcatctcctcccatagttaaccatttttagtgtgtgtgataagaacacctaaaatctactctgtttgcaaatttctagtatgcaatacggtattattaactatagtcctcatgctgcccatttgatttctagatttcttcatcctacattaattacatccttgtgccttttgacaagtatctctccatttcccccacctccccaccttcagtaatcaccattctactttctgcttctatggagagtagaagtgagtttttttagaccccacatataagtgagatcatgtggtatttgtctccctgtatctggcttgtttcacttagcataatgtcttccaagttcatctatgttattgtaaatggcagaatcaaggaagatttgttgttgttgttgttttacatatgaagaatttggaagactttctaaaggtggcaacagcaagatggtagaataggaagtctatggctccactttcactacccagccaagagaaggatccactagcaactatccacaggccagaacatcttttcaaaaatcctactacttagatagaactcacatagtcccccaaactgaatgaaaaccaaattaaaacgataagaagaacagtctcactttgactgcactgctcctctccctcccccaagttgccacaatgccagacggagaggaactccttgacccaaagtttctactgggggaaaaaagaactggagacagttatccagcttccctaacaatctcatataattcccaggaaggctactccagtctcacttcatgaggaacactgtgggtaggtaatagcacagctagactgcccaggatcaggtaaaaacaaaggaaggaagcagaggtcacaatgaccagcatacagatcttggtggtacctctgcatttctgccagccatggaaccagatggaagacacaaatcaacatgaagctgacctcatggtcttcagaagcacagtaggaagttcaacctagcttgattccccagagggttagtcttcatgcccagtctcagagcccaccccagtgaccccactgaggcagggagacccccaactccacccattgcagataagcacagtggctaggcctgcatgactggagaagtcaagcagcagttccactcagaccaaaagcccactcaaccatcctgccaaggcacggaaactcctacctcagcacattttggagaagcacaggcgccagacctacttgatccaggaagtcaaacagccactcaactcagccaaaagcttgtcacacagctccactgggacaaggagggaatcctcaatcatgcatttcaaagagcgtggcctctggttctgtctatcccaagcagtatctacacctaacctcagtgcccagcctggagccctgcccaactgcagatcccaaatagcagaattatccagccagggaatacatcttattatcagcctgaccagaagctttgcagtccctagccagcagctcccccttataccagtgcccaaccagtgatattgctgggcagtggaacctagccaggagccccagctaaaaacagaattaaggcagcagcccagccaactagagagcccacaaaaagctctgcctgcctagggtcattagcagctggccctttcagaatcacagttagactaaacagtgaaggtctatccctgccaaagaacacctgtaaaggccagcagaggaggctgtctcctcaaatatacagacaacaatgcaaggacacaaaaattacaaagaatcaggaaatcataacactctcaaaataaactaataaagctccaataatcaaccctaaagatatacagatctatcaaatgactgaaaagaattcagaataatcatcttaaagatgttcagtaaactaaaagaatacacattaaaaattaaataaaatttggaaaacaatacatgaacaaagtgagaagtttgataaagaaatagacacaattgcaaaaatagaaattctagagataaaggttacaggcatgacttagagatactgtgggttcagttatagaccaccacaattttatcatgaggcacagtaatccagtcacatcttcaggctttacttacatttctggttctcgctatttctaccacatcggcaattgcttcttccactgaagtcttggacccctcaaagtcatccatgagggttgaaataaacttctttcaaacttctattaatgttgttatttgtaactcctctcatgaaacacaaatattcttaatggcatctagaatggtgaatcctttccagaaggtttttaatttactttgcccatatatctcagagaaattactatttttggcagctatagccttacaaaatgcctttcttaaataacaggacttgaaagttgaaattactccttgatctattgactgcagaatggatgttgtgctagcaagcatgaaaacactaatttccttgtacatcttcatcagcactctcaggtgactgggtgcacggtctatgagcagaagtatttttaaagaaattgtgttttctgagcaatgggtctcaatggggagttataaatattcagtaaatcatactgtaaacagatgtgctaccatccagactttgtgtttctattgatacagaccaggcagagtccatttagcataattaagggccctaggattctcaaaatggtaaatgagctttggcttaaacttaaactgaccaattgcattcactcctaaggagatagtcagtctatcctttgaaattttgaagctagactttgacttctcctctctagctgtgaaagttctacatggcatcttcttccaacataaagctgtttttgtcttcattgaaaatctcttgcttaatgtggccgtcttcatcaatgatctttgctaagtctagataacttgctgcagcttctacatcagcatttgctgcttcaccttgcacttttatgctatgaagattacttctttcctttaacctcatgaaccaagttttgctagcttccaacatttttctgcagcttccttacctctctcggccttcatagaattgaagaaaatgaaggccttgttctggcaaggctttggcttaaaggaatgttgtggctgacttgatcttctgtcaaaaccagtaaaattttttccatagcagctatatggctgttttactttgttattcatgtgttcactggagtaacacttttaatttccttctataactttccttatgcattcacaaatttggcaaaaggaatctagctttcagcctatctgagcttttgaaatatgttcctcactaagcttaaccatttttaaaaaatgcttttgattttcaatgagagatgtgtgactcttcctttcacttgaacacttagaagtcattgtcgggttactaattgacctaatttcaatattgttgtgtttcagggaataggaaaacttcaggaaagagagagagatgagggaatggccagttggtggagcagttagaacacacccaatatttattgataacatttactgtcttatatgggtgtagtttgtggctccccaaacaattatgatagtgacatcaaaaataactgaccacaggtcaccataacagatataataataataataaattgaaatattgcaagaattaccaaattttgacacagagacataaaatgagcaaatgtcattgaaaaaaaatagcagcaataaatttgcccaatgcagggtaccacaaactttcaatttgttaaaaatgcaatatctgaaaaaaaagcaaaacgcaataaaatgaggtaatcttatgcaatgaatgaacttataaaaatgcagtaaaaatgcatcaacagaagactcaaccaagcagaggaaagaattagtgagctcaaagacaggacatttaaaattatccagtcagaggggaataaaagacaaaggaatgaagaaatcctatgggaattatggaactccattaagagaccaaacccttgaataacaagagttgcagaagaaggaaaatagggaaaggtagaatttggctgtgaatccatctggtcctggactcttttttgttggtaagctattgattattgccacaatttcagatcctgttattggtctattcagagattcaacttcttcctggtttagtcttgggagagtgtatgtgtcaaggaatttatccatttcttctagattttccagtttatttgtgtagaggtgtttgtagtattctctgatggtagtttgtatttctgtgggattggtggtgatatcccctttatcattttttattgcatctatttgattcttctctcttttattctttattagtcttgctagcagtctatcaattttgttgatcctttcaaaaaaccagctcctggattcattaatttttgaagggttttttttctctctatttccttcagttctgctctgattttagttatttcttgccttctgctagcttgtgaatgtgtttgctgttgcttttctagctcttttaattgtgatgttagggtatcaattttggaactttcctgctttctcttgtgggcatttagtgctataaatttccctgtacacgctgctttgaatgtgtcccagagattctggtatgttgtgtctttgttctcattggtttcaaagaacatctttatttctgccttcatttcgttatgtacccagtagtcattaaggagcaggttgttcattttccacatacttgagcggttttgagtgagtttcttaatcctgagttctagtttgattgcactgtggtctgagacacagtttgttataatttctgttcttttacatttgctaaggagagctttacttccaactatgtggtcaattttggaataggtgtggtgtggtgctgaaaaaaaaaagtaaggaggaactggtaccattccttctgaaactattccaatcaatagaaaaacaggcaatcctccctaactcattttatgaggccagcatcatcctgataccaaagctgggcagagacacaaccaaaaaagagaattttagaccaatatccttgatgaacattgatgcaaaaatcctcaataaaatacggcaaaccgaattcagcagcacatcaaaaagcttatccaccatgatcaagtgggcttcatccctgggatgcaaggttggttcaatatatgcaaatcaataaatgtaatccagcatataaacagaaccaaagacaaaaaccacatgattatctcaatagatgcaggaaaggcctttgacaaaattcaacaacccttcatgctaaaaactctcaataaattaggtattgatgggacgtatctcaaaataataagacctatgtatgacaaacctacagccaatatcatactgaatggggaaaaactggaagcattccctttgaaaactggcacaagacagggatgccctctctcaccactcctattcaacatagtgttggaagttctggccagggcaattaggcaggagaaggaaataaagggtatccaattaggaaaagaggaagtcaaattgtccctgtttgcagatgacatgattgtatatctagaaaaccccatcatctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctgggaatccaacttacaagggatgtgaaggacctcttcaaagagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcgcatggaaccaaaaaagagcccgcatcaccaagtcaatcctaagccaaaagaacaaagccggaggcatcacgctacctgacttcaaactatactacaaggctacagtaaccaaaacagcatggtactggtaccaaaacagagatatagatcaatggaacagaacagagccctcagaaaaaacaccacatacctacaactatctgatctttgacaaacctgagaaaaacaaccaatggggaaacgattccctatttaataaatggtgctgggaaaactggctagccatatgtagaaagctgaaactggagcccttccttacaccttatacaaaaattaattcaagatggattaaagacttaaatgttagacctaaaaccataaaaaccctagaagaaaacctaggcattaccattcaggacataggcataggcaaggacttcatgtctaaaacaccaaaagctatggcaacaaaagacaaaattgacaaatgggatctaattaaactaaagagcttctgcacagcaaaagaaactaccatcagagtgaacaggcaacctacagaatgggagaaaatttttgcaacctactcatctgacaaagggctaatagccagaatctataatgaactcaaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactatttcaatcattgtggaagtcagtgtggcaattcctcagggatctagaactagaaataccatttgacccagccatcctattactgggtatatacccaaaggactataaatcatgctgctataaagacacatgcacacgtatgtttattgcagctgtattcacaatagcaaagacttggaaccaaccgaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaaggacaaaaaaccaaacactgcatgttctcactcatagatgggaattgagcaatgagaacacatggacacaggaaggggaacatcacactttggggactgttgtggggtgaggggagtggggagggatagcattaggagatatacctaatgctaaatgatgagttaatgggtgcagcacaccagcatggcgcatgtatacatatgtaactaacatgcacattgtgcacatgtaccctaaaacttaaagtataataataattaaaaaaagaaaaatagggaaagggaaccagaaatcatatttttaaaaataatggctgaaaacttccctaatctggaaaaaagtgtcaacatccacatactggaggtgttgaagtaattcaacccaaagagaaattcagcaatacacataataatcaaagaaatcaaaaatcaaagacaaagacaaaatgttgagagcagcaaaagataagaaacatatcacatgaaaaggagtcccaatatgactatcagcagaattctcagcaaaaaaccctcaagccaagaaagagtgggatgacatagtcaaaatggcagaagcaaaaacactacccaccaataatacccaggaaatccgtctttcagaaatcaggaagaaataaaaattttcctaaacaaaaatctaagggagttcatcaccactagacctgcctgacataaattggtaaagggagttccttaagctgaaacaaaaaaggctactaattaacatcataaaacatacaaaagaacaaaagtcaatggtataagtaaaacagagtaatattcataatagtctaggacattaatgatggtgtgtaaagcaattttattcctagcatgggggttaaaataaaagctgttgataataactataattaaaacaaattgtcaaggtgtacactttacaaaactgatgtaaatattggcatcgaaaacataaaatgggaatgcatagggagaaaaactgtaaagttgcatataatcaaagtaaagttgttatcagcttgaaatagcctgctataagatgttctatgttagcctcaggataacaaagcaaacatctgcagtagaagcacaaagtacaaatagaaggaattcaaaacatatcactacagaaaaccatcaaaccacaaaggaaaacagcaagaaagaaagacaagaactaatgattaacaaaacactcagtaaacaattaacaaagtggcattattaaattctctgctatcaataattaccctgaatgtaaatggattaaattctccaataaaaagacataacatgactatatattaatagaccaaaaaaaaaaaaaaaaaacaaggcccaattataggctgtctataagagactggcctcacttttaaggacacacatagactaacagtaaaaagatggaaaaagatatttcacacaaatagaaacaaaaagagagcagaggtagctatataatcatcctttatatctgcaaggggttggttccaggaacactatgaatgccaaaattcacaaatgctcaagtcccttatataaaatgccatagcatttgcatataacctatgtgcatccttctgcatactttaaatcatttctagattatacataatacccaatacaatgtaaatgctacataggtaacttttatactgtgttggttttttatttttattatgttttattcttgtattatttttattgtatttttaaatatttttgatttgcaattagtaaaatctataatgcaaaacccatgcctacagagggccaactgtacttatgtaagacaaaataggctttagggctttgtatagtctgagctgactacgggtagaagggatcccaaagcacaccacagcacagctgctctaccaaaatatggccagactgcttccttaagcaggttcccaatcccattcctcctcacttggtgggaactcccaagtgggctttcagccacccctgttggtgttctctggccaagagagatttgtaatttccctcaaacagagcacccagagggaggggtgggacaccatctttgctctttgagtgacagccattccatctttcgggcttcagggtgtctgaggtgactggggactgaagcagacccctaacacaacacagcttctctactgaaacacggcaagagtgcttttttaagcaggtctccaatcctattcctcctcattgggcagggcttcccaactggggtctccagccacttcctagggtgcctttgggctggcaacaggcccatatctccctaggacaaagcgtccagatggaggaacaggttgccacctttgctgttttgcagcattcactggtgaaacctccaggtactgaaatatctgaggcaactagggaccagagtgcaccccaagcacactgcagcagccctatggaaaagtggcaagacagttacatgggtgtccattcctatatcttctcaccaggcaggtcctccaggcctgggcctccagccaccccccaccagagttattgagctggtagcaactctaggggcaactgaaagcctctctgccactgcctctgccttgccaccctcagactaacaatggaacaaagaccctaagtgttttattcacacctccaacaaactgcagtcaacccaagaagaggagaatagtccatctcccatgggtctcacacaccccccactgctcatcacaagacagggaacctctggcttgggcccacagcatagaccctccatcctgggctgattgcactgggcaaatgctgacctgcatctctgtggcatagaggccccaggagacaagcaaatgaccctcagccacaactagtactaagatcccttcctctgctgcctccaagttggggagaaaacaacactgagattgccccagagctgcaatgaacagcccaggagtgccaaatcatgatctacagccagcactcaaggggagaggatcccacactttcagagtattgagcaggaacatggctgccactgtgaggaaacataggggagcaacacaaccgaacaaaagtctaccaactgacaaataagcctaagtactacctgctggatcacactctaaagcttcaaaatgaaaaatacccccctaatataccccctctgaaaccagagacaagaaggcagcttcaaagaaaaaccctgcacaaagccttggcctggtgaaaacatccagaaaagaagtctattgactgtactcaatctacactgcagttaaaggaacagccacatgcagagatgaggaagaatcaacacaagaactctggtaactctaatggccagagtgtctgatgtcctccaaacaaccacaccagttctccaacaagagctctcaatcaggccaaactggctgggatgacagagatagaattcagaaccaatggataggaagaaagattatcaagattcagagaatggcaaaacacaatccagggaaaataggaatcacaataaagtaggagctgaaagacaaaacagccactacaaaaaagaacctaatgggtctgacagagctgaacaacacagtacaagagtttcacaatgcaatcacaagtattaacagcagaataaaccaagctgaggaaaaaaaatctcagaacttgaagactggttctctaaggcagtcagacaaaaataaagaaaaaagaataaaaaggaataaacaaagcctctgcaaagtatgggattatgtgatgaggccaaatctatgaatcattggcattcctgaaagggaggaggaaaaagcaaacaacttggaaaacatatttcaggatataatccatgaaaacttcctcaaccttgctagagaagctaatgatcaaattcaggaaatacagagaattcctacaagattctacacaaaaagaccatcccaaagacatataatcatcaaattttctaccatcaaaatgtcaaaataaatgctaaatgcagctagagagaaagggcaggttacctacaaagggaatcccactaggctaacagcaagcctctcaggtgataccctgaaagccaaaagagattggagacctctattcaaccatcatagggaaaaaaatcttcaatcaagggtttcatatttggccaaactaggcttcctaagtgaagaagaaatacaatccttttcagattagcaaatgttgacggaattcattaccaccagacctgccttacaagagctcttcaaaggagtgttaaatgcagaaagactgctaccttctaatacaaaaacacacttaaacacacagagcagtgtcattgtgaagcaattacaaaaacaaactaacataataaccagctaacagcacaacgacataatcaaatccacacatatcaatattaatattcaatgtaaatgggctaaatgcctcacttaaaaggcacaaagtggaaagctggatgaaaatgcaagacccagtgatatgctgtcttcaagagacacatctcacaagtaatgacaatcctaggctcaaaataaagggatggagggaaatctaccaagcaaatggaaaacagaaaaaagcagggtttgcaatcctaatttcagataaaacagatttcaaaccaacaaagaaaaaaaaaaagacaaagcagggcattacataatggtaaagggttcaattcaacagaagacctaactatcctaaatacataggcacccatcacagaagcacccagattcataaagccagttcttagagacctacaaagagatatagactcccacacaataatggtgggagacttcaaaatgccactgatagtattagacagatcttcaaggcagaaaattaacaaagatattcaagacctaaactcatcactggacatggatctaatggacctttacagaattctccaccgaaaaacaacaaactatacattctgctcattgtcacagggcacgtactctaaaatcaaccacataattggacctaaaacaatcctcaacttatgtaaaagaaccaaaatcttatgaacacactcttggactagagctcaataaaaacagaagtcaagactaggaaaatcatgcaaaaccatgcaatgacatggaaattaaacatgctccataatgactttaagggtacataatgaaattacagcagaaataaagaagttatttgaaaataataagaaaaaagatccataacagaatctctgggacacacctaaggcaatgttaagaggtaaatccatagcactaaatccctacatcaaaaagttagaaagatctcaaattaatgacctaacttcacacctgaaggaattagagaagcaaggacaaatcaacccaaagcaagcagaagacaagaaataacaaaaaatcagagctgaactgaaggaaatcaagacatgaaaaactattcaaaagatcaaggaactaggagttggttttctgaaaaaaattaataaaataggccactagctacactaataatgaagaaaagagaaaagactcaaataaaaacaattagaaatgatgaagagaatgttactactgacatcacagaaataaaaacagccatcagaagctactacaaacccctcaatgcacagaaactagaaaaccaagaagagatgaataaacttgtggacatatacaacctcccaagactgagccaggaagaaaatgaatcccttcacagaccaataatgagctccaaaagtgaattattagtaagtaacctatcaaccaaaaaaagtctggaacctgatgaattcacagacaaattctaccagatgtacaaagaacagctggtaccattcctactaaaactattcaaaaaaactgaggagggactcctccccaactcattcaatgaagccaagatcatcttgataccaaaacttggcagagacacaacaaaaaaagaaaacttcaggccaatatctgtgatgaacatccacacaaaaatcatcaacaaaatacttacaaaacaaaatcactaacacatcaaaaagctaatccaccatgatcaagtagccttcatcctcacgatgcaagtttggttcagcatacaaaaattaataaatgtgattcatcacataaacagaactaaagacaaaaaccacgtgattatctcaataaatgcagaaaaggcttttaataaaattcaacatcccttcatgttaaaaattctcaataaactaggtattgaaggaacatacttcaaaatgatgagagctatctctgacaaacccacagccaacattttactgaatgggtaaaagctggaagcatatccattaaaaaccagcacaagacaaggatgcactatctcatcattcctattcaacataatatcagaagtcccagccagggcagtcaggcaagacaaagaaataaagtgcatccaaataggaagagagaaagttaaactacctctgtttgcagatgacatgattttatttctagaaaaccccatagtctcagcccaaaagctcctccagctgataaacacgtcagcaaagttccaggatacaaaatcaatgtacaaaaatcattagcattactatacaccaacaacagccaaacctagagccaaatcagaaaggctattttattcacaattgctacaaaaagaataaaataactagaaatacagctaaccatggaggtgaaagagttctgcaatgagaattacaaaacattcctcaaagaaattagaaagacacaaacaaatggaaacacctcccatattcatgaatagcaagaaacaatatcattaaaatggctatattacccaaagcaatttacaaattcaatgctgtttctatcaaactaccaatgacattcttcacagaactagaaaaaaactattctaaaatttatatgaaaccaaaaaaacaaaagagcctcaataggcaaggcagtaccaggcaaaaagaacaaagctggaagcctcatgttattcaacttcaaactatactacaagactacagtaaccaaaacagcatggttctgatacaaaaacaagcacatagaccaatggaagataatagagaacccagaaataagactatatatctacaatcatctgatctttgacaaacctgacaaaaactagtaattgacagaatcactattcaataaatggtgttgggataactggatagccatatgcagaagattgaagctggaccccttccttacaccatatacaaaaattaactcaggatggattaaagtcttaaatttaaaacccaaaactatgaaaaccctggaagataacttaggcaatactattctggatataggaatgggcaaaaatttcatgacagagacaccaaaagcaatcataacaaaagcaaatattgacaaatggaatctaattagatttaagagcttctgcacagccaaaaaaactatcaacagggtcaacagacaacctacagaatgggaaaaaatattaggaaactatccatctcacaaagatctaatatccagcatttgtaagaaatttaaagaaatttaaacatgaaaaaacaaccccattaaaacgtgagcaaagggcacatgcacaagggctggagccaagatgactgaataggaaaacctctgctttacagctcccagcgtgagcgacgcagaagaagagtgatttctgcatttccatcggagttaccgggttcatctcactagggaatgccagacagtgggcgcaggacagtgggtgtagtgcaccgtgcatgagctgaagctgggtgaggcattgcatcactcaggaagtgcaaggggtcagggagttccctttcctagtcaaagaaaggggtgacacacggcacctggaaaatcgggtcactcccaccccaatactgcgcttttcccacaggcttagaaaaccgcacacgacgagattatatcccgcacctggctcggagggtcctacgcccatggagtctcactgattgctagtacagcagtctgagatcaaactgcaaggctgcagtgaggctgagggaggggcgcccacaattgcccaggcttgcttaggtaaacaaagcagctgggaagctccaactgggtggagcccaccacagctcaaggaggcctgcctgcctctgtaggctccacctctggggtcagggcacagacaaacaaaaagacagcagtaacctctgcagaattaaatgtccctgtctgacagctttgaagagagcagtggttctcccagcacacagctggagatctgagaacacgcagactgcctcctcaagtgggttgctgacccctgacccccgagcagcctaactgggaggcaccccccagtaggggcagactgacacttcacaaggccgggtactcctctgagacaaaatttccagaggaacaatcagacagcagcattcgtggttcacaaaaatccgctgttctgcagccaccgctgctggtacccaggcaaacagggtctggagtggatctctagcaaattccaacagacctgcagctaagggtcctgtctgttagaaggaaaactaacaaacagaaaggaaatccacaccaaaaaccatctgtacatcaccatcatcaaagaccaaaagtagataaaaccacaaagatgaggaaaaaacagaacagaaaaactggaaactctaaaaagcagagctcctctcctcctccaaaggaacgcagctcctcatcagcaacagaacaaagctggatggagaatgactttgacgagttgagagaagaaggcttcagatgatcaaactactccgagctacaggaggaaattcaaaccaaaggcaaagaagttgaaaactttgaaaaaaatttagaggaatgtataactagaataaccaatacagagaagtgcttaaaggagctgttggagatgaaagccaaggcacaagaactacgtgaagaatgcagaagcctcaggagctgatgcgatcaactggaagaaaggctatcagtgatgaaagatgaaatgaatgaaatgaagcaagaagggaagtttagagaaaaaagaataaaaagaaatgaacaaagcctccaagaaatatgggactatttgaaaagaccaaatctaagcctgattggtgtacctgaaagtgacgggaagaatagaaacaacttggaaaactctcttcaggatgttatccaggagaacttccccaatctagcaaggcacgccaacattcagattcaggaaatacagagaacgccacaaagatactcctcgagaagagcaactccaagacacataattgtcacattcaccaaagttgaaatgaaggaaagaatgttaagggcagccagagagaaaggtcgggttatccacaaagggaagcccatcagactaacagcagatctctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaagaacaaccggtaccagccactgcaaaatcatgccaaattgtaaagaccattgaggctaggaagaaactgcatcaactaacgagcaaaataaccagctaacatcatcatgacaggatcaaattcacacataacaatattaactttaaatgtaaatggactaaatgctccaattaaaaggcacagactggcaaactggataaagagtcaagacccatcagtgtgctgtattcaggaaacccatctcacgtgcggagacacataaaggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacagaagcacccagattcataaagcaagtcctgagtgacctacaaagagacttagactcccacacaataataatgggagactttaacaccccactgtcaacattagatagatcaacgagacagaaagttaacaaggatacccaagaattcaactcagctctgcaccaagtggacctaatagacatctacagaactctccaccacaaatcaacagaatatacatttttctcagcaccataccacacctattccaaaattgaccacatagttggaagtaaagctctcctcagtaaatgtaaaagatcagaaattataacaaactctctcttagaccacagtgcaatcaaactagaactcaggattaagaaactcactcaaaactgctcaactacatcgaaactgaacaacctgctcctgaatgactactgggtacataacgaaatgaaggcagaaataaagatgttctttgaaaccaatgagaacaaaggcacaacataccagaatctctgggacacattcaaagcagtgtgtagagggaaatttatagcactgaatgcccataagagaaagcaggaaagattaaaaattgacaccctaacatcacaattaaaagaactagaaaagcaagagcaaacacattcaaaagctagcagaaggcaagaaataactaaaatcagagcacaactgaaggaaatagacacacgaaaaaccctttaaaaattaatgaatccaggagctggttttttgaaaggatcaacaaaattgacagaccactagcaagactaataaagaagtaaactatcacaagaacaaaaaaccaagcaccgcatattctcactcataggtgggaattgaacaatgagaacacatggacacaggaaggggaacatcacgctttggggactgttgtggggtgggaggagtggggagggatagctttaggagatatacctaatgctacatgacaagttaatgggtgcagcacatcaacatggcacatgtatacatatgtaactaacctgcacattgtgcacatgtaccctaaaacttaaagaataataataataaaataaaataaattaaaaaaaagaaaaaacatctggcaaattgtaaacaagcagcaaataactatttccattattattagtagtaatattattagataaatatattgctcaactgaagattgctaattagtgagtattgtagcaattaccaaacaaggaaacaaattttaagtcgttcatttaaattctagaataattaaaagtttcagcttaatttcaaatgtatattattagaagtatttaaataaactaaattgtgttggtatggagtaataaaaaaaaagagaaaacagagaacaatcaaatagatgcaataaaaaatgataaagggtatatcaacaccgatcccacagaaatacaaactaccatcagaggatactacaaacacctctacacaaataaactagaaaatctagaagaaatggataaattcctcgacacatacaccctcccaagactaaaccaggaagaagttgaatctctgaatacaccaataacaggctctgaaattgtggcaataatcaatagcttaccaacaaaaaagagtccaggaccagatggattcaaagccgaattctaccagaggtacaaggaggaactggtactattccttctgaaactattccaatcaatagaaaaagagggaatcctccctaactcattttacgaggtcagcatcatcctgataccaaagccgggcagagacacaaccaaaaaagagaattttagaccaatatccttgatgaacattgatgcaaaaatcctcaataaaatattggcaaactgaatccagcagcacatcaaaaagcttatccaccatgatcaagtgggcttcatccttgggatccaaggttggttcaatatacacaaatcaataaatgtaatccagcatataaacagaaccaaagacaaaaaccacatgattatctcaatagatgcagaaaaggcctttgacaaaattcaacaaccttcatgttaaaaactctcaataaattaggtattgatgggacatatctcaaaataataagagctatctatgacaaacccacagccaatatcatactgaatgggcaaaaactggaagcattccctttgaatactggcacaagacagggatgctctctctcaccgctcctattcaacatagtgttggaagttctggccagggcaattaggcaggagaaggaaataaagggtattcaattaggaaaagaggaagtcaaattgtccctgtttgcagatgacatgattgtatgtctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaattcccattcgcaattgcttcaaagataataaaatacctgggaatccaatttacaagggacatgaaggacctcttcaaggagaactagaaaccactgctcaatgaaataaaagaggatacaaagaaatggaagaacattccatgctcatgggtaggaagaatcaatattatgaaaatggccaactgcccaaggtaatttacagattcaatgccatccccatcaagctaccaatgactttcttcacagaattggaaaaaactactttaaagttcacatggaaccaaaaaagagcctgcatcaccaagtcaatcctaagccaaaagaacaaagccagaggcatcacgctacctgacttcaaactatactacaaggctacagtaaccaaaacagcatggtactggtaccaaaacagagatatagatcaatggaacagaatggagccctcagaaataatgccacatatctacaactatctgatctttgacaaacctgagaaaaacaagcaatgtggaaaggattccctatttaataaatggtgctgggaaaactggctagccatatgtagaaagctgaaactggagcccttccttacaccttataccagaattaattcaagatggaataaagacttaaacattagacctaaaaccataaaaaccctagaagaaaacctaggcattaccattcaggacataggcatgggcaaggacttcatgtctaaaacaccaaaagctatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatagccagaatctataatgaactcaaacaaatttacaagaaaaaaacaaacaaccccatcaaaaagtgggtgaaggatatgaccagacacttctcaaaagaagacatttatgcagccaaaaaacacgtgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggaatgtaaactagttcaaccattgtggaagtcagtgtggcgattcctcagggatctagaactagaaataccatttgacccagccatcctattactgggtatatacccaaaggactataaatcatgctgctataaagacacatgcacacgtatgtttattgcagctgtattcacaatagcaaagacttggaaccaacccaaatgttcaacaatgatagactggattaagaaaatgtggcacatatacaccatggaatactatgcagccataaaaaatgatgagttcatatcctttgtagggacatggatgaaattggaaatcatcattctcagtaaactattgcaaggacaaaaaaccaaacactgcatgttctcactcatagatgggaattgaacaatgagaacacatggacacaggaaggggaacatcacattctggggactgttgtggggtgtgggcatgggggagggatagcattaggatatatacctaaggctaaatgatgagttaatgggtgcagcacaccagcatggcgcatgtatacatatgtaactaacctgcacattatgcacatgtaccctaaaacttaaagtataataataataaaataaaataaaataaataagaatgagatcatgtcttttgtgggaacacagatggagctggaggctattattcttagcaaactaatgcaggaacagaaaaccaaatactgcatgctcttcttataagtggggttaaatgataagaatttaggaacacaaagaaggaaacaacagacaaaagggtctgcttgctaggaaaggttgggaagagggagaggagcagaaaggacaaccactgggtactgggattaatacctggatgatgaaataatatgcacaggaaacccccatgacatgtgtttacctatgtaacaaacattcacatgtacccccaaatctaaaataagaatgaaaaaaaattaaaacatagaccttaagtcaaaaactataaaaagagataaagaaagacattatataatgataaaggggtcaattcctccaaagcatacaacaattatatgcagccaatatcagagcacctaaatgtataaaacaaatattaaagaacctaaagggagagatagattgcaatacaatatttgtatgggaatttaatacctcactttcaacaatggacaaatcatccaggcagaaaattaatagcaacacattggacttgaacaacactttataccaaatgaacctaacagacacacatagaacattccatctaacaacaagagaacgtacattctcctcagtgaacaaggaattctccagagtagatcacatgttagaaaacaaaatgatccttagcaaatttaagaagattgaaatcatatcaagtatcttttcagattacaatggtataaaactaggaatcaataataggagaaacttcacaaaattcacaaatataggaaattaaacaacatgctcctgcaaaatcaatgatccaatgaagaaattgaaagggaaatcaaaactatcctgagaaaagcaaaaatggaaacccaacataccataacttatgggatatagcaaaagcagttctaagagaaaagcttataacaataaatgcctacatgaaaaagaaaaaaagatctaaaataaacaacttgatgttactcctcaaggagctaggaaaagaaggacaaactaagcccagggttaacagaaagaagaaaacagtaatagagcagaaataactaatatagagacaagaaatcaatacaaaagatcaacaaaactgaaagttggatttttgaaaagaaaagcaaaatcaacaaacctttagctagaccaagaaaaaagagagaagactcaaataaaatcacaaatgaaaacagaaacattacaatggataccacagaaatacaaaagattataaaagcctactattaaaaattatatgccaacaaattagataacatggaaataataaattctttttttattatacttcaagtgctgggatacatgtgcagaatatgaacatttgttacataggtatacatgtgccatggtggtttgctgcacccatcaacccatcatctaggttttaagccctgcatgcattaggtgtttatctaatgctctccccctccttgctccccataccccaacaggccctggcatgtgatgtttccctccctgtgttcatgtattccatgggtcaactcccacttataagtgagaacatgcggtgtttgcttttctgtttctgtgttagtttgctgagaatgatggcttccagctttatccacgtccctgcaaaggacattaactcatctgatttatggctgcatagtattccatgttgtatatgtgccacattttctgtatccaatctgttgttgatgggcatttgggttggttccaagtccttgctactgtgaatagtcctggaataaacatatgtgtgcatgtgtctttatagtagaatgatttataatcctttgggtatatacccagtaatgggattgctgggtcaaatggtatttctggttctagatccttgaggaatcaccacactgtcttccacaatggttgaaataatttatactcccaccaacagtgcaaaagcattcctatttctccacattctctccaacatctgttgtttcctgactttttaacaatctccattctaactggcatgaaatagtatctcattgtggttttgatttgtatttctctaatgacaagtgataatgagctttttttcaaatgtttgttggccacataaatgtcttcttttgagaagtgtctgttcatatcctttgcccactttttcatggggttgttttttttttcttataaatttgttaagttccttgtagattctggatattagacctttgtcagatgaatagactgcaaaaattttctcccattttttaggttgcctgttcactctgatgatagtttattttgctgtgcagaagctctttagtttaattagatcccatttgtcaattatggggggttttgcaattagttttggtgttttagtcatgaagtctttgcccatgcttaggtcctgactggtactgcctaggttttcttctagggtttttaggggtttaggttttatgtttaagtatttaatccatcttgagttaatttttgtataaggagtaaggaaggggtccagtttccgttttctgcatatggctagccagttttcccaacgccatttattaaatagggaatcctttccccattgcttgtttttgtcaggtttgtcaaagatcagatggttgtagatgtgatgggttatttctgaggcctctgttctgttccattcatcaatatatctgttttggtaccagtaccatgctgtttgggttactgtagtcttgtagcatagtttgaagtcaagtacaatgatgtctccgggtttgctctttttgcttaggattgtcttggctatacgaactcttttttggttccatatgaaatttaaagtacctttttctagctctgtaaagaaagtcaatggtagcttgatgggaatagcattgaatctataaattacttgggcagtatggccattttcatgatactgattcttcctatccatgagcatggaatgtttttccatttgtttgtgccctctcttatttccttgagcaggtttgtagttctccttgaagaggttctgcatatcccttgttaagttggattcctgggtattttattttctttgtagcaattgtgaatggtagttcattcatgatttggctctcttttttactattattggtatgtaggaatgcttgtgatttttgcacattgattttgtatccagactttgctgaagttgcttatcagcttaaggagttttggggctgagacattggagttttctaaatgtacaatcatgtcatctgcaaacagagacaatttgactgcctctcttcctatttgaataccctttacttctttctcttgacagattgtccttgctgcacttccaatactatgttgaataagagtggtgagaaagggcatccttgttttgtgatggttttcaaagggaatgtttccagcatttgtccattcagtatgatattgactatgggtttgtcataaatagctcttattattttgagatatgttcaatcagtacctagtttgttgagtgtttttaggatgaaagggtgttaaattttatcaaagaatttttatgcatctattgagataatcgtggtttttgtcattggttcagtttatgtgatggattacatctatcaatttgcaaatgttgaaccagccttgcgtcccagggatgaagccaacttgatcgtggtggatcatcttttgatgtgctgctagatttggtttgccagtattttactgaggattttcacatcaatgttcatcagggatattgaactgaaattttgttttttgctgtgtctctgtcaggtttgggtatcaggatgatgctggcctcataaaatgaggtagggaggagtccctctttttctattgtttggaatagtttcaggaagaatggtaccagctcttctttgtacatctagtggaattcagctgtgaatttgtctggtcctgggctttttttggttggtaggcttttaattattacatcaatttcagaacttgttactggtctattcagggattcaacttcttcctggtttagtcttggtaaggtgtatgtgtccaggaatttatccatttgttctagcttttctagtttatttgtgtagaaatgtttatagtattctctgatgctagttttatttatataggatcagtggtgaatcccctttatcattttttattgtatctatttgattcttctctcttttcatctttattagtctggctagcagtctatctattttgttaatctttttgaaaaaccagctcatggatttattgattttttgaagggtttttcatgtttctctccttcagttctgctctgatcttagttatttcttgtcttctgctagcttttgaatttgtttgctcttgcttctctagttcttttacttttgatgctagggtgtcaattttagatcattcctgctttccaatgtgggcatttagtgctataaatttccctcttaacactgctttagctgtgtcccagagattccaatatgttctgtcttttttctcaatggtttcaaagaacttatttatttaattttgttatttagccagtagtcattcaggagcaggttgttcagtttccaagtagatatgcagctttgagtgagtttcttaatcctgagttctaatttgattgcactgtcgtgtgagagactgtttgttacgatttccattttttgcatttgctgaggagtgttttacttccaattatgtggtcaattttagaataagtgtgatgtggtgctgagaagaatgaatattctattaattttgggtggaaagttctgtagatgtccattaggtctgcttggtccagagctgagctcaagtcctcaatatccttgttaattttctgttttgttgatttgtctaatattgacagtggggtgttaaagtctcccactattattgtgtgggagtctaagtctctttgtaagtctctaagaacttgttttatgaatctgggtgctcctgtattaggtgcatatatatttaggatagttagctcttcttgttgaattgagccctttaccattatgtaatgccattctttatctttttaaatttttgttggtttaaagttggtttgttttatcagagactaggattgcaagccctgctcttttttgcttttcatttgcttggtaaatattcctctattcctttattttgagactatgtgtgtctttgcatgtgaggtgggtctcctgaatacagcacacagataggtcttgactctttatccaatttgccagtctgtgtcttttaattggggcatttagccctttttcattcaaggttaatattgttatgtgtgaatttgatcatgtcatcctgattctagctggttatttttcacattagttgatacagtttcttcatagtgtcattggtctttatattttggtatgtttttgtggtggctgataccagtttttcctttccatatttagtgcttccttcaggagctcttgcaaggcaggcctggtggtgacaaaatccctcagcatttgcttgtcttggaagtattttatttcttcttcactaatgaagcttagtttggctggatatgaaattctgggttgaaaattattttatttaagaatgtcaaatattggcccacactctcttctgacttgtaaggtttctgcagagagatccactattagtctagtggccttccctttgtaggtaacttgacccttctctctggctgtccttaagtttttcttttgtttcaaccttggagaatatgacaattatgtgtcttggggttgttcttcttgaggagtatctcagtggtgttctctgtatttcctgaatttgcattcattttgctttggattgctttggttattcaggctcttttttggctctaagtgaattttagaatagctttttgctagttctgtgaaaaataacattagtagttttataggaatggcattgaatctgtagattgctttgagcagtatggccatttcaatgatattgaattttccaatccatgagcatggaatatttttccatttgtttttgtcattcatgatgtcttttagccatgttttgtagttcttcttacagagacctttcacctccttggttagacgtcttcctaagtattttattttttgtgtgactattataaatgagattgcattcttgatttggctctcagcttgaatgttattggtgtatagaaaggtcactgatctttgtacattgatttcatatcctgaaacttcattgaagccatttatcagttccaggagctttttggcagtcattagggttttctaaatagagaatcatgttgtacacaaaaagagatagcttgacttcttcttttcctatttggatgccttttatttctttctcttgcctaattgctctggctaggactttttggtggtggtgttgttgtttgctttcatttttgtttctgttttgagacagggtctcattttgtcatccaggctggagtgcagtggtacgatcatgccttactgcagcctcaacctcaagtgatcctcccaccaaatcttgagtacaggcatatgccaacatacagagctaatttttaaaaaaattttgtagagatagggtctccctatgttgcccaggctggtcttgaattcctgggctcaagaaattttcccttctgggcctcccaaagcactggaattacagacatgaaccaccatgtccagtctatttctgtcatacatctaatttagccatgcagttagcccatttaacttttgtctctttaagataatacttaaattttcactcagtgtgtttcaagtatatgtccttattttacatgtgctattatctataagtataattgataattaaagaatttctacataattattctagtgcaactgagatatatatatcttcaaatttcaaaaatattcagttatgttatttcactggaaaatgtaacatattctttaaagctgtgggctacttggtacactaaacactgctccaaagtatagtgtcagttcaaattcagaagtgagtattttttaagtttatatttatatgcctctaaactgtctaatgataattcaggtcatgctttttcattggttggcattaaaaatctattattttatctctattgaacttaattaaatgctagtttgctcaaagtaccatgaccagtaataaattaaatatattcctggcaagtctattcaaaaataatatatctctcattcccattaaatgacactcatattataattataattccaaaggtaaagagggacattttctaaatatattttgatgatcaatttttttatattcacatatcacatctccagcacaaatacctaattagaaattttccttatcttaatctttgataatcatcacttttctcacgaagtaaaaatatacaactacagtctttagccacatgatagtttattgtgattagagcccttgtcaccaagtaaccctgcctatagttagaataattcttcacttacagacttattttcaggccacctaactagctatgtggacatataatgacatatatcgaccacataagacattaaattttaagaaaagaacacaaaaatgctcaagaaccattacactacaaggaaaacagcattatgtactagaagaaaacacagacctaaagcaaataaatactctcaggtaatatcattgttgtcatagtaagcgtgtaggaggcacagaacttcacagaggatgaaaaaagatactgagcttgtgtgtctcatggcttcctagagaagtcatcctatccagagtttcataggctgtatagggaattgctacatagatgagggggcattgtgagcctgtgctgggctcaggggccagacacatcatggtggtcttgggaaaccacaagtagtctggtactgttgcttccaaaagtgtgaaagcctgggggaggtaaacaggggccagaccacacatggcctcacagatcatgctaagaagcttgaatttaattatgtgggaaaggggaattactaaaaggttttcacaaaggaggccagtcaggagctctttgtttagtccaggtaagaaacgacagaattttatcaaatgacaccagcaaaacaaatggaaagatggaattcatacaggtgtagggtataaaatggacagatcttggtgtctggttagaagttcaacctgaggtgtggcaggaaagggagagacaagcagagcaggagtcccaggtagaacctgactcagtaagaacccagtccaacctctgccatgcattgtgcacctcagtgtccccacctctcagagaaggagtgagacaagattatctctaaggtcccttccaatacaaacatgttgtaatcctaccttatgaatctagcctttctgtagcacagagacaggaccagctccagtgttaggcagaaggctggagggacaaatatcactcaaaaaaaaaaaaaaaaagctcaggcttgccattaaaggcattgaatgcaaatagacacaaattattaaacatctttaaatgtgaacctatttgataagtgtgaggtcttatcatctaaccatctcatgtctgaaaggaaataagattgtaagttctttaagaaagacatcaatttcttgtggtattcattatctaatacactgtgcctgcttcaccctaaaaaaaaaaaaaaaaaaatcaaatgtgattgcttgattataatgttccgggcatttggaatattgttctacattggaaacgaattttatttatatcatcatctgagagaccatgtagtaatacataacatattcaaattgcctgccatacagactgcaaaagcctgagttttctctctccctctacaaaaggcaaacaacaaatcctcaagggtcttgtaaatgttacaggaagtttgtaagctaagtagatttttgcaatgctaacgatttttctttcttgccgagactcatttacttactcaaaatagcaacattccttttccttatatatatttcattttccttctccaaagccagagtttaagtacacaattctgaaaattgtcaatcagcctgattctccctgtggctaagctactccataattataagctagacatcctcttaggtcactagggtctcaagtctgtgaatatttataaaatagtctccccagtgagcaaataaatgttaatgcttctaccaaacgtgattaacaaaaaaacttattctcatgaagaagtgcataattgtaataagatcagaaattaactcaaactccaataacaattaacttagaattgtttttagtgtaggaaatattattgcaagctttaatctgtaagttatagtgtttctaagacaaaaacctcaaaaagcattaacacgcggttctcgaaggtttctgccggaactccatttatgcatacaactaattcacttatcctaccacatgtattcattcaaaacacatgttgaattccttttataagcaaagaatccagtatacagaagtaaataccactggcatggtccctagcctcatagaaattaaagtcaccaagtcgcctcctggcagagacagatagtcaacaagaagtattacaaatattgtttctccccaaggctgagccccagcctcactcccagcagcttccgcctgctgagttgaaggtacccatgttgtctgagcagctattcaactttttattacactgatggaggtactgggcaaggtagtagaaagaaaaagaaaagccagaaaatctagaaatgttaatgatatttagagtagaaataacagagctacttctgggaggaaaagagctgctactataagacaggaaacagctctatatactctgggttttgaccaatgttgctgaccacgatggaaaaacaaggactactgaatttatccccctgccatgaacaactagaaaaatggaaaaaacatgaaacaatggctttgtgttttctcaagggcaggcagtcaaaattttggggtttttttgaataaaatgccagatttcctcgaatgtgagctttaatggttggccttgtttgtgttatagttggacagctactagccatcagagatttagagccaaagtgcaatactcaccttgcctcagacaaaatattcactgcatatttgtgcaaaaggaacacctttactctggcagaaggaatattgcaattacagggtacagagatacaaagtggccattcttagacatttacacagagccagagagaaataatgaatactactctaagaattcttgatgggttcactaaactgaagaagctgaagaaatgaagccttctagcaactcagcttccatggatatcatatttcttaagaaattaggatctctggatgaagaaggtgatcaatggcagacaagttgggactacttcaaggcctttggtgcatttcaacatctgagatcagactgctgaagattcagctgccaccatgagtcaattgggtaagcacacataggaaaaagaatgctacttgaaatttgggaaaggtaggtaagtttcctagcaggcattgggactgagaaaacaagaggctgagtcatttttagagcatgccacagaaatgatgcccatgtgaatgacaaacataagagagaaatgctgctctctaagcaggagggactgggctgtactaggtattatgcatgtcatcaaaatgctcaggatctctgtatctgtggcagacaacttcacagttccacaaagagtatacagcagagtagagaacacctgggattcacagtctgatctcataaacctgagcctaagtgacctaaatcaaaggtcacgacctggttgtacttgacaggtagaatattttatttgatctgcacaatgttttagaaatcggaaaatttctcacagaaatctatactgttgcattctctgaaaagattagaaaaactagaacactaaataatggcagccagacttttctaaatggagcatggacccaccagtcccctcagtctctctcttctctatgctggttcatccaatatggcagacattacttctctgcttcttccttggaaatagctggctttctttaaggcagcaatgatgccagcatccagaaaaatacttactttggaaaacatccttttgcagcaaatggtggccatgtgacaatgttctggccagtaaaacatcaggaagttataggaaggccttacttttccttcttaaaagatgtgccgtgtgtgtgtgtgtgtgtgcgtgtgtgtgtgtgtgtgtgcgcgcaaagtggcagatggaggcattgcaagcatacttctcccacttggaaggacaaagtagcatgtagagattcacactgtgaactgtttttttcaagaagcaatgcaggaactaaacaggaaaaccaaaggaatccacagatcctttgaaggaaacgataggctacagcctatactgtaattcaagtgaaggattgtgagtccccagagtgtgaaagggggagagactgcctccagactatacacccctatgggggagcctgaaagtccaagccatgggggaagaccttaaccctatagagcacagaaactgacttaaggagagtcctggaatataaaagtaagagaaccagtgggaagaaccttgagggtactctcaatctccagcacagaccaagggaagccattcctaattggtcatcataggagacccttcagaagtcagccaaatatttcaggtagtggtcacaggttgaaagaagcccccacctgggtttcatgatataacctcaggtggggacaaactcctttggccagggatgggtgggggctgggggaagaggggacacaagtgaaaagtggactgcagctgtgagtgcagaagctgggcaccagtctttgcaggtggattgggaagtatgtggcctgaaatctgtggttgctgtctttacagggagaggttttgacctggggcagttgcgagttctgtgtgcaggctgcctagaacgtagctcactgctgccagtggaacactgaaggagatgatctgccttgccaagtgtatgggatccgtgtggggctgactgccacctgctactccccactctctgtgtgagcttgtctgtgcaggagaggcagcaacactcccctctagaacatcaacccagtggcctgagaaccacccctatcccccaaaacccacagaggctgctgcttgccctgcacatggagactcagaaagcaaacccacctgacccagcccctacctggctttgccctgccacccacccttgtagcttaacacaaaggacagaaacttttgggagctctatggccttacccactgcctgaggaaataaagtacccacccagggcaacgcaggcaagcaaaaatcccactgctactaccccagctggtgctctttagcaagtgccacctactggctggatgacaaccaacaaagaccattatagcatctcctagtagaataacactgtgcccaggaaggagaaaacagctgcatgacctcagctatcaccactgcctgtaccacttggactaaccaggaggtcctgagtctgtccacatgaccagttcattactactataaccagcacttgagaaagccaacacactaagattatcaatgagacttgaggagaagtcacatcagtggatcccttgcaacaccaacctggagtgtggcaacttcactgggtggctagatccagaggagcaacaacactcacagtagtctggctcccagggactcccactcctatggaagggggagtacaccacatcatgaaaacaccctgtaggacaaaagaatctacagagcaggccttcagcaccagttctttctgcttgtgggaagtttcagcagaagcacaattgcagtgctgtgttcagcagggaaactttgcagctctaatccaacagtcagacagccctagcacacatgaagggacttggagaagtggatgtctttcctccctggtgcgcaaccacaagcacagttggggcttctatcacaggagcttagtgtgggtgcaactatagacagcctttctggaacatatcagggtgaccgcatacctacaggaggagcatcctccaggttcaggcttgcacgagaaatagagtcacaattgctctctacttgaaacatcaacattcctacagacaaaaagaggtgcctgtctgatatgaatagccagagcactgggacaggagtgtgcctgagaggtagatagctttcctgctgatctggcagtggaactgagttggagttggatccaacccttccccctgataagaccaggtcagcaagaaagctctctgcctctcaggcacaaatgggtttaacagatgtttacagaaaattctacctaacacctgcagaatatacatgctcatcagcatatggaacattctccaagatagaccatatgatagaccacaaaacaaatctcaataaatttttaaaaattgaagtcatatcaagtattttctcagaccacagcagaataaaattaaaaatcaactccaaaagtaacccttagaactatacaaataatctgctcctgaattattttggggttaacaatgaaatcaagatggacatttaaaaattctttgaattaataataatgatgacacaagttatcaaaacctctgggatacagcaaaaagcagtgctaagatgaaagtttatagtgctaaatgcctacctcaaaaagtcaagtctgaaagagcacaaggtgacaactcctaaaagagctcctgaaggaagcactaaacatggaaaggaacaactggtaccagccactgcaaaatcatgccaaaatgtaaagaccatcgagactaggaagaaactgcatcaactaacgagcaaaataaccagctaacatcatcatgacaggatcaaattcacacataacaatattaactttaaatgtaaatggactaaatgctccaattaaaagacacagactggcaaattggataaacagtcaagacccatcagtgtgctgtattcaggaaacccatctcacatgcagagacacacataggctcaaaataaaaggatggaggaagatctaccaagcaaatggaaaacaaataaggcaggggttgcaatcctagtctctgataaaacagactttaaaccaacaaagatcaaaagagacaaagaaggccattacataatggtaaagggatcaattcaacaacaagagctaactatcctaaatatatatgcacccaatagaggagcaacaagattcataaagcaagtcctgagtgacctacaaagagacttagactcccacacattaataatgggagactttaacaccccactgtcaacattagatagatcaacgagacagaaagtcaacaaggacacccaggaattgaactcagctctgcaccaagcggacctaatagacatctacagaactctccaccccaaatcaacagaatatacatttttttcagcaccacaccacacctattccaaaactgaccacatacatggacactcttatagacatgcaaaatgctctggaaagtctcagcaatagaattgaacaagcggaagaaagaaattcagagctctaagacaaggtctttgaattaacccaatccaacacagacaaagaaaaaagaataagaaaatatgaacaaagcttccaagaagtctgggattatgttaaacaaccaaacctaagaataattggtgttcctgaggaagaagagaaatctaaaagtctgggaaacatatttggggaaataatcaaggaaaacttccccagctttgctagagacctagacactgaaatacaggaagcacaaagaacacctgggaagttcaacgcaaaaagatcatcacctaggcacattattgtcaggttatctaaagttaagacaaaggaaatcatcttaagagctttgagacaaaagcaccaggtaacctaaagaagaaaacctatcagattaacagcagatttctcagcagaaatcctacaagctagaagggattggggccctatcttcagcctcctcaaacaaaagaattttgtatccagcaaaactaagcttcatatatgagggaaagatacagtctttttcagacaaacaaatgctgagagaattcaccactaccaagccaccagtataaaaactgctaaaagtagctctaaatcttgaaacaaatactgaaaacacatcaaaacagaacctctttaaagtataaatcgtacaggacctataaaacaaaaatacaagttaaaaaacaaaaacaaaaaatcaaggtacacaggcaacaaatagcacaatgaatggaatgttacctcacatctcaatactaacattgaatgtgaatggcctaaatgatccacttaaaagatacagaattggagaatggaaaagaattcacccaccaactatctgctgcctacaagtgactcacctaacacataaggactcacagaaacttaaggtaaagggatggaaaaagacattttatgcaaatggataccaaaagtaagcaggagtggctcttatatcagacaaaataaaatttaaagcaacagcagttaaaaaggcaaagagggacactatataataataaaaggccttgtacaacaggaaaataccacaatcctaaacatatatgcacctaacactagaggtcccaaatttataaaacaattactaatagatctaagaaatcagacagcaacacaataataatggcggatttcaacactccactgacagcactgaacaggtcatcaggacagaaagtcaacaaaaaaaaacaatggatttaaactatgtctgggaacaaatggacttaacagatatatacagaacattccatccaacaactgcagaacacacattctattcaacagcatgtggaactttctccaagacagaccatatgataggccacaaaacaagcctcaataaatttaagaaaattgaaattatggcaagcactctctcagaccacagtggaataaaactggaaatcaactccaaaaggagtcttcaaaaccatgcaaatatgtggaaattaaataacctgctcctgaatgatcactgggtcaaaaaccaaatcaagatggaaatttaaaaaattcttcaaactgaatgacaatagtgacacaacctatcaaaacctctgggacacagcaaaggtggtactaagaggaaagttcatatccctaaatgcctacatcaaaaagtctgaaagagtgcaaacaatctaaggtcacacctcaaggaactagagaaataagaacaaaccaaacccaaacccagcagaagaaaggaaataaccaagaccagagcagatccaaatgaaattgaaacaaaaaaaaataccaaaagataaatgaaacaaaaagctggttctttgacaagataaataaaattgataaaattatgaagattaaccaagaaaagaaaagacaaaatccaaataagctcaataagaaacaaagtgggagatattacaactgacaccacagaaacacaaaagatcattcacggctactaaacatctttatgcataaaaactagaaaatctagaagagacggataaattcctgaaaaaaaatacaactctcctagcttaaatcaggaagaattagataccctgaacagaccaataacaagcagagagattgaaatggtaatttaaaaattacgaacataaaaagtccaggaccagatggattcacagcagaattctaccagatgttcaaagaattggtaccaatccttttgacactattccacaagatagagaaagagtgatccctccctaattcattctatgaagccagcatcaccctaataccaaaaccaggaaaggacataaccaaaaaagaaaactacagaccaaaatccctgataaacatagatgctaaaatccttaacaaaatactagctaaccgaatccaacaacatatcaaaaagataatccgccatgatcaagtgggtttcgtactagggatgcagggatggtttaacatatgcaagtcaataaacgtgatacgccacgtaaacagaactttttaaaaatcacatgatcatctcaataaatacagaaaaagcattcaacaaaatccagcatcccttatgattaaaactctcagcaaaatcggcatacaagaaacacctcaacataataaaagccatctatgacaaacccacagccaacattatactgaatggggaaaagttgaaagcatttcctctgatacctggaacaagataaggatgcctactctcaccactcctcttcaacctagtactagaagccctagccagagcaatcagacaacagaaagaaacaaagggcatccagagctgcccccttctgcgcggtcacgctgagccagcacctgggcctggaaccaggccacagccccccagctttgcccaccacctccctaccatggacgcccgcaaagtgaacgagcttcgggcctttgtgaaaatgtgtaagcaggatccgagcattctgcacaccgaggaaatgcacttcctgagggagtgggtggagagcatgggaggtaaagtaccacctgctactcagaaagctaaatcagaagaaaataccaaggaagaaaaacctgacagtaagaaggtggaggaagacttaaaggcagacgaaccatcaagtgaggaaagtgatctagaaattgataaagaaggtgtgattgaaccagacactgatgctcctcaagaaatgggagatgggcgcaaggctccggactccacggtgcagactgcacctcgcagtctccccaggtccgcgcagcagccacgcttcagccagaatactgggatcttcagtggcaggaggagtaatcagaagatggagatgaattttaacattattttggaagagattcttattaaaaggtcacagcagaaaaagaagacatcacccttaaactacaaagagagactttttgtacttacaaagcccatgctaacctactatgagggtcgagcagagcaatttttagtgatatcaaaaagtctagttttgaagatggccgaataggaacagctctggtctacagctcccagcgtgagcgacgcagaagaagggtgatttctgcatttccatctgaggtaccgggttcatctcactagggagtgccagacagtgggcgcaggtcagtgggtgtgggcactgtgcgtgagccaaagcagggcaaggcattgcctcacttgggaagtgcaaggggtcagggagttccctttccgagtgaaagaaaggggtgactgacgcacctggaaaatcgggtcactcccacccgaatactgcgcttttcagaccggcttaaaaaacggcgcatcacgagattatatcccgcacctggctcggagtgtcctacgcccacggagtctggctgattgctagcacagcagtctgagatcaaactgcaaggtggcagtgaggctgggggaggggcgcccacaatagcccaggcttgcttaggtaaacaaagcagctgggaagctctaactgggtggagcccaccacagctcaaggaggcctgcctgcctctgtaggctccacctctggaggcagggcgcagacaaacaaaaagaaagcagtaacctctgcagacttaaatgtccctgtctgacagctttgaagagagcagtggttctcccagcacgcagctggagatctgagaacgggcagactgcctcctcaagtgggtctctgacccctgaccccctagcagcctaactgggaggcaccccccagcaggggcacactgacccctcacacggcagggtattccaacagacctgcagctgacggtcctgtctgttagaaggaaaactaactaacggaaaggacatccacaccaaaaacccatctgtacatcaccatcatcaaagaccaaaagtagataaaaccacaaagatggggaaaaaacagaacagaaaaactggaaactctaaaaagcagagtgcctctcctcctctaaaagaacgcagttcctcaccagcaacacaacaaagctggatggagaatgactttgacgagctgagaggagaaggcttcagacgatcaaattactctgagctatgggaggacattcagaccaaaggcaaagaagttgaaaactttgaaaaaaatttagaagaatgtataactagaataaccaatacagagaagtgcttaaaggagctgatggagctgaaaaccaaggctcgaaaactacatgaagaatgcagaagcctcaggagctgatgcgatcaactggaggaaactgtatcagcaacggaagatgaaatgaatgaaatgaagcaagaagggaagtttagagaaaaaaggataaaaagaaatgagcaaagcctccaagaaatatgggactatgtgaaaagaccaaatctacgtctgattggtgtacctgaaagtgatggggagaatggaaccaagatggaaaacactctgcaggatattatccaggagaacttccccaatctagcaaggcaggccaacgttcagattcaggaaatacagagaacgtcacaaagatactcctcaagaagagcaactccaagacacataactgtcagattcaccaaagttgaaatgaaggaaaaaatgttaagggcagccagagagaaaggtcaggttaccctcaaagggaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatactctacagacaagcaaatgctgagagattttgtcaccaccaggcctgccctaaaagagctcctgaaggaagtgctaaacatggaaaggaacaaccagtaccagccgctgcaaaatcatgccaaaatgtaaagaccatcgagactaggaagaaactgcatcaactaacgagcaaaataaccggctaacatcatcgtgacaggatcagattcacacataacagtattaactttaaatgtaaatggactaaatgctccaattaaaagacacagactggcaaattggataaacagtcaagacccatcagtgtgctgtattcaggaaacccatctcacatacagagacacacataggctcaaaatgaaaggatggaggaagatctaccaagcaaatggaaaacaaaaaaaggcaggggtcgcaatcctagtctctgataaaacagactttaaaccaacaaagatcaaaagagacaaagaaggccattacataatggtaaagggatcaattcaacaacaagcgctaactatcctaaatatatatgtacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacatttttttcagcaccacaccacacctattccaaaattgaccacatacttggaattaaagctctcctcagcaaatgtaaaagaacagagattataacaaactatctctcagaccacagtgcaatcaaactagaactcaggattaagaaactcactcaaaaccgctcaactacatggaaactgaacaacctgctcctgaatgactactgagtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaatttacaccctaacatcacaattaagagaactagaaaagcaagagcaaacacattcaaaagctagcagaaggcaagaaataactaaaatcagagcagaactgaaggaaatagagacacaaaaaaaccttcaaaaaattaatgaatccaggagctggttttttgaaaggatcaacaaaattgatagaccgctagcaagactaataaagaaaaaaagagagaagaatcaaatagacacagtaaaaaatgataaaggggatatcaccaccgatcccacagaaatacaaactaccatcagagaatactacaaacacctctacgcaaataaactagaaaatctagcagaaatggataaattcctcgacacgtatgtgtctctcccaagactaaaccaggaagaagttgaatctttgaatagaccaataacaggatctgaaattgtggcaataatcaatagtttaccaaccaaaaagggtccaggaccagatggattcacagccgaattctgccagaggtacaaggaggaactggtaccattccttctgaaactattccaatcaatagaaaaagaaggaatcctccctaactcattttatgaggccagcatcattctgataacaaagccgggcagagaaacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaataaacgcaaatcaataaatgtaatccagcatataaacagagccaaagacaaaaaacacatgattatctcaatagatgcagaaaaagcctttgacaaaattcaacaatgcttcatgctaaaaactctcaataaattaggtattgatgggacctatttcaaagtaataagagctatctatgacaaccccacagccaatatcatactgaatgggcaaaaactggaagcattccctttgaaaactggcacaagacaggggtgtcctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctgataagcaacttcagcaaagtctcaggatacaaaatcaagtacaaaaatcacaagcattcttatacaccaacaacagacaaacagagagccaaatcatgagtgaactcccattcacaattgcttcaaagagaataaaatacctaggaatccaacttacaagggatgtgaaggaccccttcaaggagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaaggcctttcttcacagaattggaaaaaactacttaaaagttcatatggaaccgaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaattatctgatctttgacaaacctgacaaaaacaagaaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaactccaaaagcaatggcaacaaaagacaaaattgacaaatgggatctaattaaactaaagagcttctgcacagcaaaagaaaccaccatcagagtgaacaggcaacctacaaaatgggagaaaattttcgcaacctactcatctgacaaagggctaatatccagaatctacaatgaactcaaacagatttacaagaaaaaaacaaacaaccccatcaaaaagtgggcgaaggatatgaacagacacttctcaaaagaagacatttatgcagctaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaatagaaacacttttacactgttggtgtgactgtaaactagttcaaccattgtggaagtcagtgtggtgattcctcagggatctagaactagaaataccatttgacccagccatcccattactgggtatatacccaaaggactataaatcatgctgctataaagacacatgaactcgtatgtttattgcggcattattcacaatagcaaagacttggaaccaacccaaatgcccaacaatgatagactgggttaagaaaatgtggcacatatacagcatggaatactatgcagccataaaaaatgatgagttcatgtcctttgtagggacatggatgaaattggaaagcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtcacatgtaccctaaaacttaaagtataataaaaaaaaaaaaacagaactttaccattgttatgatagcgtaggaatcacaatgaagtattcttatgtgagaaatttgtttatgacaatctgtattacacattatatcatgtatcactattttatttaattaaaatttattttaaaaaaagatagtaatatctaggaccatatagaaaaccaacagatttctttatatggtccttagcacatgaagctagtaaaaatgaaattatttgtaatgggtatatgtagtcactcatttattcttattagctatataatagtacatatatacatacatacatactattctctaataacaatgtagaagacagtctgtatatataatgtatatagcataatgtatattgtatgatatagaaatatatttgagtgtattagaatgattgtaagtacaccaaatatctcactaaatgagaataattgagtcagcctgctttattatagatttgaataatatatcttaaagaaatttcaaatgaattaattagaactacctgaattatgacaaagatcatattgtaagacccagaagttgcacaaatcattgctgctctcatcctgttgtccagaatatagttgctctgccacagctatctgcaagagagtctgtgaaatatgtgaaatgttatatctaactgagcagccatgtgcccaactaagactcaagaggtctgttattaaaatattattaaaagtaagagagggggaccaggtagagtggaccctccatctctgacatatctagtcaatatattagacagatgtcaaatgaataaggcaaataacatttactgcagaaaattagatactgagcatatacagcatctgtcatataaattcataaatgattattaattgaaagtttttttgtccttaatctactgttatttcaagaaagttagagattttgtcctgtaacactgtttatctatatctggaaaatacccaaatttggttgctaagttaccagttgattttacagttgaaacctaattgaattaagtaatctttaataatagaagagaaactgcataagtaaatttaaaggaccctaagttaattccaattaatgattgtgcatagttctaaacaaaccagttaattatacagtacataagaactaaaaattaataaaagaataaatataaatcagcatttttcctgaatacattttatttcctttttctgctcattctcataaacgtagtcatcttttttgacacacctcatattaagatctatgtgtaacaagtatggattcatcagcattttcatgttgaataacaactaaaaaagaaaacataatagaattagaagatcagatatgtagactcccagtgatcagaaagcagagaaatgtccttcctagccttatgttctccagttactcaacaaacatctggccgggcatggtggctcacacctgtagtcccagcactttgggaggctgaggcgggcagatcacttgaggtcaggattctgagacccataggaggctgggactacagatgtgcaccaccacacctggccaatttttgtatttttgtatagatgagtttttactacagctcaccagcactctcaggcacagtgccatcctcatatacttctggagaggagaaggggtcactgttcccacatttaattccttcagctttttcctacacccatttttttcctccacattcctaggagatacaatcatttcaccatgaaagagtttccttattactgtgtctaagatggatgcaaatcagtggtttttaaaattaaaatataatttgaaatgatttgaatatacaatatattgatatttgccatttttgcagtgatatgatcgtggaaaagacatttattaaacaagctcaaaaagtaagttgtaatctcagaaacaagataataataggtgttcagtgtctgtcaaggaattagcattaaatcaatcacatatatgactaaatgcctataattaagggacagggctgatgcaagatattgcctgccccattttctttctgcattgcgtgattgagcttctcaagccagccttttctttattaatgtttactaatagaattccagcactttgccttgaaactataggtcatttgaattcctaataaaaataattcaaatgataataagaaaataacatttcctctccactacagttgcagaaaagcagatttagttttgtgacataaaatttaacatagaaacataattactaacaaataaatcttgtaaaacacttaggcttcaaagataattgctatgccctgtaaaagtaacttctagcaactaaacaatctatcgtaattgattgccttaaaaagttgttttcctagttaatatttgtacaaactcttccctatttgcccaggacctttctagttttagcactgaaagtcccacaacccaggaaaacccttactcctagataagctcaaagggttggttaccctgacaccattatgttctagaaggtacaaatgcatgtaaattttctttgtaaagtcagaacagaattattgctacttagctcttttcccttaagcaggaaggtagtaaaacctacaactgcaatattccttgcttaaacaaagagattaaggatctgtgcctcacttaaattaacaatgcaaacaactgtaaactacaaattttcataataattttaaataagtcaaagtgccctgagtcccataaaatagacatacatttttggtttgttaagtactcaaaataaaaagaaacatgttaaatagttctaacatgtaataaaatagatttataattaatttcaaactgacaacaataattttggtgttctcttaaaacttagagaggctttgagtagaatggtttaatgagctcagcactatttaaaaactgccctgactagaatgaatcttgcagtgctggattagaattagtgatatcagtatgaactcatttttagcttaatataaaaacagatggatagacataataacaattataaatatgtgtacatacatctatatagatacgagggttagtgcctatgtgtgttacctagctctgtcctcagagaaggcctagaagcaaagacaacctagtagcaattagcacacccaatgactgatcttggacataggagccaacatgaaagagtttccaatggccacagctgaaaaaagttaaacaacaaaataagtaacataacatagaattacaactcaaaatataatatatgtataagattccactaaatttgtaataaagaaaaaaataagggcaataaaaacaagaaatgaaaggttataagagacaagaaagtggatattggcaaaaaatatatttcagaatacatttggaagaaggaaaggagttggaaggttctggaaactgattaatcaaaatggagaaaaacatgaacaaaactgcttacagagggacaattttcctcatcaaatcttgtgaatgctcagccagattcaaagtaaggtagagttgaggcacagggctggagcaggggctttggttaaaagttcatatgtgaaacattcgtgttcccccttaccttctacacgctaggtataaaatcctgggagccaggtgtccattctcaagagggcaccttctcaaggaaaattgagaggctcaagagaaaagatgctctctgataccatagattaaatcttcggaggtagtcaatatatggcatctatgaaacaaggatggaatgttgattctttcagctaaaaggggtatcagaagcaaaaaaacaattggaagaggcaaattatcagagaaataatactagagaaattctcagagatagaaaagtcactagactgaaaattcccactgagtctccaaaatactgatttaaaaaaactgagttaaaaagaaagacctgaggcacattattagaaattttataatgtatataatgccagatttgaatacaacaaatgagaaaatataggttacttgacaaagaatgagaatgacctggggtttctcattagtaacactggatgttgctagaggacaggcaagcagaaccttcagaaatatgagagaaaattattttcagcaattaatcttctactctgcaaaattatcagtcaaatgtaagataaaataaatatatatttgtaaatgtacaaatttaaataaattctgcttaggttaatttaagaatttctaaacaacatacttcaagaaaataatagagctaaccataaagagaaaagtaaggaaacttgaaatggttcaatctaacaaaatggctaagggaagtccccatatgcagctgaacaacaaatctagagaacaatcaggccaacagtcaagagcaaaagaaaacaggccttcagggaaaaaaggagaggaggtcaaataagttttcatacaaaatgtagaaaatttagaaaaatgtaaaggtacatggatggaaattggacaaaacaagaaggaacacttagaaacattaggaaaaattttaaactatataataaatgaatgtatttaagaaaatattgatttttgataacttaaagtagatgtatcttgaagtagctatatctatacctactttaagtgacatatatacatatatgtatatatacatttatgtgtgtatatatatctacatatatgtacacatatatgtatatatatgtggaaggctatgggaggggagggaggtgtccctaaacagataaatctttaccagtgaaaacaggaagtcaataagtcatctctctcaatttgaaaaataagaatataatagcataagcatatcattgtaaataagaacataaccactgaaaataaagcaaataaaggagttaaaaattattgcttcttcatggaggtggcaatggatagtggattgctgcctttacatgttctatcactaagtaatgtttttaatatgtatatttttatgttaaatttttatatttaaaagtaaaatattaaagaccttacattttaaaaatcagagaaataataccagagaagtactcaaaataaggggtagaagtgtttagcgcatggcccaattatattattttgaattattaaagattaaagaaaagattcagagatagaaagaaccttgtgttaattccagtttattttcttgcctgtattttctttctttttattttactcaatagatatttttcttgagcatctaacagtgccaggtaccattcaaggaactgggggatattagtagctgaaaatcaaaattattgctccacagagctcattcctagctgggggaacagataatttaacaataaaacatagcggatattaagacatgatcaattcttagggaaaaaagagcagcagttaaacatagtcatttcacagaaaattctgagtgaattaagcatttttaatagtttcctgctttctgtcaacctgctaatatttcctaaatcttagattacagctatttttcaaaggtacttaaaagttgaaagaataagccaataatcaaccacatacccttcacctaaattaatcaattcttaacaatttgctacattggcttcctcttattctcagaaagatagatagcagatagatagaaagacagactattttatagattgatagatgatagaccaatagataaatagatgaccatgttacagtatttaactttttactcagctgcttcaagataaattataagcatcattactttacctctacttcactgtgcatctcctaaaaataagagtattttctcaaaaactacaggccaatgtccccagtaaacactgacacaaaaatcctcaacaaaatactggcaaacagaatttaacagcacatcaaaaaattaatttaccacaatcaagtagactttttacctgggatacaaggttagttcaacatatgcaagccaatcaattagacacaaacaaatggaaaaatattccatgctcatggactagaagaatcaatagcattaaaatggtcatacagcccaaagcaatctacagattcaatgctatttctatcaaactgccaacatcatttttcacagaactaggaaaacttaatataaaatcaaaataaagcatgaatagacaaagcaattcaaagcaaaaagaataaagctggagacaccacattaactgacttcaaactatgctataagtctacagtaaccaaaacagcatggtactggtagaaaagcaggcatatagatcaatgaaacagaataaagaatccagaaataaaaccacatacctacagccatctgaccttcaagaaagtcaacaaaaataatagctattcaacaaatggtgctgggatagctggttagccatatgcagaagaaaaaaaaactagaccccatcctttcaccatatacaaaaattaactcaagatgaattaaagctctaaatgtaagacctcaaactataagaattctagaaaaaaagctttgaaaacaccatctggacattatccttggaaaagaatttatgagtaagtcctcaaaagcaattacaacaaaaacaaaaattgacaagtgggacctaattcaattaaacggtttctgcacagcaaaagaaactaccaacagaataagtagacgacctacagaatgggagaaaatattagcaaactatgcatccaacaaaggtctaatatccagaatctataaggaacttaaactgaatgagaaaaaaaaaaaaaaaaaaacagaaaaaggtctggcgcagtggctcacgcctataatcccagcactttgggaggccaaggcgggcggatcacgaggtcaggagatcgagaccatcctggctaacacggtgaaaccccgtctctactaaaaatacaacaacaaaaaaattagccaggcgtggtggtgggcgcctgtagtcccagctactcaggaggctgaggcaggagaatggcgcgaacccaggaggcggagcttgcagtgagccaagatcgcaccactgcactccagcctgggcgacagagcgagactccatctcaaaaaaaacaaacaggaaaaaaaattaaaaaacaggcaaaagacatgaacaggtgcttctcaaaagaagacatgcaagtgggcaacaaacgtacaaaaagatgttccacatcactaatcatcagagaaatgcaaatcaaaaccacagtgagatactatctcacactagacagaatggctattattaaaaagtcaacaaataacagatgttggtgaggttgcagagaaaaggggatgcctgtacattgctggtgggactgtaaattagttcacccattgtggaaatcagttgggcaatttctcatagaaatcaaagctgaattaccactcaacctagcaatctcattagtgggtctatagccacaggaaaataagtcattctactgtaaagacacatgcacatgtatgttcattatagcactatccgcaatagcaaagacatagaatcaacctaaatgtccatcagtggtaggctggataaagaaaatttggtacatatgccacatggaatactgcacagctataaaaaaagaatgaaatcatgtcttttgcagcaacattagagctggaggccattatcctaagtaaagtaacataggaacagaaaaccaaataccacgtgtcctcacttataagtaggagctaaatattgtgtacatgtgggaggaagggaaccgcagacaccagagtctgccttagggtgaagggagggaggagagtgaggatcgaaaacctacctatcaggtgctatgcttattacctgggtggtgaaataatctgtacacaaaaccaccataacacataatttacctatataacaaatctgcatgtgtacccctgaacctaaaaaaaaaaactgtttttttaaaaaagtttaaaaaaaaacagttgctagcaaggctgtgaagaaaagggaatatttatacactgtcagtggggacgtaaattagttctgccacagaggaaagcagtttggagatttctcaaagaacttagaactgccattttacccagaaatcccgttactaagtatatatccaaaaaaaagtaaatcattctaccaaaaggacatatgcattcacatgttcatcatagcactatgcacaatagcaaataaatggaatcaacccaggtacccatcggtggtggaatgaataaagaaaatgtacatacacaccatggaatactatgaagccataaaaaaagaatgaaattgtgtcctttgcaggaacatgaatgcagctgagggcctttatgttaagcaaatttacacaagaacagaaaactgaaaccacaggttctcacctataagtgggagctaaacataaagatcaacatagtagtcatggacataaatatggcaacaatagaaattgggactattagaatggggaggtggtgagaggggcaaggattgaaaaactattgtgcactatgctcagtaactgagcaatgggatcattcataccccaaacctcaacatcatgcaatatacccaaataataatactacacatgtaccccctgaatctaaaataaaagttgaaaagaaaaagcatcacagctaggcagaggcaaacaagctcaaaagctggtgacctttataatggaatagcacaatactgggtcaatactgcctctgctttttggaagaatgtccatgtactacgaatagaggctctagtgtcagggaaaatagcatattaataatggtcaatttcttggctctttcttgtcacttttagcaaaatctgtgagggagaaataaacttaataattatcaagtctgcaaactgaaattaaagagaacacagctttaaatctgttctctgcctgtgggctgcaatcaaagttgaaagagagaaccattttgaagcctccaaattacaacagcaaccattgttttcatactttggacaaaagcagtaataagaggtgtctgtaaaacgaccagatcgagattatgacttcccactggaaccattatttcaagtgtcctcaagagatcagccttgaagctgaattaaaccattggagagaacaccaaagccaaaacttttttaaaaatgagacttttcaggctttagaattatgtatctatagaaaagccagagtactatcatcgtttttgaaatgcatataaagctactgcagcagcccaagactacaaccttgaaaaatgtccctgcccccttgacttctatcttagagagaaaaaaccagctgctcactagcactcaatagtctaccctaaagcagttatatcagaagtgctgaaagggaggaaatctgttgttggttttctttctccttaggaggtctagctgctgttggctagactaatgacaagttaattcaatcagaagcagtcttctgggttacccttctgaccaacataatgttacctcataacctttaatactttctgagtcaaaatattttaatgctggtctttgatacttgtcaagggaagaaaaaaatgtaaaatacgtctatgtcttttcaaataaattacttaggttagataatcacaaagctagaattcagagatagctcttacatacctcatgaaggaggtgaagcttgagggataggtagaatttaaattaactgaagattatttcaagcagtataaacagcatacacaaaaggctgtgagaagtcctgtggcctgtgcatagaaagctggactggtttcactgaagcttcaggcataaatgaagggacatgttgggtagggacttgagtacaaagtaaaaacattctaactttgtcctataagtaacaagggttcttagagaacaatgggtgatgtttgaaaacactgttttagtaagagttatatagcaatgccccaaactaaaccagggagtcagccaggactcaagaaacagcacaagttcaactaaggagagtgaataagcaaaatgcagtaagttgatgactaaactagcaagcccctttagtgctcaccagcagtcagggatggcaggggtaaaacggagtcaactctgcttgtttggaaaaactcttctatttgtatttctacagaattagactaataccaatttgaagacttaggtcacatatgatggattatccttgccacttgagaactttttaaacctttcctttttcctttccctaattgtttcatggtagatcatgaatgcatcaaggagcaacaagagtcagatctgtgactcatccatcgagattaaaatctgcccaaatacataattaagtgactatgaatgtgttgaaaatgccaaaataaacacagacagaggctcttctaagcttcctaagcaactttgaatttttttcatcaatttgtataatatactctctgcaagctttaatagagacaggacacaaaacattgtctttactcattctcatttatgtccatcagattgcgttaccttgcctggtaatgtactagaatttcctctgaattttagacaaggtgatcgtgaaatgtggtacagtctcaggtggtttagcaaacaaccttccacatcagtgcagttatctcagcctttaaaccatcagctctggattataaatttgatctgccagcttatgaacttgagtcaaagacaaagaacattatgccttgctttgaaaggggattagaagcaaaaatgaactcaagtgttaaaaaaagtactaaaaaataatgaaacaaaaaatatattatcagtacctctctaagcaacaggatatactaacatgaatacaacagcaatgttactatttgctaggatttctctctctctctctctctctctctctctctctctctctcattctctctgtttatctcttacctttcttttctttggtacactatatccttttaaactatgtttgcccaaaggcaaagatagtttttgctggtatttttctacctctgaagagaaaacaagggtgagtgtcatttgaagatggacagtatcttatttgttctgttggaactcctgcacactgcagagacttggtaaaagcttaaaaataaggaggaaacctttcagtggtaccatcaagatcaatgtccaaggttatactaagaacaagaattttaactccacaattcctgcatttgtattctcatagatatagaaaaacccttctgaactcaggcacttaaccaacctggtcctagcttataaagaagatgataattctgattatcatttttcctcctttttcctactcctaaaaaaaaaaagcatagccctcaagcagaaattaactggacattttcttttttagtttaaagatttatttgactaataacgttgtctaaattatgggaccgttttcttagcaggttaccatgctgtgttaacaaggagacaaagacgattgtctggtgcagaaccctaggagctcttcctgggttgccaagtgttattgattgaattgtgtcccctacaaagatatgttaaagtcacagtgtctagcgcctgtgagtgtgatctcattcagaaataagttatttgctcatgtaatcaaattaagatgaggtcattagagtggtccctaatccaatatgactagtgatcctacaagatgagaaaaatgccgtgtgaagacagagatacatagggagaatgtcatgtgacaacagaggcagagattggaatgacacagctgcaaatcaaagaatgtcaaggatttttggccaccctacaagctaggaaaaggcaaggaagcttctgcccaaagtctcggaggaagcatcatatgaaaatgccttgatttgaacttctggccttcagaactgtgagagaatgaatttctgttgttttaagccacccattgtgttgctttgttatagcaccctgggaaactaatacagtcagcaatgagctagttgaaaccaatagctttccctttttccagtcagaggaactgcaccagaacttgacttctcatgggacagatacccccaatagtctctaggttctgggcagctgacaattcccaacatgccttaaacagccatttttctcctattttaccaggcatctcatactctgtccccattaaaacgtagagcaatgggaagtagagatcccctgcagaagcataggccaagcacagaatactagaaaaataagaggagtgtcacaactgctgacttgccactcattagtgccacctgcaccgagtgacacactggaacttgccccatgccctttgcagcacatataatgcactcaataaaatctgacattccatttacatattaaatgacatttggaatatgcatagagctcgtattctagagtcatgatgtctggctttgaaagctgtctcctgcacttactagcaatatgaccttgagcaatgtattaccctttttggccttggtttccttatcataaaatgaagttaataaaagataacaagaatttcctctgggtgtccttggaaaagttaaatggaaaaaaaatccatgtgaagtggtgcacacacttagaatacaagttctatataagttgctttggttggtacttcttttgcctgctgtaagcctaaagtaacagaaaatttatttctcatgactgatgaagcattaccagtctcctagagtgccaggcctctatcttcttacaactatcacactgacaaatttcactggctcatcattttctctttcatgaagtcattcttgggtttcacgtccttaaagacagctatgattcctgtttcgattattactttccctaaatcaataagcaaaacaactacttaaatttttgtacttaagaacagatctgtctgaaggcctccaggccctatcagatgcatacaaatggtgattgatgaatgtcaggtatgaccatcacagtcattctgttgctttcttactgaactgaaaacaactagccaccatatcccaagagagttttaaattgtctttaagttttttcagatgcatagtttgcactcatctagccatcaaaatgtctataatgtagcaaaagctaatgtttgaacaagaaaatattgtgatattaaattcattttgatccctcacttattgggaataaccactctcacagcattgagttatttgcagagaaaagcgttgcacataacagcctaaacctttctttctatctcattattaagatgcaaaacgcccccgtccacacacacacacacacacacacacacacacacacacacacatgcatgcacaaaaatataagggagtttttttttaatacaaatgcaagaattccaacatcaatcatgaaagcctttgggatccatttttaggtcacaacatatagttaaattttagtcaatattttaaaccaagcataacataatatgtcattataaaatccatttcaacaaatcatgctttctttacataattaacttaaagaattaagtggtgactcactagctaaaagaaaacaagtcacaacttgtccttataatgtaaacctatgttacgcatttaatagcgaaagagagtggaggtctcattcaataacctaaataaatacatacatgcataataaacaataaataaagcaaaagaagtccagaagaacagtcctttacttttgtgttcccactcgaggtcccagggagtatttgggaggcatgcctccaaattactcaacttctccattggaagcttctccatagacctggtaggaagagggagctttcagtttagagcctctaagccacttcaaatagccaacttcttctcctcagtaagacaacccatctgtttttgaacttctcattcttttcctctcctttaaatctcaaagtccatttacccccttttgcttaccaactgtaccaggtcaagcctatttatactcttcttagttttcaaagcagttttgcccatctcttttctcatctgcatctccagatatgagagaggtggggtgggatagggtgggaagagctccatttagggtctggcccagactgggttatctatgagataagatgaaccttcaaactattcaagcagaccttctcttgacatatcccatttataattatgcttcaaaacaaaaggaagcctctgtctctttttttagcaccttttaaattgcttttaaaaggcctccttagttacccataatttggtatattttaagctcctgaaattgggtgaggcacgagaaggaggaacccaaccctatgacatgtatattacggttattattaaaaagaaattcataaaataatctttaattatatgctaattttaaaacattttacttgaattacaaaatgacaactttaattactaaacaaattataaaagtatataggtctgtgaaactgtccaagagtcaaaaggcagtcgatctactccattattctagactactaggacttctctgatatgtcctgctcaacaattgattgtatcactttgacactttttaaagaccactgattcttgatgttattgatttttaaattttccctttgaaaactttaaaacaatactaagaaaagaacaaagtaatgaagaaaacagtaatgaaaaaaagctagaaaacactctatgtgtatgtgtgtgtcttattgttattgttgtcgacaatctcatttgttgacagcaagattggctttggagaccaccgttatagactgaattgtgcatgccccccaccccaaaattcatatggtgaagccctaagctccatgtgactatattggagataaggcctttaaggaggtgactaaggttaaatgaggccataaaagtggatccctgttccaataaaactagcatccttataacagaggaagagataccagtgagctcactctctgccatgtgaggacacagtgaaatggcagctatctaaaagctaggaagagaagccctcaccagaaactaaagcctcctggaaccttaatcttggacttcccagcctccagaattgtgagaaaataaatttcttttgttgaagccactcattcaatgatattttgctatggcagcccgagcacattaacacaaccactgaatgtttgacagagtaaaggaagggctgcataatatgaacggtttgagaaaacctgtcctaagacaaaatcaccattttgaaaacacattgcatgtgagtcttcagcaatcttttgattttctttttaacagattaaggaattatttgggcgagcttcaaaaactacaaattcctgggccacagtctcaggaattttgattcagtaagtttagggtgggctctgattctgttttgtctcatttcattgtttcatattccccagatgattctgatgcctagccaggtttagaaaccactgctccagggtatccagaaataatagagggtagtaaatgaaatcccctcctcaagtgttttctcctcctcctcccaaagctgcctgttccctatccaccctttttcttacaagtaaaataaatttaaagtagtcaggctgttgaattgaaatcagtgtgtggaaattttctgttgaagaacaagaaactcccccccaccaccctccagtcaatcaggtgatatgcacgagagcaagacaaaacccttggtaagtcactgcatccattctcaacaggtctgttatagatcttcaggtatttgtattcaaactttctttctggattaatctatttactttttttttaccttcacatttgaaacccatagttttcatgagtaacccaagtctctgaataggcctttccttcataagaaaagaatatgggaaggtcacagcaatcccattactgggtatatacccaaaggattataaatcattctactataaagacacatgtacgtgtatgtttattgcagcactatttacaatagcaaagacttggaaccaacccaaatgcccatcaatgatagactggataaagaaaatgtggccacagaatactatgtagccataaaaaagaataagatcatgtcctttgcagggacatggatgaagctgtaagccatcatcctcagcaaactaacacaggaacagaaaaccaaacactgcacgttctcactcataattgagagttgaacaatgagaacacatggacacaggcaggggaacatcacacactggagcctgtcgggggtgggggcaaggaggggagagcattaggacaaatacctaatccatgcagggcttaaaacctagatgatgggttgacgggtgcagcaaaccaccatggcacatgtatacctatgtaacaaacctgtgcattctgcatgtgtatcctggaacttaaagtataatttttaaaaaatatttttaaaatggaatatgagaaggtcaaaaccaagccttgaatttatgtctctggagcctgggatgtcaagcaatcggctgaagctggggtgtatgtggagcctggagtttggggagaggcagctctgcagcctttgttccctaccagcaatctctcccaatcctgggtggtgtacacacctccctccatatgcaacacagccctgaggcttaaaccatatcccaaggctgggaccatttcagctataacaccagggacccttcttcacaaggtgaggagagaggaaggagtcattaattcaaagagaaaggtaaaatactgcaggattccacaaacagcactgcaattatgatcactgaagttcctagagctaaaattttgagagaagctctcatgggaaactcacttgatccattttccttccagagactcacttgaggaagtacttgttgataatcgttttcaaaagctgaaacagctaaatttaaaaacctctttttttttttttcaatgccaagcctttttggaaagattgtggccaattccctctgtacagacacagaatctatgtggaattctcatactggcccagtcacctgtgaatccaaggatttgttgcaacagaagaaagtttgggccctgtcacacatgcattttttgcacaccaagctcagaaaaagcaagtatatgtctttcatgcttcttcccatttcagtgccctcccctcaatacaggctcatcccttttctctctcccaggatcctaaatatgcccattatatttggtataaatctttgtacaaggttttgcataaatctttaagaagcaagctaatgacaaaagtactaactttggagacagcagaactggattctaatccaggccctatcaatgaccaggcatgtgactctggaccatgcttttctcagtccatatctgttcataaagaagtacactgtacattaaccctcatctgtacataaaaaagctctcatccttcatctgtacataaagaagtacattgtacactaatgtctatggtgtctaatttctctaaaattttctgggatctgatgaataaatttagaaatttcatttagggagggagccaagatggccaaataggaagagctccggtctacagctcccagggtgagcgacacagaagacgggtgatttctgcatttccatctgaggtaccgggttcatctcactagggagtgccagacagtgggtgcagaacagtgggtgcagcgcaccatacacaagccaaagcagggcgaggcattgcctcactcgggaactgcaaggggtcagggagttccctttcctagtcaaagaaaggggtgacacacggcacctggaaaattgggccactcccaccccaatactgcgcttttccaatgggcttaaaaaacggcgcaccacgagattatatcccacacctggctcggagggtcctacgcccatggagtctcgctgattgctagcagagcagtctgagatcaaactgcaaggcggcagccaggctgggggaggggggcccgccattgcccaggcttgcttaggttaacaaagcagccgggaagctccaactgggtggagcccaccacagctcaaggaggcctgcctgcctctgtaggctccacctctgggggcagggcacagacaaacaaaaagacagcagtaacctctgcagacttaaatgtctctgtctaacagctttgaagagagcagtggttctcccagtacgcagctggagatctgagaacgggcagactgcatcctcaagtgggtccctgacccctgaccccggagcagcctaactgggaggcaccccccagtaggggcagactgacacctcacacggccgggtactcctctgagacaaatattccagaggaacgatcagacagcagcattcgtggttcacaaaaatccgctgtcctgcagccactgctgctggtacccaggcaaacagggtctggagtggacctctagcaaactccaacagacctgcagctgagggtcctgtctgttagaaggaaaacaaacaaacagaaaggacatccacaccaagaacccatctgtacatcaccatcatcaaagaccaaaagtagataaaaccacaaagatgaggaaaaaacagaacagaaaaactggaaactctaaaaagcagagcgcctctcctcctccaaagatacgcagctcctctccagcaacggaacaaagctggacggagaatgactttgacgagttgagagaagaaggcttcagaagatcaaactactccaagctacaggaggaaattcaaaccaaaggcaaagaagttgaaaactttgaaaaaaatttagacgaaggtataactagaataaccaatacagagaagtgcctaaaggagctgatggagctgaaagccaaggctcgagagctacgtgaagaatgcagaagactcaggagccgatgagatcaactggaagaaagggtatcagtgatgaaagatgaaatgaatgaaatgaagcaagaagggaagtttagagaaaaaagaataaaaagaaacgaacaaagcctccaagaaatatgggactatgtgaaaagatcaaatctaagtctgattggtgtacatgaaagtgacggggagaccggaaccaagttggaaaacactctgcaggatattatccaggagaacttccccaatctagcaaggtaggccaacgttcagattcaggaaatacagagaacaccacaaagatactcctcaagaagagcaactccaagacacataattgtcagattcaccaaagttgaaatgaaggaaaaaatgttaagggcagccagagagaaaggtcgggttaccctcaaagggaagcacatcagactaacagcagatctcttggcagaaactctacaagccagaagagagtgggggtcaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaaaaaccggtaccagccactgcaaaatcatgtcaaattgtaaagaccatcaaggctaggaagaaactgcatcaactaatgagcaaaataaccagctaacatcataatgacaggatcaaattcacacataacaatattaactttaatgtaagtggactacacactccaattaaaagacacagactggcaaattggataaacagtcaagacccatcaatgtgctgtattcaggaaacccatcttacatgcagagacaaacataggctcaaaataaaaggatggaggaagatctaccaagcaaatggaaaacaaaaaaggcaggggttgcaatcctagtctctgataaaacagactttaaaccaacaaagatcaaaagagacaaagaaggccattacataatggtaaagggatcaattcaccaagaagagctaactatcctgaatatatatgcacccaatacaggagcacccagattcattaagcaagtcctgagtgacctacaaagagacttagactcccacaccataataatgggagactttaacaccccactgtcaacattagacagatcaatgagacagaaagttaacaaggatacccaagaattcaactcagctctgcaccaagcggacctaatagacatctacagaactctccaccccaaatcaacagaatatacatttttttcagcaccataccacacctattccaaaattgaccacatagttcaaagtaaagctctcctcagcaaatgtaaaagatcagaaattataacaaactgtctctcagaccacagtgcaatcaaactagacctcaggattaagaaactcactcaaaaccactcaactacgtggaaactgaacaacctgctcctgaataactactgggtacataacgaaatgaaggcagaaataaagatgttctttgaaaccaacgagaacaaagacacaacataccagaatctctgggacacattcaaagcagtgtgtagagggatatttatagcactaaatgcccacaagagaaagcaggagacatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaacattaatgaatccaggagctggttttttgaaaggatcaacaaaattgacagaccgctagcaagactaataaagaagaaaagagaaaagaagcaaatagacacaataaaaaatgataaaggggatatcaccactgatcccacagaaatacaaactaccatcagagaatactacaaacacctctacacaaataaactaaaaaatctagaagaaatggataaattcctcgacacatacaccctcccaagactaaaccaggaagaagttgaatctctgaatacaccaataacaggctctgaaattgtggcaataatcaatagcttaccaacaaaaaagagtccaggaccagatggattcacagccgaattctaccagaggtacaaggaggaactggtaccattccttctgaaactattctaatcaatagaaaaagagtaaatcctccctaactcattttatgaggccagcatcatcctgatatcaaagccaggcagagacacaaccaaaaaagagaattttagaccaatatccttgatgaacattgatgcaaaaatcctcaataaaatactggcaaaccaaatccggcagcacatcaaaaagcttatccaccatgatcaagtgggcttcatccctgggatgcaaggctggttgaatatacacaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaagactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctcaagctgataagcaacttcagcaaagtctcaggatacaaaatcaatgtacaaaaatcacaagcattcttatacaccaataacagacaaacagagagccaaatcatgagtgaactgccattcacaattgcttcaaaaagaataaaatacctaggaatccaacttacaagggacgggaaggacctcttcaaggagaactacaaaccactgctcaatgaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttcaagttcatatggaaccaaaaaagagcccacattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccacgtacctacaactatctgatctttgacaaacctgagaaaaacaagcaatggggaaaggattccctatttaataaatggtgctgggaaaactggctagccatatgtagaaagctgaaactggagcccttccttacaccttataaaaaattaattcaaaatggattaaagacttaaacgttagacctaaaaccataaaaatcctagaagaaaacctaggtattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacagaatgggagaaaattttcgcaacctactcatccgacaaagggctaatatccagaatctacaatgaactccaacaaatttacaagaaaaaaacaaacaaccccatcaaaaagtgggcgaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaactttgtggaagtcagtgtggagattcctcagggatctagacctagaaataccatttgacccagccatcccattactgggtatatacccaaaggactataaatcatgctgctataaagacacatgcacacgtatgtttattgcggcactattcacaatagcaaagacttggaaccaacccaaatgtccaacaatggtagactggattaagaaaacgtggcacatatacaccatggaatactatgcagccataaaaaatgatgagttcatgtcctttgtagggacatggatgaaattggaaatcatcattctcagtaaactatcgcaagaacaaaaaaccaaacaccgcatattcttactcataggtgggaattgaacaatgagaacacatggacacaggagggggaacattacactctggggactgttgtggggtagagggagtggggagggatagctttaggagatatacctaatgctacatgacgagttaatgggtgcagcacaccagcatggcacatgtatacatatgtaactaacctgcacattgtgcacatgtaccctaaaacttaaagtataataataataaaataaaaataaaaataaataaaataaaaataaaaaaataaaataaattaaaaaataaatttcatttacttatgtatgaagagaaaaagaaaataaaaccacttaaaagggcttcaacatgtcatcttctaacttctctaggcctcgatgctggttccagattgcctggtttcaaaccccagtttgccacatactggctgcagatttgggaaagttacttaacctcttcataacagcctaccaatataaaagatgatgacaataatagccttttccccacaaggatgatgcagggactaaatgagccaatacatgaaacatgtttatagcagtgctgcaaatagaaagagttcaataaatgccaggctctattatcatcctattgtcataacgtgagaataacaacctgtcttcacttcttcccatggttcgtgaggatcaactaatataatgaatgtcaaagtgatatgtaaattacaaagtactatttaaagggaaagaattatacaaatgttcacaagcagatgaatgatttttaaaagtatggcatatccataaatggaaaacattttggcaattgaaaaaaaggaactactgatacatggttcatatggatgaatccaaagacatttcactgagtaaaagaagctagacgcaaagactgaatatttatatgaaatgcctagaaaaggcaaatttataaaacagaaaacaggtggggcgcggtggctcacacctataatcccagcactatgggaagccaagacaggcggatcacctgaggtcgggagtctgagaccagcctgaccaacacagagaaaccccatctctactaaaaacacaaaattagccgagcgtggtggtacatgcctgtaatcccagctactcgggaggctgagacgggagaatcgcttgaacccgggaggcagaggttgtggtgagctgagatcgtgccattacactccagcctgggcaacaagagcaaaattctgtctcaaaataaataaacaaacaaacaaataaataaataaaacataccagtggttgcctaggatggttttgggagtagagagtcaccaaaaatgggcatgaggaaactttttagagtgatagagacattctacaactagactgtggtgatggctgcacaattctagaaatgtactaaaatcattgaattgtacatgcataatgagtgaattttatgttatataaattatccctcaataaattattaaaataaataataaataactataaagtaacagtgttatcatcacctgatatgttatttcataaacagtatgtttcttagaaaatgatttggaattgccagattttatgaagatagggaaagtgctttgaaaattctaagtttctatacaaactaacaatattattaataaaaacaaataataaacccattttaaagaactctgtgatttgtctaccccacatgtactcaccctgccaaatactcccaggtcaggaagctgctcctttagtgaccctgagttcttccttcctcccacgtgcagtccactcactcccataacccagctttccctggagctctattagcccatcctggaacacactgcaatgggatggaaaagaacaggccttagtacagacacaggttcaagcctcagctaagccacattctacctgtgtgacatcaggcgaagtatttacacctgcactcctcctttcctctgtctgtaaaatggaaatgataatgtccatctcctaaacttgttttgattgtgatgattaaatataacatatgtaaagtacctagtatttgctcaacatgtttttttctcctgtaggaaaaaaaaactctaccatgttttgttaattcttcaatatttattgtgtaccaaatgtgttggggaagtttaaaagaaacaaaggtttaaataattctccagcagaagccaagtctgacagatagcagatgtttttctggggctttggtaagaaagtgcactgcacatggtcattacagctgctaaatgacaaggcctaaagagccaggccagtgggagcagtgtcttggcaataccgaagtctcctttttcatacaagagggaaaacttccaaggccaagaaaaagagtggagcatctttttccctcatacaggtcagctagaaaaagccacaagggattaaagatcaaaggaacatttttctttctctgagttgtgaatagctttgggtgagtaataaattgaaaagatttaagggcaaacaaggcccaaaaagaaaaattaaaaatatgttaaagaacaacaaaactcagagagatgaataaaagaatatcctggggataatcatgctgatatgcagcttgaggagctagaccacaaaatgcacataagggccaattcctagggacccccccccccgccaaaaaaagttatctctagctccagctgctgaccagatactatgctgggtggcctgcagcatcctcaaatttaagaggttcaaaatttaactctagtacttcttctatctagttgtctaaatcaggaattatacttaacctttttcatgatctctgctaccattactttaatgcagctctccattacttcatgaataaaagaatgaacaaaagaatagctaaagaataatacttgaaagcccattttttggcaggtggttaattttattttttaatcaacaaataatacttgtacatatttatggggtacataatgatgttttgatacaaacaatgcatagtggtcatatcagggtaattagtatatccatcatctcaaatatttatcatttatttgtggttggaaatattcagtatcctctttctagctatttaaaacgatataatatattattgttacctctactcaaaggccaattttttaaaaaatgattttaaaatatggttggaaaattctcattcaataagtatttattgagcacctcctgtataccaagcacactgccaaacagtaaagtgtataatatagtgcagcctattgtagcatatgaatggagggaaaagttagaggtgacaatgaataggtattttagggctgaaagtaatcagagaagagaaatctccagaataagaatcaagaaaagggaagtgatgtggctagcagaagagaaacagcattttctactttgccatcctagagagacaagggaaacaaatacaagctacactggagctttggaggaagaacttgagactagtataaaataacaaagtattctcgtgtgttttgccttgagattatgatgaatatgattaaaattctataattctggatgctaaaggagaaagaattactgatccaaatgtccttaaataccaagcctagtgcttaaaagttcttccttatcaaaatattggagaatatatacccaaatgtttctctattgttgtcctgaattatttacatttaactatttcaccctttggattttgttgtaatttacatatgatgtgaggattttgaattgttttcttttttgttaatttcttttttttattattgaagttctggggtacatgtgtacaacgtgcaggtttgttacataggtatacatgtgccatggtggtttgctgcacccatcaacccgtcatctacgttaggtatttctcctaatgctatccctcccctagccctccatcccccaacaaaccccagtgtgtgatgttcccctccctgtgtccatgtgttctcattgttcaactcccactcatgagtgagaacatgcagtgtttggtcttctcttcctgtgttagtttgctgagaatgatggtttccagcttcatccatgtccctgcaaaggacatgaactcatcctttttatggctgcatagtattccatggtgtatatgtgccacattttctttatccagtctatcattgatgagcatttgggttggttccaagtctttgctattgtgaacagtgccacacaatttattattcttttcactgctttgtgttaccttactatcctgggttaagtttgtctatattcaagacctctctttgtgctatcttttctatgctttttagatgtctttttatggtaattttttttttttgagatggagtcccgctctgtcgcccaggctggggtgcagtggtgcgatctcggctcaccacaacctctgccttccgggttcaagtgattctcatgcctcagcctcccaagtggctgagactataggtacacaccaccatgcctggctcatttttgtatttttttttcttttaatagagatggggtttcaccatgttggccaggctgctctcaaactcctgacctcaagtgatctgcctgcctcagcctcccaaagtgctgggattgcaggcgtgagccaccaagtccagccagtattcccttttaaaaattactttattcttataatagattatactacttcacctaagataattatcctccagttaattcctttttcaaagttttctttacatttctactacatttataatgtcagataaacattagaaccttctgtccaattctctccactaaaaaaaaaggaagaagaatgcttcagtcttcttatccaggcacttacctccatttactcgtttgctttttactcattattagtattggctgggtctgctgaatttttgacattagaggttctaggtataagcagcaatacctaaattaaactcaaagaaagaaaagtcaggaaaggcaattgaaacataatggtacaagagatagaaataccagcagaggtgcattctacaaaggtagagagagtttaagaaagacttgtggtaagcaatgctaaaactgatgaaggggacaataactgaaaatcaacctctgaatttgggagttattatacaaagtcactgatgattttcccaagaaaaatttggtagcatgactaagtcagaagctatattcagtttattgaggaacgagtgagaggtaaggaagaagaaatgctgaccaagaattctttttcttttcatgacattaaatggtaatggtaaatagaggcaaagataatatagatgagagagagattcaaggaaaagcggggagtagagaggggtacagggaatatttaggctagaaaagctctatatgcaggctggaagaaaagagccagaaaccagaggcacagacattaaaaataatctgagaaatgaatctacttcttacacagtaaataaaaaggaaaagatcatagtaatagctaacacccattacttactgtgtgccagccactgtgccatgaactttaatgcactgtctcatgtgagaaaccctcgtacaagacttatcatccccattctagagatgttgcaaactgagacaaatgtacaataagttggcctaaggtcactctgctgtaagtagtggagctggtatctgaaccctgaagtttcactctagagtcagaatgcttgatgaacagcctacatattgtcaagcagaacggtgaaagcagggcgctgccctaacatcgacgaatcacctcccaaatcaccaaatgccacctatgaacacataacaaggactgacagctttgactaggactcaagagtggcagaaacaaaggagttctccattacaagaatgcctatgcatgaatagatgtgtcactttcaaaagcagccacccctgtccttcacaccagttaccaaaccttgatctacacactgcttgttttttgtgtcttcatggtttccacttgtaagttatttatttaataatacaggaacttgggtacaaaaaaacagaaagagtgaataagacctactatttgatagaacaacagggttactatagtcaataatacttaattgtacattttaaaataaagagtataatttaattgtttgtaattcaaaggataaatgcttgaggggatggataccccattctccatgatttgcttatttcacatggcatgcttgtagtactcatgtactccaaaaatatatatacctcctatatacccacaaaaataaaaaattcataaaactgaaaaataaaaaagaacacaggggcaaagggacataattgtttagcccacatggtcataacacagggcttctggcctgtccatttgagaaaagggttaggctggtgagtccccagatgcacatgcatggcacatagtgatagctccctggagcaaagagaagcatgcactggagggcaggaagacagaaaaattagccctacaccaagagggcctactcagactctacacatctttccaaagccccaattcctccgtagaggcttctctgctccttcagctctttcatgtagtcattcatgtaaatgccttctcctaccttgggtttttagttcctttagagaagggaccaagtcctatatctctttcaaacttccaggttggaggtgttcaagaaatagttatcgaaaatgtatcaactatttctactcatgagtaagtgagctgcttctcatgattacttttgatgaaaaaaaatgtgttgatcatgaaccactgtcaagaccactagagcttgaggttttattctaccaagtctgccttaattatttcctcctgggaacaaatattagcacatgccaacaaggagtacgagccagttttcggccagagagtagagctttttctcagtgcaaggccaccttgccaactgttccctgaacagtttagatctagatgatgtattctaaccaattaagctatattctagttgattaagctaataaacctaaattcattattttgctccctgtatcgtgaggtcggtgaacacagcgaatagtatcaacaaataaaacattttatagtgaaaatgccttcattcaaaagcattgctggagattgttgtcaatttaataatttattcacaaaatattgtgactcccaggcccatctttacagaagccctccctggaatccttcctagtggaggaaacctgctttttattcagttgacatctggcttagccatatgatttgggttagccaatggaatgtaagcataagtgatttatcttataattcagctgaagctttaagaaccattgtgatgttcccccgttactcttccctctaccataaaaatggcctggcttcatcagtctggatccccaaatggagctgcagacaatccacagctaatacttttattagcaagccactaacttctaccatagcaagccactgagatttgggggttatgcttggttactatagcataacttcctgaaagctgacaaatgttgaaacctacctataaacatttcattctctccctctagcctctgtcacaccacagacataaaatgcaatttgaagctcagtctttgaaatcaacagtaaaatgagagaaccatgtcacagggttgttgaaattgtttagtggaatcatgtatggagagcacctaggatggtgtgagctcagaaatgtgagctccctcgccaccataatgccttcccttcatgtttcattcccacttccgtggtggaggtaggaaatgacagacaatgtcaaccagaatcttgattcttctctgtaatcgtgtgatgaacaagttataaacagctcctgcctcacaaaacttgtagtcttacttctagcagaaaaatgtaccatgtgcatgcttgcttcctcatctattaatgtgaagttccagcatccaagtgaaaaattaacaaatgtaattaggattgtcttggagatagagggaatccattgttcatgatttttccctctcccaaccactatcaaccaccccaccatctatacacatcaccactgtcagtaccacttccagaaattactccctggtcctaaaacctggattagattgccctcctctgtgctcccataacatcctgtacttaccccttctccaaactgttactctggaatggatttactagtttgggaattagtcttcccactgagagaataaactgttccttcattattttagtcctagaagttgccccatgcctcaaacgtggtagatatttaccaacattttttgaattaatgaatgagtggatttgataagttaatttcttcatagtgacttttgagttcccgctgcaagttgatgacttttttatgccagatgcccagggctccaggcaatccttatagtttttctaactgacaaggaattctctattatgaaatggggatgtgatttacatatacctgcaatcttaaagcactcatagaggccactggaaactcaaatgggtaatacaaattgaattagcagctcttgattaagagagcattgattttattaaaactggtagaatatatgccagaagttaattaatagcttgaaaataatcagacacttcataaagctgaacatctgccaaaaagcgggtattctgaggtatgttcaggaaagtttccaagtgtataatatttgtttccatagttccttatgttgtaataaccaaaaaataggtaaatcaattttaaataaagcaatttaacaaactcatatttcctttatattttggaggaactccaaacttgcaagagtagaacaatgtccttacttactctcttgggatatctaaaatatcttcagtcctataagattcttttttaaaatgaggaatgattcttgttctgcttatttttacataacacctttatcatcaaacaaacttcaagatgtgtcatctttagtaggaaaacatatttccacctcatcctcctgttagacttcagtctacttaagcctattctcagtttaatgggattaacagaagcaaatcacaatttaagactatagtttaccaaccttcctttctcttgttcagtgaaattcccctgataatccatcagtcaacccctgctggccttgagaggcgctctagaaggcaggagaagggcacacaggctcgctttttgaactgaagaagggtttcatttggtttagaattgtcaaacttcaaaaaataaataaataacttaaagtgtttttcaaatcagccataaggctacaaaccagaaagaaaagtgtgaggcaggtgtttggggcagctacccaagttgcctacatggtttccaaggtcctttcaactctaaggtttgtgtatcaggctgtctacagatcatactgtctccataagattgtctagttcattttatggctagtttgaacaatctgattttcttttttacaatggcaggggctcaatccatgttaggcttcaatgttgagtcacccaagttctccacagagaataaccaaccagccgtaaggaagcttcttttagcaatgccaggattctgcaaagtccctcccagcttaacttttctgaccttgcggcagcagaacaacaaaaagaacagcccctggcaccctcagaagagcacaaagccctctgacaacctgagatggcgcccaggtagacttccctcaaaaaaaaaaaaaatggcaaggctgcttcagcaggtctttcagccccaaccactccactctccgtctccttttcttcactgctttccccacctctcttccccccttccactttgacccaccccaattttcgtccacttctccctcaccccttccttgtaatctctctccttgaggcatcctgtggatgttgactgtaatctcccctggaggagggctaagaaatgcacctccagagggtctgtttgccattggaaccgcgtagagaaagcgtgcaaacccgtcaactgctcccgccgttcctctccctcctcaacccaggctcgctacagaagaagggagtagggtctgcccccttgttgtatctattttccccttctccgccagggctgtggccggcaaggggctcaggaggtgagtcccttgcccacacctccaaccccgctggcccggtttataacatggacagccctgccctctagtgtctgcaaccgggagccctaaggcgccatcagctccagaatttctcttttataacctaagcaagacctggagtacctcggagctgcgacctccagttcacaataccacctgcctcacacccgggctcatcttttcatcccacacccaccacccccctctccgttcacggtgtcccgggaggctgcgacctgcgtagatgatttagcagactgcccctgcccatgctcctgctcctgctcctcctcctcctcttccccgctctctccctctcgcctcctcttccagtccaggcgcccagactcggcgaagcgcagcgcctgccaccagcggtgcctcgggctgcccggcgcgccgcgctcccaggttctgtctcgccgcaccccggcgggcactggcgcgggcaaggacgctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaaggtgaggggcgcacaccttccgggacgaccttggcttcccttcttacccccacccactccaggtactccagctctggcttggggatgtttgccagctttgaggcgcaaaggcggcgggagttgggatgcggggtgtcggagggagactgagggtcgcccgggcaccgtgcctgcaccctggattatagtacagagagcatttcttgttcaaacaattcctcaaatgtgtgaacctgagaatcaacattgtgtataactgtggtttgagcatttcatcctgcttccttgcaaaaggattagaggcagcttaaagattaaataggtatggaacgggtgctggggggggccagggaaaacttgagtagaaatcacagggaggtggtgtgctccagggaccccggaagaactgtgtgatttcaaagccagctgattaaaaaacctttgattagaaaggactgcactgttgctccagccctcagaaaataatactgtgctcagtcctgataaacaaaatgcccaggtgtggaggtaatgaggcaggctcattttttttaaaatacaaaataaatcttggaagtaagagttaagatgagaagtttggtcttaagccatctccacccaatactgcaaggtgagaggctgaccccctacctaacgaaaaggaaaggaaattgagtctaaagggaagtgattccagctcctatcacaggatcatagtggttttgcatctatatgtatatttctgcctgtgcccagttttggaagaaaggaccttgtattcaacccaacgctgcttgtccttgagttagaaggataaggcagatggtgtcagcatcccaaggtgtttcttcctaacctttcttattgtccttccttgcctcctgcaccaaatctcttggggagggagcagcccaggaggaaataatagatcgtcaaatgggttgggggagcagtgttttttccaaaataatttaggctcattttatcattcttatgttttccctcaaagctctaagcagtacatcgtcctaagctgaatttaacattgctccagaatatatatttatcatagttgtacattcagacacaatatgcataaccttaaacagccaggatgcacttgtgaatcaggggcttcccttacttaatcctgcgcaagagaggcaaagcaggcacgtgggtctgattccctgtgcggtctccttcatgaggagcatatgtgaaatacctttgaaatacagagaagattgagacagcttttctctttctggtacagttgctttcctgctgaattaaatgagatgaccctgtcttcaacaaataaatgaatggaggcatttgaggcccatttaacaaatgcacaaaatatgcctgcctctgtttttcctcccttcagagctttagcctccagcccacggagttgtgatgatgaagcccacctcctaagtgggactcagctcagtttctgtatcatatttaaaacagagtatgttgcttatttctaaaattgcatagcacctcaccactaactattttgctgcatagaggtatttcatcactaagagagctatatagagaaactcactcaaatcctgattcatcattgttgatagaacttaactattgtgtcatcatcacctgacatgggctgcagaagctccaaggattgctatagatctcaattgagacttctagtaacagagctagaaaggagccttttaaagtgtagccatgactctggtcattaggtatatgcatgttcaaatattcccttacgtgcttgttttcgctttcataacaatttccagggatgaaaacttagcagattatttttataatgaagagtattcaaattaacaatgtgtatccaccagctaacaagttttaaattccacagaaatcagcatcacaagcatagtaaaatcaagttttcattctttcctcttctgccataatgacttcattcaaggcctagtcccagaccaagtgcatggaaacgatggctcatgtctctcaacatttgcccaagggaatggtgcctaccttgcaactcagcgtgatgtcacctttattagccattctggtgtctatacaaaatatttgctccccatttcttcttatcgatgcctggtcagcaacaatcatgtaaataagtttccattcttttgaggaagataacgaagtcagcgtttttcagaagtggtgcctaggaagagacaaaatccaggacacacctctagttcaggtaacactgcaatatatttcaatttcctgctgcgtgatggggttattattgaagagggaagtaaggtatatcattcacagcacattgtccccacctggctcaagcaccacccattccccaggtgggctcaatatgctacccccaccaccaccaagataccaaggctgcaaatgaaaagtagatctcagccaggcatgatgggtcacacctgtaattccaacactttaggaggccaaggcaggaggatcacatgagcccatgagttcgagaccagcctgagcaaaataatgagaactcatctctacaaaaaaatttaaaatgagccaagtatagtggtgtgtacctgtagtcccagctacttgggaggttgaagtgagaggatcgcttgagcccagaaagccaaagttgcagtgagccaagtttgtgccacggcactacagcctaggtgacagagcaaggccttgtctcaaaaaaagaaaagaaaagaaagaaaaagaaagtaggtctctttgcagaaagcctcaggccctgaacttttgtgtcatcttctcattactcaagtctaattccctacatctcacttttacacacagatcatttttttcatgtttgttttgattgcccaccctggaattctatttctgcactaccctttaaaagtgaaagatcaaatctaacgctctaatgtgggaaagcattccctctatttctacaagcttatttacacaaaaaaataagcttgagactgatcaaaagctgaatttctaccaaataggaacttactttttatgccgtaaattatcaaggccatctcaaggcagaggtgagtttagcatctcatgctttatgctcctttcttctgcacctaccagatttttattacatgtgaaattatatgaacataaaccccagggaaacattgaagatgagtgtgccgtcacaagtgacgaggggacagatgaacagggaagagaaatggggcagcagcactttagagtgacttacttctctcttgttttctcctccctgaatcattttctagaaccagtattgtggcccctaaaatttggggcttaggtcagtcaacttaccaaagttcatcttcctggtgatgaaaggactttcatcaaaatcccagctactttttattcgttcccacattttgtggattaagaaactgagaaccagaatttatagagatcactcaatcaattggcatattcccggatcacaacaaattgataaaattcttgagaaccctctttctaatacagattgactataattttgtctttcatttttagttctcttattttgtctcatgcactgtggattatctggtttactgcagtccttacctgaatagatgtcagtgttttgatcccattgttgtattcccctaaaacacgtcaaatgaaaaactggacactttaataggtttattgttagcactctctcatgctgatcaattctcaacacatgcagttgtaggattaggaagacaaaatcctttagaagaagctatgaaacctaatccttctgcatctggatcattttaaactacaagttgtaagaggaatgagcatctctggattctagttatcagtgcagaccagatggaaggtctttatgaaatctggtatgagaaggaaagcattttatagcaagaagaaaatattttgagaaatagctaccagcagcagcagctagcagttctaaaactctcagatcctcctaatgaccccattagggagggaggaagggagcaaggaaggaaggaatgaaggaaggaaagaagaaaggaaggaaggaaggaaggaagggaaggagggaaggagggaagtgttataaatattggtcagggaaaagttttattattaatgacagattaaataattagctactaggaaaattcaaggggatacataaaaatgccattagaaagaataagagaacccagtaaggtggctagctacaatagcttgcctggttagcgacaatataatcatagggatttatattacgcttgtacactgttgggcagaaaacatgcctgagaggtataaaagatgctgttagcatccaagaaaaatgggaaaggaaagcccacctcatctgaggaagatggaggaagaagaacctacagaaaaggattccacattccaaactcatccctctgaattcagtaatatttatccttatatgatttctgacagtgtagtttgtcattgtaattaattctttcctgtaagtaaacaagaattgtatacttacttaagtaccttacattttaaactttattacatagtcctaattttaatgttgaactctgccctagtcaaggaagtatttgttacctaacacaagaatttgatatacagtcatccataaacactatcctaccatatagttcatcataatttaacattcaaagaaagaagcatgatttcctcttttattatgctttcatttgagccattttaactttcttaccattctttccttctgaacctaattcaattccttacacaatgctctaaaaaatcaaggattaaatatgtaacttaatttataattagcaaatacatcatttacaagatgcattcatattggcaagcatattttatttcatagattgtaaactggtaaaacaatgtaatctcctcaccctctctgcaatacagtaagcctgtttctaagaccatcaaggttttactttatgtccgaggcattggagaaccagactgtactgaccccagggtttggtgacttacatataaatgaagcatcttaccaagaagggatgaaaaatgactttagaggaagcaaaagtctcaaagctcacaagacttgattactttcagcttggtgacagaggcaatgctcttgtgatgcagatggagtaatttctccagcacaaaagatgtccagccgggtcccattggctttgagataatctctcacattgcattaagtgtactgagtaccctttctcagacttatgtaccattagcatgcatttaattaacagttaatgattacatagtattgttactattaccacatagtcctgttatattaaaatacatgaaatttgtagctatgttttgcctgtttagtaaaatgagtctgaatctaagggtgagagggtctacacacagccaagaggatggggtattaacccaggcctgtgtgaagatatttgcatctcatggaatgctctccagagaacaaactgacctaccctgtgcatgtcagctaagctcccgccagcttcctcagggcttgctgaatgtacagtgagtgccacagtgccagcgtggcagtgaagcacaggcccaactctacggacctggggtcagaaggcctgggttaataccccattctcttggctgtatgagctgcatggtctgtcatcgttacaatggggacaataatacatgccctgtctacctcagcctcctttcagggaagtttctcaaaacagaatatgctattgtgattcattgtcacctgtgatgtcaaactgcaccttgtgttatactactagggggtaacacagcatggggctcaagcccaagctctcgagtccagaaagccaggttcatatcccagctctgccattcattaactgctttcacatctctaaacctcagtttcctcatttgttggggctcacataacagtactatgtcatagggctatttatgaggattaaatgtgtgtattcattattgctaaataataaattaccccaaaacctaatggcttaaagcaacagatttttattatctctatgatcatagttccatgggttgggaatctgggtatggcttagctaggtcctctggctcaggtctgtcactcacaggctgcaaagtttcagccgagactgcagacatctcaaggctcaactggggaaaggtaacgcttccaagctcgctcacgtggctgttgacaagcctcaggtcccagctggctgctggctggagacgttcttttgctaccacatggacctctctatagggctactaacaaaacagagtgcttcatgcagatgttgcagcttgctgtccttggagcaagggctaagattgaaagatagcaaaatagaagccaaggtctttttgtaacctgatatcagaagtgatatcccatggcttctgctgtgttcctcattagagacaagtcactagtttcagcctaattcaaggggaagggattacacagtgggaggaatacctacaggaaccaaatcattgagagccacctgagatactgcctgccacaatataagacatcagaagctgtttgataaagactcaattcagtatcacctcgtggttttatctcatagtaatgttctcagactgaaattagataatctgtcaaagaatttgtaaaatataaagctctatacaatatcaagattttattagttttattaatgctgagaatccagttccactttatagatagtgatataagaacagcaaatcaatgattaagagatgtgaattttacaccttgctgtgtgtgtgaccttggaaaagccatttatttgtttcataccttagttctctcatgaaagtgatgataataacagacttaccaggataaaatagataatagacagccatgcagcacattgacaatattttggtcacccacaaaccacatatatgacagtggtcccacaaattataatggagctgaaaaattcctacagcctagtgacatcatcgctattgcaatgttgttgtagcacaatgtatcgctcatgtgcttgtgatgaggctggtgtaagcaaacctgtgctgccagttgtataaaagtatagcacatacaattatgtatagtatataatacttgataataaacaactgttactggtttatacatttactgtactatactttttatcattattttggggtgtgttcctacttaattaaaaaaaaaaagtgaaaagaagtttaactgtaaaacagcctcaggcaggtccttcagaaggtatcccagaaaacagcattgttattacaggagatgacagctccatgcatgttattgccccgaaggaccttccaacggacaggatgtgtaaatagatacagtgatactgataatcctgagcctgtgtaggctaaggctaatgtgtctgtatcttagttttgtttgtttgtttgtttgtttgtttgagacagagtctcagtcgcccaggctggagtgcagcagcacaatctcacctcattgcaacctccgcctcccaggttcaagcaattctcccacctcagcttcctagtagctgggattacaggcactcaccaccatgcccagctaattttttgaatttttagtagagacgggatttcaccatattggccatgctggtcttgaacccccgacctcaaatgattcgcccgcctcagcctcccaaagtgctgggattacaggcgtgagtatcttagtttttaacaaaaaagtgtgaaaaggaaagaaaaaatttaaagttttaaaaatagaaaaaagtttataaaataatgttataaataatgagaatatttttgtatagctatacaatgtgttttaagctaagtgctattacaaaaagagtcaaaaaggtttttttaatttaaaagtttgggggttttttgttttgtttttgtttttgtttttgtttttttgagatgacgtttctttcttgcctcccagactggagtgcagtggcgtggtgatcccagttcactgcaacgtccgcctccccagtttcaagcaattctcctgcctcagcctcccaagtaactgggattacaggcatgtgccaccatgcccagctaaattttgtatttttagtagagatggggattcactatgttggccaggctggtctcaatctcctgacctcaggtggtttacctgcctcggcctcccaaagtgctggtattacaggcatgagccaccacacccggcctaattaaaaagtttataaagtaaaaaagttatagtaagataaggttaacttattattggagagagaaaaaatggtttttacaaattaggtatagcttaagtgtacagtgtttttaaagtctacagtagtgtacagtaatgtactaggccttcatattcgctcaacactgactcactgactcacccagagcagcttctaatcctgcaaactccattcatgataagttccctacacaagtatcccattttttatctttataccatattttcactgtaccctttctacgtttagatacacaaatactattgtgttacatttgcctacagtattcaatacagtaacatgctgtctggctttgtagcctagaagcaataggctatgccacatagcctaggtgtgcagtaggctacaccatctaggtttgtggaagtacacatcttgatgttcacacaatgatgaaatggcctaacaatgcatttctcagaatgtatgatgcatggctatatataaaattatgctgaaatctaaaaaaatgagatgatggtcataatgacaatgatgaagatgactatatgtttcagcttctactccatggtcctttgaggacaactgaagtaactagatatgatttttgtcagttgtgttttaagtgtatgtatcaaatccagctaccccaagttttacaataactttatatggtttaatcttatcttgctgaacacattagatatgctgccctgaaaagtggcttgcaaacagaatttttagaaactgaaccataattaaaatgcacagaggccgggcacggtggctcacacctgtaatcccagtactttgggaagccaagacaggcggatcacctgaggtcaggagtttgagaccagcctgaccaacatgaagaaaccctgtctctactaaaaatacaaaattagccatgcgtggtggcacatggctgtaatcccagctactcaggaagctgaggcaggagaatcgcttgaacccaggaggcggaggttgtggtgagccgagatcgcgccattgcactccagcctgggcaacaagagcgaaactctgtctcaaaaaaaaaatgcacagagaaggtttccatgtatctagtggaattgtacaatgcttatgtgatcttgtgatatcattaatattttgtaatataaataattatcctcattattttaattttctggcattgtagcaacacctgtataaatatttatagttacttaagaactcacaaaacaaccttttgaagtaggcaaataaaaccaactcttggttatctcaaagagttctttttgtttgattcttgtgttatctacatttcttctctcactgtaaattggcataaatttggcagatacaaaacaagtaaagttcaaactcctccactcaaccactttaagggattttttttcctgcttataagtatatcacatgttcattgtagaaaatttggaaatgcagaaaagtataaaaaatgtagttaaagttactcttattgccaccaccaagaggcagccactattgatactttgatgaatttctgccttagtgctttccctctctatagggagaaaagagtggtttctttttcaatgaaatcaggagtatgttatatacttttcttgtgttctgctttctctaattaacattattttttaaatgatatttccatttattgattcaacaacataaattagtaaatattgactatatccaaagtggaatttggatgaactgtaagaaatatagttaataattgaattcagattttttaaatcaattccaacaattgtgaagtagtttcttttcctttttttaaaaaattttactttaagtttggtgatacatacgcagaatgtgcaggtttgttacataggtgtacatgtgccacggtggttcactgcacctatcaacctgtcatctaggttttaagccctgcatgcgttaggtatttgtcctaatgctcaccctccctttaccctccaccccgcgacaggccccagtgtgtgatgttcccctccttgtgttcatgtgttctcattgttcaactcccacttatgagtgagaacacgtggtgtttggttttctgttcctgtgttagtttgccgagaatgatggcttccagcttcatccatgtccctgcaaaggacatgaactcattcttttttatggctgcaaacattatctatttaataagtttcacatgtaattattatttgaaaacatcatttctaataagtatataatattgttgtatggatatactatatcttatttaaccagtcattactattggacttttaggtggttgtcagtttttatactgtaaaattatagcatgaaaagaaaatttttacataagtctttgtcattcattattctagttatcttagtaaaagtagcaaaggagtccttgaagtcactagggggaaatgaggtttggtaatccaagtataaatatatacaccacagtcttctcttccctcttccctaccacttcctctcacctcccactggcagaaatttgcaggcttttaatgctggaaattgctgaagtaacaatctaattggggtggccatctgtcgtttttggcccatatcgttcaggtcacactgaatgcacccttggctccaagagtgacatgggacccaggcccatccaaacatcttgttctccagggcactgtgattggttcagggataggccgtgatccaagcagaccaattggaatcaatgaggctcagttgagaggtgttcaggtgccatcacctacattggatttggagatttaaggatacatgccaggaactgcagggacccaacataaggggagtgcctcctgaggataaaactttacatggaggaaggaagagcccagagatggagaaagattcttgggtatattatttaagtttctggatccacctgtgcctgatctacacttgacactgaagtttcatgagcaagtaaagtctccttctcacttatgccaatttaagaagatttctgtcatttgtcttttaaaaggtctttaataatccagagatttttaccctctcaattgatgaaaatgagttgtagttaagacagattctggaactgaatcctagttccatcactgacagtgtaacgagggaaggttatatgacctttccccagtcagcttccctacctataaaatgaaaataatgctaatacttatcacctcagagaggtttttgcagggttaagtaagttaatatgtgaaaaagtgcttaaaacagtatctggtatattttaattactacgtaagtgtgtccctgctgctgctgctgctgttgttattttgaaggcagaaagaaaatgcaggagagtaaatgacctatttcactcatgcagagatttagcagccaagctaaaattcaaatttaggtcttctcttttctctgcttgttgttctttctcaagagctaagcctatcgtcatctttatgatatatttgagtattaagctttcagaagtttccatccacataattgaacatttctatcaaaagttttgaggtagaccaggaggccagaaaatagatttaagttactagcaataaccagatgctactgtaggattataggttatcacaacttgtaactaaaaattatgatttttattataataagtttaattacatttatttaattttaattaaaattaaaatacattttattattataatttctactttaacaagtaactatacctttcactgtgttttatttagcacctttcacagtgttgttgtcttttttaatataccttcctattaaaccagttgctctttgcagaatgcttgaatcatttggctcttggttagtaggctcccgttacctaaccaagcactgagtgaacgtatttactggggaggcagctggtctctcccaaatgtaaatcagatttcatcatgtctggcttggagagaacgtggcatatggcaaatgaagacacagctgcatagtgaaattttccatcacaagttagtctaatacctgaatgcagagtgaataaaacattttctaaacaagaatattatgttcaaattcataatcattgttaaatattaagagtcaggttatttcccttgaattatacaaaatttcactattcttgaaaaagtacatgttatcttatatttaatgtcatactattcacatccaggctgcctttcaacttctattatttaaaaatattttcagatatctacattgcctgttattaaaatgcaaactgttctttgagtagagaacctttgtgtaaggccttacaaagttctgatagagatgaagtgcacggaaggaatgacagtgtggtgggaaggtccatggccttaggggaatgggtgggagcctaagctttggagcagttaggttggaattcagacaaagccctgccacttctaggctgcaaaggtattgaacaaggtacttaactaccctctgcctcagtttccttatctgtgataagaataatatcatgtaatgataatacaaacatcataggattgtcagaatcaaaatgagaaaatgtatgcaatattcttagcatagtacctgccacataataagcactcaaaaataataagacctgcttcatcactggctctaaagttgtgtccaattggtttcataaccctaagaaggctatcaaatcttcctgggcctcagttttgtcattagatgagtaaattggaccaaattctataaaaagtgcctttgggggttaaaatgctatgacaatgcccatacacattggggtaaaccaaaaatctataacaggggcaaacttgggaagattttttcaaatctgtttttctacactgaaattgagctgcatcccttctccaaaggtgatcatcttctctaataataaagcaaggtttgtctatttttaactttttattgatccagtgctcagatttttcagcaccatttggggaggagtgttcaatgcctcattgcagaaccttccttgtcatgatgattttgataatattattgacattctttcagattccatagtgagtctttgtcatgatcaaagggctcatgatgctgataacacaaacaagagtaaccagttcaagaattaatttggttaatgaggatcactaatacggataatttcttcctaactgttttggcgggatgcattatttggttgagtgtattatcttgtctacactgatcaagctagcttgaaactcttcttatcagcctttaactacgtactttaccaacacagcctttgaaatatttgttttcttttcatgaagagcttttaaattttttgcctagattccaaagtaagaaatcaatttaaatggcataactttcaaactagacttctgaaagactttatgcatcatcagtaaatctaaattgatatttttctttaaaagatgcaacttttctatttcctatgtaaataactgtgactctattgatttataaactccaagaacaattaccactagggaaaaagacaggataaaggagcatttgttgtcaagcagatataatattttgaactgatgataatgtttcccttacaaaacatgcttgtattaactgatatttatactcatttttgaaaactgaattacagatttatgaaggatatattcgaaacttaattcactaaaagaaaaaaatatatatgtctattgaaatatcccctaagaagcagaaaaatatttttgttctagtagtataaatgaataatgcaaataagaatgtcacctgaattttaagtaacacacagtatatttggaccccagattgacaattggcaacagtaccagaaaataaactagaagctagatgcagccaggccttggcaaatatatttttatactgttgttaagaaactcataataactgcttcctcactgatgtgaactttccttagttgacactctcttgattacaagtacacgatgcctactttaaattatccttaatcatgaagggaatttgttagaagatgccaggatatttggtgaaactcaagagctagagttagctactaggaaattatcaggaatctagaaccttatttttctcttcccttttttctctccaagactggctttgaatatttctacacacatgtggctaaatgtgggtgtcccatagctccttagtttcaatttcgagattcaaacaactcacagagaaaaccaacaagcatctctcactcacagttcaaattcctagaaaaaaagggagtttggcccagctatagttagctgtctatccctagcccatcaacaatggtgcaaacataggtgctgggaatctagtcttagcaggaggggaacagtatgcagaaaaagggggatctgtgttgtacagacaccccaaaaaagttgtcttttcttccttttggcttacacatacacacacacagacacacacacacacacacacacacccctaccattcttcccatttattaaaaggtctccctgccatatatgacttaaccatcttacactgaactacactctcattcacccccttcctaaaggggataatccaatcaatcatatctagcaactgaatcctaaaatgtcatcaatgggcccctcttctcaaagtgaatgatccccagaatagtccatcttttctgtagattaggcttcattttgttcagaaaaatagctttctctttttattctgcaacataatgattgaatggtaaaattagaaagttatcagtaaaaccacaaacattcccactcaaaaaatgattacaagaagcaaaaatcttcacagcaacatcatacattggttaccagaccagagaatatattgcatcctgcaagacaaggattgcaagaaaggtgaagagtaggataaataggttttatgggcttccattattgttgggatgggttccttcctaaatcaagtacttcactacaatataatgcaaataaagtgaacctctctgcatgctgccttgactgactcagccaaccagtttcatattctttacatagctttgttaactgtagctctctctattgatgcaatttctctcttagtcgagatccttttggttgtgagtaaaaacatacacagatacaaaaccacagactttaagttagcttaaggaaaaaatatgttgggaggagtttactggaagggttccaggatacattaattcataacaaatgaccccaaaacttaatggcataaaatggcactctttatttaagtcagttttggagattatctgggtagttttctctttatttaagtcaattttggagattgtctgggtagttttctctgctgagatttttcctgcctctgcatgagctggcaggtcagttacaagccagatgatctactgtgttctcacatttctaagggtcggcaggctgtcagctagtgcaaaggaatcagtggttagaagggactaggccatgtggctctcaacatccgggatgctacactaggcatcttcacagggttcctaaaagtacagtgaagaaagcagcaaagtccttgagactcaaactcaaaactcacatgattccatttctgtcacattctattagtcaaaataattcataaggtcagcccagactcaaggaacagaaaacagattgtattagtctgttctcacattgctataaagaactacctgagactgggtaatatataaagaaaagatgcttgattgactcacagttccatagtctgtacagaaagattggctggggagtcctcaggaaacttgcaattatagcagaagcaaaggggaaacaggcacatcttacatggctggagaaaaagcaagaaagtgaagggggaggtgctgcacacttaaacaaccagatctcgtgagaactcactcactaccatgagaacagcagagggaaatccacccccatgattcaattacctccaacaaagcccctcctccaacattgggaattacaattcaatatgagatttgggtggggacacaaatacaaaccatatcatagattcacctcttgatggcaggagctgtagtagggacatttttgcagtctacaacaagggatattatgaagaagtcaaagataatttgtatagccagacaccacaaggggctagaactgtgaactgtaaagctggcagagcctgagatatttccatttttattcaggctgtctgtctgcctctcatcatatggcctcttactctgcttctctcactaagacatcttactttattcaattactttattcaacttactttattcaaggtatgtatataagaccctagaggcctgccccacaaatccccagtgtgcatgtcttcagttcaagtgatctgctcagacagctgaatagtatctcttagcaccaatttcaattcccaaaacagaggatttgattgtcccagatttggggcagtgattcatcccaattcatccactatttctggatggggagccacagaatagatacgtggttactgtgaggcccctctgcagaagagagcggtgtgggacccttctcagaggatgagagactcaggagatgctttctatcacagaatgtaatggcaaagcccgtatgccctgaaaaattcaactctccaaatgaagtcagtattctgttaccaagtcagtgccaggaaaatgcaagaaaaattgaaaacaagcttgtcattttcttctatttttttctgagtctgaagtgcccgtagatactcttaattcttctagaaagcttgaaagcaatatttaatggaagtcaaatttggtctgcagcagatttctttctcatttgattttctccttcttatcttggaaacaacctctaatgagagaaatattccagagcaccatctcaagatgtatctgggaaaagaacccattgtaccccagagcaaatcgaccctctgctccctgacaatatgcttggttttcaacagcttccctgatcccagttcttatgactttaccacacttttctacacttcccagaggttcagcaaggcttccgtctccctgccggtcttgtcagggcaatctcttcactggcaccatggcttattttctacagaaccattgaaagcagacatggttcccatgcagattatcttcccatttgcacttaccaatcatgtgaactcaggcaggtccacctccctgtcagcttgtctcctgcaaaatttagacttcatgtattttctgtcactgctattctgtatgtttgttatcagatcaaatgagacgcctgcatgcggtagcaccttaaaaacgttagaatgctctgtacatgtagagaaatggaacttctctcacagatacttgatagtgagataaagtggcacgggtcatttcatgtccagtgtcatcatacagatgtaaaatcccaccttggaaatgtaggtgaccacatgtagaattttacctctgcctgctcatgagaccctgtgcaaaggactcagctaagtcatgctcaggcttctgatccacagaagctgtgagataataaatttatgttgtttaaagctgctaaatttgtggtaatttgttacacagcaatagacaactaatacagtgttcaatctcaaatgtaaaataacattttacataacagaatgctatgtgtaggcttgagtgagtgagagagagtgtgtgtgtgtgtatgtatgtgtgttccaaaggaaacgtattttaaaatgaaatacattttaacatatggttttcaaaaagctgagaaactgatgataaatttacacttgttgctgcaacatctcaatattgtaaaccaaaaataaaattctaagacccccccaaccaattgactgaaaccccctctcagtcaagggcattccaaagtaaacctgaaaaactagttcaggccatgatgggaatgggggattagacacacctcattatacccttctctctttggaattggggcacaatggaccagcattaacactacaacagagatctcaagactgaccaaagagattctttgtggcaataaggtatatcacaaaatcatagatagcaggccctaaaagaaatagaaagtattttaccctgaaatatatttctttgatgtattttaaaatggccctgcaaagctgtctcttgtgggagaaatctacattctataaagaatcctcttccctttccaggtctttttctgatcccagaaagactaactaaaagtctggaacctttaaaagtctgataagaaatatttaccatctaatctctctgaagcctgctacttggaggattcatctgcataataagaaccctggtctccacaaccccttatcttcattcagacattcctttctatattgattccagttctttagataataacttaacactttcaaccaattgccaatcagaaaatctttaaatccacctataactggaagctgccctgccaccatcactgctttgagttgttctgcctttctggaccaaaccaatgtacaccttatatgtatcaattgatgtctgcttgtaacttctgaccccctaaaatgtataagaccaagctgtaacccaaccatctgcgtacatgttctccgaccctcctgaagctgtgtcattggcatgcccttattcttgacaaaataaacttctaaattgattgagaaaaaaaatttaaaaaaataaaaacctgattttcttggtcagagctgggctactacttgcttgccatatgatcttgcacacattatttatggagttttttatgtttcactttctgttttttaaataagaacaactccactaacttcagagtcttatgagaataaaatgataaaaggtatgtgaatatgcttagcatactatttggccatgctagaagactataaggttaggttttgtttatttgtttgtttgctcctttcttggtgttcactgggttcaatggctaagttctattacatgttaaccttgtcgtttagtatagaaaacaatgtgagatttagcatgattattgaaacagcaaatcttcagaaatccaacaaacctatggcactcaaacagcttagtaaaacctacccaacaaaatttaagaagtcttggaagcagatggtttggggcatctaggctccagcccaggggcatttttgctggcatttgtgagacttttcaaaaacaataagcagtcaacattgttcaaggctcattttttccctgccttctgaggtgactacttgagcaacatctttcagataattctaatctaagaagaattttttattttaaccttttaaaaaggcaataaaataagacatctattttttctccaaatagctttgtacgataacctctatttattaggacatttgaaagtttcttaccatatattctagccaaggccatcttttttttatgaaacattgttagaattaaatcccagaatttcagatgagctttcccttacactgtcatatttcaccttacctcttaacttttaagggactgtccatgaatacctgagccccaacatctcagtcacttggcactggagaaaaatcatagtgccacccacctatcttctgaatcaatgtatctgaatgtttaatattttccatttgttttacaatttcttacaaaataaattattttcccattgaggaaaagaaagatttttatgcatttgcatgaaaaggtttcaaagatattgttaaatggaaaaaaagggcacagtaaagtaaaaaatagcttgcatatcgagatctcatgtgcatggaaatgcatgggcaaaagcctacaggagcacagtggtggatgctggtaacctatggaaggtgagtggagtgtgagcagagagggggcctgtcacctttagtcatatatacttccataatagtaaaattttttaaactcaggctatatccccacactatttaatttttaaaattgtttttaactgggcgtgggcaggaggcatgcattccttgaccaatagaggcatttttttttttttttttttgagacagagtctcgctctgtcgcccaggctggagtgcaatggtgcgatctcggctcactgccagctccgcctcctgggttgacaccattctcctgcctcagcctcccaagtaactgggactacaggtgcccgccaccatgcccagctaattttttgtatttttagtagagacgaggtttcactgtgttagccaggatggtctcgatatcctgacctcgtgatctgcccaccttggcctcaatagaggcatttttaatttacgagcccatgggagaagcccatgtgcctatactcaaatgccagctcctcacaatgaccccaaacattctgtctaaagtgccctctcatcttccagtctgttcctgtttctgttttttccctcatgatacttgctacgatccaaaattaataagtatctgttggcctctgttttctcccagctagaatacaggcattatgagggcaggagtctcatcaatcttgttcagttttcatctccagtgtctagaggagaatcgagcattgagtagatgctcaacaaatatttgaataaatataagaatgaatgagacaaatgcccttgtgccattattgtctgctataaaactctgaaggagcaggggctgcaagcaaaaatggcagtgggcccaagttttacatctgcttccaaagtactatttcttatttgttagagaagacatttgtttcaagagatctaagagaaaatttgcctggtggaagatcctagcagccccagactctgaacaggaagtgtctaccaaccagatattggcccagctcccacacagcataagacaatgtattaatcagggctctccagagaaacagaaccaattgcacgtgtgtgtgtgtgtgtgtgtgtgtgtgtgtgtgtgtgtgtgtgtgtacagaaagagagagattgatgttaagaaattggctcacacagttgtggagcctggcaagttcaaaatctgcagggtaggcaggtaggctggagacccagggcagagctgatattgcaactcaagtctgaagacggtctagaggcagaattccctcttccttggggaaactcagtcttttttctcttgaggccttcaactgattggatgaggcctaccacattgtggaggataatctgctttacctgaagtccactttgaatttaagtgttaatctcatcttaaaaaaagaaaaaaagaagaagaaaaaacactcagctgagcactgtgactcacacctgtaactgcagcactctgggaggccaaggcaggtggatcacctgagctcagagttcgagaccagcctgggcaacatgatgaaaccctgtctctacaaaaaaaaatgcaaacgttagccaggcgccatggcacctgtatgtaatccccagctattcaggaggcagaggcatgagaaatgcttgaacccagatggtcaaggctacagtgagtggagatcctgccactgcactccagcgactagtgttttgactaatctgggtaccattgcctagccaggttgaaacacaaaattcatcatcatgggcaggatgacggaacctcagctggagccttagctgtgtaggtaacacagagagtatcctgtggtgaaaaaattagaaacagacattgtgtgagaaagaaggggcaagttttgtgtaacatcctgacaaattttgaatctctgttaatcctcttttatgcaagtatcagaagatcacttcatgttcagccataggagccctttcctcatagccccatatcagccaagcgcatatagataaagctgcaggcaaagataaggcgtctctgaatccccagctgtgtctgtagggacactcttccttagtgccactatattcctcatactagtaaggaagtcagccaattctactcaatgtacaagtaagtacattgaaatgcagactatctaaataagcaaactgaagaggcacactgggaaagttatccagataattcaggataaaattcagcaggtgtcttggtctgttttgtgctgctttaacagaatagtgaagactggatgatttataaagaatagaaatgtatgtcccacagttctagaagctgggtaaccaagatcaaggtgccagcatgtagtgactagtgagggccttcttgctgcaccatcccaaggcaaaaagtggaaggacagaagggggatgaatgctgtgtcctcacttggcggaagtgcagaaaagagcaaacccactcccataaccctttttatactgacattaatccattcataaaggcagacccctcctgacctaaacacctctccaaggccctaccacccaacactgttgcattggggattaaatttccaacatatgaattttggggacacattcaaaccaggcaagtttgaaaagcttatatttggggtttacattattccacctggtgaacttcaccagttagactccatttatgacacagctcaggtgaatgttctgttatcccggttgttcaatcaagatccattgagctgtagtgggtgggggaagtgaatcaggagcaaacacttcaggaaagtgaggttaaatgaaagaaaggctgagctaggcacggagaacctgaattctagattttaacacctctcttgatcatttgggacaagtcacgtaaccctaagcctcagtttcctctctgattctcctttagccctatagtttcatgggatgtctaatctcagacactctgctggccatgtggcctcagatccctctcctaatgcctaatatgtgttagcacccttgtgctttcaaatatctgctactactgctagttttatttctaccacttaaagaatggaaaacccatatttaaaaaaaattgatttcccccacaatagtgtgtctgaatacagattctgaattgctttacacatatactgtatgtttatctaattataagtagaaaataatattgtgccagtgataaaaatgaagctaggaactatcaagagagcctggtcctatttccaaataccattatatgctttagtattttggtttcaaatcagcttccaatatttggggagtcagtttttcttttttgatattttttctgctcaactgtttcagaaaatctcttgttgctatggaagtcaaatgggatttttcatctgttttaaaatcatctcctcatgcctttacaattaaaagtcatagctaattataatgcttacctactgaatgtggatcccatattaaacaaaagaaaatatatgttcataatgtcaggttcgtaagaaaaagaatttttttaatttaattattttaccagactttaagtctttcccattcttacacatcccatttgaatgacactaaaatgtataaaatcaattatatgagtttaatttgcccaagcttggtataaaattttattattcccttcctgagtatccggctattctaattaattttctcctccttatcagcggatttaatgattcacttccatgcccctcttttgccaagtgcgtcagcgtgtattgttagccagaggtgtctccatggctgttaagaagctctgactcggtgaagaaacagaagcagtgtgctgagcaggagaagagggatgaggtcatgcctttgagcaccgactataacctttatgttgctcttggtttttgtaatgcacacatatgcacatgcaaatatacatgtgcacacaaaaatgcatgcctagctatatgaattctcatgtcagaaatgagtggcgagtgaagatcagaacagatttcacatttttaacctagtctaaattcagctcctttgcagaacttcatctgagtaatcccttttaaatctgagccctccagttactccagattttcttagcacttagttagttacgtgcatgcctctgctgtcatagcaaagtcacaggctgacatccacagcagggaagataagtaacaaatgcatgaacttgtggcacaagatcaagcactgggtgtacagctcatgactggcattgaggaacatggtaaaaaaggaagggaaataaagcaagtaagatttttgtttgaacattaaggagaattttttggttaggtacagtggaacagtttataaaatgtggtagtatgatccccaatcctggagcacataaagaagaaaataaaaaaacattttcctggagttgcttgggtcagaaatgtcagagatgcagtgcaaatcatcttatcagctatttgagaatggtcagatgtagacatgaagagattaacataattattcattctataaatacagtcatacaccacataataatgttttggtcaacaacagaccacatatacaatggtggtcccataagatggagctggaaaattcctattacctagtgccatcctaacatcatggcacaatgcattactcatgtgtttgtggtgatttggtgtaaacctactgggctgccagtcatatgaaagcatatcacaggctgggtgctgtggctcacacctgtagtcccaacactttgggaggctgaggtgggcagatcacttgaggccaggagtctgagaccaacctgcccaacatggtgaaatcctgtccctactaaaaatacaaaagttagccgggtgtagtggtgcatgcctatagtcccagcttctcaggaggctgaggtgggagaatcacttgaacctggaaggcagagattgcagtgaaccaagattgtgccactgcactccagcctgggtgacagagcgagaccctgtctccaaaaataagataaaaaataaaataaaaataaaagcataccacatacaattatgtatagtacataatacgtgatctctgttactggtttatgtatttactacactatacttttattgttattttagtgtgctccttctactcattaaaaaaatgttaactgacaaacagcgttaggcaggtccttcgagaggtattccagaagaaggcattactattataggagatgacagcaccatgcatgttactgccccaaagaccttcctgtgggacaagatgtggaggtagaagacagtgatattgatcattctgaccttgtgtagtccaaggctaatgtgtatatttttgtcttaatttttaacagaaaaatttaaaaaataaacaaaaaaatttacataggaaaaagcttataaaataaggatataaaaaaagaaaatatttttgtacagctgtacaatgtacaccactgcacctggctaacttttgtatttttagtagggacaggatttcaccatgttggtgtttttttatcaagaagttaaaaaaatttaaatacttataaagtaaaaatgttacaatgagctaagtttaatttataattgaagaaaagaaaatattgtttataaatttaatgtagccttagtgtacagtgtttagaaagtctacagtagtgtacagtaatgttctaggccttcatactcatccaccactcactcgctgactcacccagagtaactttcagtcccacaagctccattcatggtaaatgccctatacagatgtaccatttttttatcttgcatactgtatttttactgtacttttttatgtttaaatacacaaatatcattgtgttacaattgcctacattatttggtacagtaacatgctatacaggtttgtagcgtaggagcaataggctatatcacatggtctaggtatgtagtaggctataccatctagatctgtaagtacactgtgatgttcacacagggacaaaattgcctaacgacacatttcttagaatatgtccctgatgttaagcaatgcaggactatacttattaagcacctattatatgcccaactctctgttaggccctggagacacaataaacagactctattttcaaagcccccatggtcttaggggtaggacaaacagacaagcaaaaattactctacagttcaggacatcattctagaaaaccctagaagagaagttgcactgggtgctatggagaagaagagaggcaccttccctggagcaacggtatgctagggaagtcttcctgacaatatccagtcttctagtttgaaaaacaaaatcatcatgtgaccgtgaagaaagctcatatagccatttgcatgactgaaaaaatatgcgttggaatcgtatctgggggcatggggcagattgcattactaacacataagacaaatcaggaatatttacaattatccttaaaaatcctacatattgctcataaagtactaagtgcatgaatatgtgcatagttttatgttgtggctatatttagtaagtaatatatatgcctaaatatgccatccatgcaataaatgtaagaatcacactctgtggcaagatgctctcagtgtgagacacaaggaaaatgtgatagcaggtgatatactcatttagtgatatagcagaactgtctgcagtacttaaattctttctctctttctctgcctttatattttctttcaagcatgggtggttacatttgtctaagttaaacctctctttataacagtaaagttgtaaactttgtctaagctgtaaacttctccttacaacagaaataagttacagtttgaacaaagtttttgaaaattttttaaatcatcttaaaataatgatccacagtactgaagaactcaatgaaagagtaattacaaattgctaatgtttattaattcttaaggttccttatattttaatgccttgcaataatgaattatttaaatcataggaattataacttgcacataaaattatagtcaataattttaaattaataaatgaaacaacatagtactagtaaaagaaagaaaaaggaacatatttagagatatattcttcaaatttattgaacttcattcacccacagattttgttgttcgagctgttgcttcagaaccaaatctgctcaatgaatatcaccttctgcctcatttccctcatctttataggtcaaattccctatcactgcctccactccatgccatatgtgggcttccagaccaaatctgacttgagggactcagcatcccggggctttccacctccttcactgaagccacctgaggggctcctccgtccatcctgggcatgctcactgctcctctgacagagcaagccattgacttgaagcagttctcagagtctcaccgtctctgcaggagtgttcctacctgataatgaggctctcactcctggcatggaatctatcccactcccccgactttctatgagttccagttcagaggttctcaatgattctcaactgagaacactagaacttcttagtacagtggttctcaaatttggtttcacgttttattcatctgggaagttctgtatttttttttaataccggtgcctagccatcacccacataaattctgatttaatcgttctggaataggtttgagtcatcaagagtttgtagaaatttcccaggtggttctaatgtgcagtcagggctgaagaccactatctttgcaggcttcttgcaggcctcaccttcccagtcaatgccaagagccaaaccagtccatccaggggtctacatacacacacacagacacacaccaaacttgctataagtaaatagctcaaggaatgatagcaaatatatggtcttccttattctaagtgaagtaactcaggaatgtaaaaccaaacactgtacgtcctcactcataagtggaagctaagctataaggatgcaaaggcataagaatgatacaatggactctggggactcgggggaaagggtaggagggggctgagggataaaagaatgcaaattggttatagtgtatacttctcaggtgatggatgcatcaaaatgtcagaaatcactactaaagaacttattcatataaccaaacaccacctgttccccaaaaacctatggaaataaaaaagaaataggaattctctaacacccacaaaaaaaaatagatggtcttcccctatatctaagttgttctagttgatccagtctttcttggagggtggtataaaatgaaaggatgggtggtttcaaatttttcagactccgaaaaaaaaatgaatacaggatctgggtgggaaataatattactaagaagagggaagaaggaaaacagctgaaaataaagtcaggttaagtgattgagtccaaggtaaaatgttataacataagaagaaagagaaaagtaagaaggaaataattgagatattttaggaaagttaatgttatttaaatgaacagacttacaaataaggaaactctccatccagttattagcatcatccaatgactgaggcactgtggataatgcaaagtatacaggtcctgagccaaagtggacagatggaatctcatctctacctctttccagctctggaatcttgggcaattgtgggagactttccaagattcccacagcaagatcttttctcacacattatcttcttacaatatgagattgaatctcctcctgttttgaggtaggatctgtccttcccatcccttgagtctaggaggtaagtacaggggtgtgtaagacggtgtgggagctgagaaggaacttgctgacatgtgtttgttggggactgattcagaaaagaggtgatgctcagtctgagtatggaatgctgagatggagtttgccaggcagagaaaaggtatttcaagtaaggataaccaacatatctgaaggcttgaagatacaaatgtgcgttttcattacaccagggcttctgaaactcagctgcatggacatattcttaaaagatttaaagaatttttattattttaaagggttaatattttattcaagtttattgaacagatataattcttcataaccagagacaatacaaggcacataaaatgcacatattttctagagaaacacagagcttctgaattgaaggggacctcgggatcttttatctcagcccccatgtacccatgtgccatggctgagtgatatagtataataagcagaaagactgtgaaaccagacacatagctaaagagcaagtgcaattaaaggttaaaattagattattattccttttgatgcccttcccccatggcatatcacaaaacataaaagcaaaggcaagggaaaaaaacagcaactgggaagactataccctctagccaacctatcacaattataatgtggtatttgaaagaagaaaagacatttcaaaagggcaccattattaatgccaccaagaagggattggaaagttgcagtttaaatcattgattttgtgccagttctcttgtttatataaatatcaattctcactgtgaattattgcacctttatttagttaggaatacatttttaaaatgccttgctaaaaggtgtgattcaatggagagaaagtattatcaagtagtgcaatgatccataaatagctattattattattatttaacattcgttaaacacccacagtgagctaagcactgtaccaaactttgggaggatgtgtttcttactctgacgaggacagattaaatatgcgaaagagaggaaagcttaggatcagggaaatttatttttctactccaacatttccatgtcaaatttccacttgtcaaattaacaaaattcaagatattataatagtattaataatagttatttcttgtgttcagtgttttttacattacgaagtgttttataaacctatctcattatataacttggcatatagtctctggaagatgtgagaataagagaggtaattttatttcaagagaagcatcagctgatttgttggagcatgaaagggcagtcatactgaaggagaggggagagtttttttggataggtagtatatgcaaaaaagaattgttcctctcacctggctttcagctatcagtttccctccctgaaagcagtcactgtaatcatgtttttgcatatcaatcgagataataaatgagtttactaacatacagtttacacatgtggtatcacactatgttcactgttctgcaccctattttctcttacattttggagattatttcatgctacattattatttttaatggttgcatcctattccatatataagtgtaccacaatttatttaactggtctgttattaaagcatatttatagaaattttgtcacaatttttgtttctgaaaaattctgctattacaaacaataattaaataagtagctttgtagaaacacctctgcaagtatatatgtaagataatttcctataagtggaattgctgagccaaagtgtatgtgccttggtaatttggtagttgctgctaaattccctctggaaaatgtatactggctgcaattcctagcagcaatgtatgagtgcctgtttccccacactgtcaccaacacaatgtgttatcaaaatttgagatatttcataatctgatgagtgaatagcagaatctcatggtagtttcatttgcattccttctaagtataagattgcttaagcattagttcatagtttaacaaaaacattagtggttccttttctgtgaactctatttatattttcagttcttttataggtgggtgttcttttttgaattggtttttggcaactcctttaatattgatgaaattagtccttaatacataatctgaattgcaaatatttttcctagtgtggcattcgttttcattaatggtatttttacgttacagagttatctagttttaataacttagtgtattaatcaatcttttgtggcctctaagttttgtttcatgttcataaacatctctattaacacaagattattttttaaaaagaaacttcctagttttcacttatgattttttatgtaaattgttaatacctttggtatttattttattatgaggtagggatctaactttatttttttaatagatgactattaagtggtcccaactctattcatgaataattcaactttcttccatgagtttgaaatacttctgtcatatactaaattcccttgtaggggaagtgctttgtaaatgccatcattattcagtttagaaacgcagacattcccctaggttaattcactagagttgatggttgataataacctactgaatccaagcagatgtgtggggcaagaaacacagaaacagcaatatgcaggaagcaggaggggtgcctagttggaattaagagagcaaataggaacagaggaaaaataagattaaaatgtcagagaaaaagtagggacaactccaaaacaaatactttcatgatataaaaggtaatgagaggacacctactccaactgccctcctgataaagttcaagctgcatcacatgaactccaggacttttctggtctggtctctacctacctctctagcccagcgtagatttctcactaattatctttcaggtttcagcttgaacattattttccgccatgtacttccaagacttggcaaagaatgaatcaagtgttccttttttggtccctgcagcattctgtgcattgtattgtctggtctctttcacctctgttgtggacatttttcttcactcccagcttttagtcatctctgtcagttaccaagtttctctctggatgacttcttctcttacactaagcccacgtgcttctgatggcactgacttgaccccatccctgaggtcccacacgtgacctaggcaaagctgcttgatacgagtcactctccacaccccagccacaccccagtgagtggttcagggattggcatgtgcccaaggagagctaatgtgacacagtggaacttggcctggggagcctgaatgaaaactcaaaccagaagtcatcttacaacaacgggggtctacagagtggaccaaaaatgaagtagaaccaagaaatggagggacagggaaagccatctgaagccctggatcaaactggaaaccaatatcatccctggattatttcattactaataaattccttggttttcttcacattgttttaagctcaattttctgtcacttctagaaaacgactgcaacttcttaacagctcctgaaggttgtttcttaagggaagaaactgtgtcttaatgctattgtattcccagggctccattcctggagcacagcaacattcaataaatatacagggaagaaaaaggaataaataatacgacaaagttcttttaaatcctaaagtaacaactgcttccaggtatggatattctacttatggaagatcactgagttgactgatggcagaatctggattcaaatctaggctgacccgggcccaaatccttggtttgctcacctgtaaaatggcaacgctttgtggtttgatattaaaatggtgatgataccctcttttattgccggaaccaaggagtgtgccaaagagaagaaggttcctgctttgccaaaaaccctcaagaaaaagcaaagaagttttgcagagctgaagatcaagcacctgagaaagaagtttgcccaaaaggtgcttgtaaaggcaaggagaaagcttatctgtgaaaaactgaagcactttcacaagaaatatacacagatggacagaatggagattcgaatggccagaatggcaagaaaagctggcaacctctatatacctgcagaatccaaactggcatttgtcatcaggatcagaagttccaatggtgtgcacacaaaggtgttctgaaaggtattattgcagcttcttcacctttgtcggatcttcagtggaacctttgtgaagctcaacaagccttcagttaacatactgaggcttgtagagccacatattgcatcagggtacccaaacctgaagtcagtaaatgagctaatctacaacagtggttatggcaaagtcaataaattaatcgccttgacagataacactttgctcaatctcttggcaaatatggcatcatctgcttggaggatctgattcatgagatctatactgttggaaaacacttcaaagaagcaaataacttcctgtggccctccaaattatcctctccatgaggaggaatgaagaaaagaccactcattttgtagaaggtggagatgctggcaacagagaagaccagatcaacaggcctattatgggaatgaactaaggtgtctaccatgattatttttataatctaatccattagtaaacagtaactgttttcaaattgaaaaaagtaaaatgataataatataacagcacatatcaaatacttattctctgttagaactgattatttcacaccttttctcctgtagcctcactgttcttcagaaactttatggattataaaaaccatgaactctctaaactctaaaagaaaggcatcatggatatgagcaattactctgatttccgcaaataaaattgtttcatttagcttccaattgcctctgctaatgagagaacgtaaaattgtggataatcaaaagtcattgatatgtgtttggagaccttgttgtatgatgagttcagcagtaaattttccttgctaatttcattttgcctccagtggcaaaaaaaaaaaaaaatgagtttggattgtctgagcatatgttaactgggtgatgaaaaagataattattgtgctggacatgaacagaaatcattttattttttaattttattttattttagattcagaggggatgtgcaggttttgacatgggaatattgcatgatgctgagatttagactctagagattccatcgcccaagtagcgaacacaggtagtcttttggaatccccagtgtctattacttccatctttgtatccatgtatacccaatgtttagctcccacttataagtaagaacatacagtatctggttttctagaaaccatttttaaatgtccttaaaatttacttagtgtaatctacaaggcagataacccacaagcagataattgaggggtgaatgtcaactgaatataagaaaatgtttgttctattgcattattatgattttaaacagagcattataattttttattttgcaataattaaaagcaatcttacctactttagttggtgggattttcattaagtgtaaaattttatatcacttgaatattctcatgtttcaattgccatcttaaaatagcacaaataatggctgaaacattattcattctattcataagttaatgctgcttaaattctgtcagtaaaatgtattaaaaattctttatgcattttttcatcccttacattcttagctatgcaggggttaaaggtcatgcagaatacttcaaggtattgtttgggtattttcaggggaaaaaaaaggttacctaaactgagtgaagtaaccaacttttacaaggctcttctcatctcattacaactggtggttgtacacattgaaatattgttgtatggggcagttttccaagttgtatgaaaagccttgaaatatttagcattttactctattacaatttgagaaattatattaaaaaataaagaaacaaaacgatatatgtcattgcagcactatttattacaggtggaaaaattctaaatttctaataataatggcatatctgtgactttaaaaataatatttcaaagattatttcatagccaaacaagctaattataatataattgtttttaagtcttaaaaaaggcagggaattatcccagatatctgtatgagtgtgtatgcgagttgggggaactctggaagaaaatctgccagtgattactggggttatgccatatagatgatttttacttctcattttcaacctgccaaatcataatgagtttctgtaataaatctgtataacttttatcagaacaaattctgttttcataactagatcctagttcccagagcaggcagattaggtaaacagccctctttacaagatggtttctaaaaagaggcttgaacacagaagcacgttctaccactgctgtttctagttagctagttctttattacagttgtatttcacagcttagtctataatatagaaattctctagcaaggttggatacctccttactatttagtaggaggatttactttcctggggggtaaaaactgtatcttcattctaccctccaccttctccttttaaatccttggcttttaactccactgtaggttctatgctccttgtctggaagctggaagacctattaggaggctgttgcaatagtctgagcaagaaataatgagccagaacaaaggcagtggctgtgtgtgtgtgtgtgtgtgtgtgtgtgtgtgtctgtgtgtgtgtctgtgtgtgtagctgagtgggaaattcagtaagtctgaggctgacagggaacgcaggagaggggatctctccccactgctgtgctgattacagctataccccgctccataaccttgcagccaccaactctcataaaatctaccaatcagacctaaaagagatagagcactgtaaccacaaatgtcctggccatcagcatagagactttccaaaagacccgccccaaatacatatgttctgtagggtcttagctcaccctaacttaacatttgcttcattttaatagtaaaaatcacagcccaggaaggagatttaagatactaatgagacataggacatataaagaagcatgacaagagaccgcacaggtgcagccaacagaccactgcaaacatgcaataatgttacctggaagagagcttagaaagaatacaagttcaagctaacccactttcaggcagccaacagcagatctctttctgctgtagtttccctttctgctccaggtgaaagccgcaataaactgccttgctgaagcccatcttagactctccatcagtttctattttctgagggtagagaaccgactggccagtcacaagtccacacggcccatgtgtattctctgcctagaataagtctccttcacctctggttgaccagatccttctatccttcaagttcccattcaaacatctccttctccacaaaacccttctatacccacagctggaagtaattttccctcctttgatttttatgtttttacctttttcatgtatgtatatatttttttattttgaaacaatcaaaattgcaatacagagaacttttttaaaccacttgagagtaaattgccagcctaatgctccatcacagctgaatacttttgtgtgtatttcctgcaagaaatgagacattctttacataactacagtacaaacttcaaaatcagaaaattaatattgaaatattaatgccatctgttcctcagtccagtaatgttctttatagcaaaagaatcctgttcagaatcaagtgttgcatttaattatcatctctttaatctcattcaatctggaatggggtctcagtcttaaatttcatgaccttgacaatttagaaaatacagactaacagagtactcatcaatttgggttttctagtgtctcctcatgactagatccagtttatgcaccttcagtagaaatatcacagaagtgatgatttgttcttattaaatggtgcatgattgcaatttgttctattattagttatgctcactttgattgcttgattaagatgatttcttccagtcttctcaactttgaagttattcttttcccctgggtaattaatgatattttgtagagatatattttgaaacttttaacttattcattcacttatcttttgtcagtatggactcactgtttattttattctataagctctaatccattactatcattatttatttttaacctgaaattgacaagatttggccagcagaaaccccttcaaagtggttcctgtgtactttgatacatcctcaccattctttgagcatttctttgctttatgttacaagatgttccaagatcattcgcattttctcttcccccaacctggactcatccatagttctacaaggactcctggttccctgaagaatggtatttagaaaccaaggtctgagtcctaggagtttttattgcatttggggtggtactgctccgaagactgctcagtgcacaaaacttaaaatcatgggaatgtatggaagtgcacacatgtataaatccacacgtttacatcaatagttattatctacctgtagatactgaaaatcatgagttcacactcaaaggttccaactccattgagtttattccagctttctccctttccatatatgcaattcctatttccaatagtgaaaaacctggctcccattatccttaacatagttacttacttaaacacttccatatatgtctcccatctttggaactatcaacttctcacataaatatcctccttattccactcaggtcatgattgcacatggacatcctctcctgtatgttcagtctctgaaacccatgttcaagtcactctcccctaccgctccatctatatattctcctaagcctgtgcattccctgaaaattccatgccaggccacccaccccctgtgatatccttgtcaccctgcttgggctctgttacccactttggactatcctatatgtgtaccctcctcactctaccaggatgcccgtacatggacatcctctcactctgattacaaataataaaattttttagttaaagaaaaaagagatactggtaggatttttagtctaggaacatcctaataccttaaggtccttggccaaaccttaatttattagcatacgtgaaacacactcatggaaaagtgattcctttccttcttttctgcctgtgagaccagaccagtcatcaatataatcattgtttaagggaaaaagtgtattagtttttttattaaatctcaccttctctctttctctctctctctctctctgagacacacacacacacacacacacacacacactctctctctctctcccattcctttaccatgaaagcttatttcactgttgctcaatcctctgtggatcaaaatcggcaaaggatactaaaagtactaatatttttcatggaaaacaccgcctattgtattctgttgctggaaagattcttccacaagactgatgacagaaacaaaggaaatacaaggaagaggttatggaaaacaggagggagagggatgagtaaataagaaaaagaaaaggtgggaatgaggaaagtagcaagaagggaaatggaaagaggtgatctgggagagaaaaaccacaggtgggatgctaaatgggagaaatgtgaaaagaaagtagtgggagtggcattcaggagagtctgacttagccaccaaatcccatggcaaagagtgccaactttattatcagccccaaagcagtgctactgtcaaaataaaaaataaagttacctactccaaaatcactgacatgtctaagcaagtaatggagaaactgttggttcatacactttttgagaaccaaacttctgaatttttgtctacatacttgtttcctgacatctttaaagaattgctgtttggagcatcagttttggacaccacacatcaacatctccaagatggtgaaagagttcttggttgaccaaaactttgttgaagaaaaatattgatatgtgtataaatggaacgcctgcactattagcatcacatctgattttgctgcttttataaagaaagaaactacacatttcatcacgtcaatgtgtctgactcaatcccctaccaacgatccagaaaaatgtcttgtctaatgctaggatcttgtcaaatccaggttatgaaatcattgcctttttatcactttgaattcaaaaacatactttaatatgaagttattctcttcgtattcttcattatagacctaagtttgctggatttccaaaaagtagtttttgaaacacaataaaacttaagggaaaattttgctccttttacagaaaaagaatatcacttcttagaacaatttttttaagatgctctattaactacctttattgtgacactttttaatactgtatgaaaacctcggtatggtgccaatttctttttttccctcttaacttttattataggtgtggggtatacatctgcaggtttgttacatgggtatgttacactcagggagtaagcttagtacccaacaggtagtttttcagcccatgcccccttccccctctccctcctctggtagttcacagtgtctgttgttcccacgtttgtgtccgtgggtactcagtgtttagcttccacttataagtgagaacatatggatttggttttatgttcctgcattaatttgcttaggattatggcccccagctccatccatgttgctacaaaggatattatttcattctttttatggttgcatagtattccctgtatatgtaacacattttctttacccaatccacaattgatgggcacctaaggatgattccatgtctttgttattgtgaatagtgaggaaatgaacatatgagtgcatgcatctttttggtatagtgatctattttcctttggttttatacctaataatgggattgctgggtctaatggtagctctaagttctctgagaaatctccaaactgccttccacagtggctgaactaatttacattcccaccaacagtgtgtaagcgttcccttttctccacagcctcaccagcatatgttgttttttgactttttaatataatagccattctgaatgaatggctgaaatggtgtctcagaatggtgagatggtatcatattgtgattatcatttcgatttgcatttctctgatgattagtgatgtggagcatttttccctatgtttgttggctgcttgtatcactccctttaagaagtgtctgttaatatcctttgcccattttttaatggggttatttgttttttgcttcttgatttgcttaaattcctttatcagatgcgtaatttacaaatattttttcccattctgtaggttgactgtttactctgttgatagtgtcttttactcacagaacaatttgatgaagatttattccatgattagtttaattagcagatcttttttgctgaagtaaatcattctatatgcttcctacagatgttattatagatactactgaaaatatcagtagggcacattagttactttcccaacattcatttcactttattccttcctaatgaaatcctgattttagtttgtacattatttcccccactcaccaaatgactgaggaaaacaaatctcattgccaaattgtccctccttagttgaaaccagtcagcacatgacactgttctggctactgttatataggtagaggagaaattacatggcctgcatcggtccaatcatagttaggggaagaactctcttttacaatgttaagaacatacgttacatcagattctcctggtaggtgacttgtaaccataggagaaccagtctgaattccaggctgtctaatggagcagaaatatggaaagcatttatgtcttgataacattatggatcactgagtcaccaccctgaccaaagctgactctacttctggactctctgttatgtgagataataaatttctttactgtataatttgtcattgacttgggcttttgtacttgcagccagaaatatcctaattgatcaaatcaagtccaacctcctgtctgaaaactgaaattgcaagcagacatgcatgccaactttgaggtgctggtgaaagtgtttctgcaggttaggccttcacagcttccctgcagaaagaaatctgaaaacactgaatagttcccatgcaggtttcttctgctcagataattttaaagcttaaacatgacctcataatcctttccttcctggcatagagagaattggtaatgccagctttgcaaggtaacctcattgatttgaagaaaaaggaaatgatgctacacaaattaaacccaagagagtcttggagaattctgatgttctttgacagcaatgtacctttgagtcacgggttttagtaccagctgccatcaaaataaaaatgtcaaaatcaattgagtgtccaagataattttcacattgctatgtcagtctctttttcaagtttaacatcagatggcttaatttgtacagagttaatgtttactcttaggattttattttgatttttttgcacagtttagattcatcttgattatttcctgaaaatcaccactaaatttacatggcttttcccatgaagaaaatattctttgaacaaaatcaacttccagttcaataggagaaaccataatcatatgcaaatttgttatgtatgtgtatatacttttctgaaaaggggaattatattttcatctgattcacaaaggagtccatgactcaaaaactatttctgaaggccaaatagtaactatagatggtcagagaaattaccgtgaaagaggaaaagagaagaaatgaaataagacgtattttttaagttttggcctggttgagaggacagatataaggtgactgcctcttggatatggcaaagtggtggtatatatatttgagtctattacagtatagttggaaaacataacaagtaaataagaagtccctggagactttaagacatgtaatgacaatatattgctgtgtgggtacaaattaggtgcatgcctggatcaatcaaagtacttgtaggaaacttaagacacaatccaaaaaaaaggtaattgaagagattttaatgaaagtactatttacaaaagagtaaaagatgggattaagggaagccacagggatggtgaaagagcctaggattgacaacaggagaagccattaccgcttctatgccgaagctagcctattgagagtcatggtggtagaaggatgcctgacaggagctatgatcataggtggaaggttacagaaacggtccacctgcagcaccacaggaaaggagccccggaaataaataccccattctcactctctccccataatctgaccgcctgccaaagcctctcactgaccaaatccaaacaagagctgagggggtggaagctggattatcttagctgacaagatcagtcctttagaatcaaaacagggtcggccaggcgcggtggctcacgcctgtaatcccagcactttgggaggccgaggcgggcggatcatgaggtcatgagatggagaccatcctggctaacagggtgaaaccctgtctctactaaaaatagaaaaaaatagccgggcatggtggcgggcgcctgtagtcccagctactcgggaggctgaggcaggagaatggtgtgaacccgggaggcggagcttgcagtgagccaagatcgagccactgcactccagcctgggcaacagagcgagactctgtctcaaaaaaaaaaaaaagaaaaaaagagaagaatcaaaacagggtcatggatgaagagggacgtgacaaggcaaacaggcaccacccaactcagacacggcccatataacagtacaggagggactctcaataagaaatagagatatttagttccacagtagctctgatacacatttttggcaaagatgtgtatttcagaatcctttccgtttagttaatgctagtttttagtcatcatactctatgttgacaactttacggatataaacaaatacttattttataatcattaagtttctgatagtaaagctaatttttcccctcaggcaaaaatattcttctagtttcatagctttggcagtactttattcctcttaaagagtaaagtgtttatgtaaactggaaacaattgttttgattccatctccaaattatactaattcctatgagattcacagttcccttttgagttgttatgaacctaaactgtgtccaggagtatgtgtgggtgggtgtgtataatgtactgaactgatcaattgacagtccgtgtgtacatgcacctggaaggccaccactagctcatcatgtctgtgtcttttcagggatggactgcataggttgtctggtgcagtggaaagagttctgaagacactggtcatgatctgtcttttcactaagcagctgtaggtcttttggcaagtccctcacccctccaactactcttcaaaggagtaatgggttgaggcaacagaggctcagatatccaccgactttaagttctgtggttcccatgcctgtgcctgatcagcatagctaatgggaacatccactttgctgcttactgactgctctggtttgaaaagagctttgttttaaacttatctagagtgctaactactctactttaaattaaatattagataaggaaagcaacagatgacattaaaatacaacaaatcctcagtgactttctgtgggtctaagagttacagcctcacatgaaccttaggatttccgtgaattgcataaattatgcttaccatttcgcaggtaaatatttacatgtccaagtaatgactccacaaagctgtgagaaaggaagaagataattcatgccctagaatagatctgtacattgtaattcaggtccactggagaaactctatttactatcatcttcaatgtcctggaatggaggaaggagctatggagccactgctgaggccaaggtattccatgccagctgtcacatgggtatttgtacaacattcttgcatcatacaaataaataattagctacgtatttaatacctactgcacactgtgtattacatatattgtttaattctcataactgtcctttgatattatctccaatttactggtctcaaagaaatcaagtaaattaaccaaagacactacctaggaagggaaagagtcaggatttcaacctaagattctaaagctgatgcctctatccttgttaccctagtgtctccagcaactctggccagacatattcactatctctcaaacacttccattggtttttcacagaaaatgaagctgttcacttaactttgatttctcccttgagtgatgtatctgaacccttagccctccacatgtgcctctagcaatatctactattccctggagaataagaaccaggtgggctgggcctggcctcaattgccagtattctccagctccatagcagggcaagcaacacatccatgtgacctgtctttacgcactagaacttctatctcttgtctttcttctaaattatagaccatattttcctgtaggcatctacctcctcttcccttccaccataattacccaattatctaaacaccctactccctacttcaactgtctctagagaacattcaccttctaaatgtgctttagataattttatacctttactgggctttgagaatttttttaaggggaggcactgccctaacccactctccttttgtcttaggttgggtttcttggaaatagattctaagatggagaattgtgtgcagaattttggttgtgatgtgctctcaggcgatacacctgcaaggaagtgacagaagaatgcctgaggaggagtgagaatccaggaatgggtcagccctgaagaggggtctggggcaggcactgtggtgtgcactgtacctgctcagattggtgggcctgacttgtgtcttcagcttaaattacctattcctcttccagacaaaagatctttaaggtcctaaacaccagtctggaatctgactatgcaaaaatgaaaagatcctgagctccctctccagaggaactaagtgaaacaaagaacgattataaagtaggaaagttctaaaaatagtaagatgagactgggtaatttgaatgaaagccagtcaagtctatgtggaatatagcatcttactgattcattatcagcccatataatttaattacattctacttaccatgcaattttcacatcctaaaccatccagcgtgaagtctatgttatctgattaaagaaagaggaaagggagagaagggagtgagagaaaaagagagctcctgaagccatgcaaaagaggagcttccttaaggatggcagaatgcattgcaaattcagaaacatatttaacatataaaagaaataatgtaaatttatctcttgttttctataaataagccaggtttgattatcttaagctattaatacaaatattcttctctttgtctttcttaacttgagccatttacaatttgtaacacagagaatcatttttcagatctaacttaacatgtaactcttcattgtttcaactgaaattagcaaatcccagaaagaaaattcttccctaagaaatcatttcttcaaagtgattatttaagagttgctaagttagaaacatacatatcactatcactatcttctgatcatggtatcactatcttctgatcaaaatttaaagatattcatttgaagaacatttatacctcaagttctaggaaaaggaggttttagtgactgaaagatgttgaggaaaatgtgaagctcttaattaaaattattgagtcacgtgaatatactgaataaaatggtggttcccagaagctgggacaagtaatgagaaaggggaaatgacgaggggttggttaatgggtacaaaaatacagttagtagaaataacttctagagcttgataccacaatagggtgactatagttaataatttttattgtacgtttcaaaatagctagaagagaagatttggaatgtttccaacacaaagaaattataaatgttgaaggtgatggatatcccaatcacccagatttgatcattatacatcatatgcatgtatcaaaacatcacatgtaccccataaatatgtacaacttattcagatctttttttctatttataactgattgaataaacctattcattttactaaacaattagttttcaaaaataaccaatatataaaactgaagaaagtcaaagaccatatcctgaattacaaaaataatattttaaaatatatatactcctagaattatttgactttcacttaactaatactctttgtgatcaatccccctgattaaattcaaatttatgttaacctatatttacatttatttttggaggtactctagaaaagttttccaaactgcatcctagttgctgtggcctttggtttgatggctttcacttttgagttcaaacctcatttcccaaatacattctacaactaggcatatttatttagaactcaaaaggccaccatcttcagacttaagaaacaaaagcagcagtggtttcattatatttcatatatttcattatattttacctgtgtgtaaaatataatactgtcttcttgggcgaaaggtcatataattctactctcatgtggatgttttccacaaaatgaatacatagatttaaactgatcaatccacattctttcaattgacctctcttaaaaaccaaagcacagccatttgagcttcagtgcttagagcaactctttctggcctgtgtaaggaatttacccatgacttgggttttaatactgtactctaaccagcagcaagagagagccaccaacaagaaaaaacagggatgctgattttaagaacttaattacaagaatttatcagttagaataaccctaagtactgtaacaaataaaccctgaaatgtcagaggcttgacagagcagaaggttatttcttactcagataatggcccaactctggaactcctaattgggaggtagcttttctctacatggtgatttgggaaacagactccttgcctcttgtggtcccacagggtctcataatcttctgcattttgccagtggaagaagaaagcatggagaaacatcctgtttcttaaaaactgtggcccagaggtaacacacatcacttttgctcacatttcattgatgtgaaataatcataaaatcaaactaagatgcaaggtggtgggagggggagtgtgtagaaaatatacttaaacctaaactatgggacaaggagcacaagttttggtctacaactattcatcacaaccacaaacaccatcaagcaagaatttatcaacacctattttattctggatgctgtggtaataatcaaagacagcataggccaagtgacaataaagaactataatgtattcacgctgtcattcagcaaatgcttactaaacatctaccggctggcacttgctgggccgtaaactaaggaaatgaagatggtgctctcaatcccatataggagacaggcctgagcagtgctgggttacctcaaagcaaatcaagtatatttttaggattccaatgtaggagcgccaaaactagagacagaaaaaaaaagaaagtttttgaaacaatttgatccctgatgtgtccttaaatagcattaaaatgttcatcaaaataaaggtaagaactttgtaggatttctttatacttatgattaacattttttaattatgtgtatagggaacatcaaaatatttttataatatcctagccctttaaggtatcaacttggtccagatatttaattaagtgtaaggaatgtcccaaaagacctcacaaatgggatggaatttgagtgccttagaaaaaaaagcaaggctcagataagcagaagatatgagggaaggtgttccaaatcaaaggaactaggatagcgctagtcagcagagacagcatcaggacaaccactatggctgtgaaagataaattaactgggtgatgggtcctcttaacagcccagcttcactcagatctgccttccctgttgaatgtgagcacctcaagggcaaggaccatggccatcctttagccccaattaccagtatctacccaggtttggagaactgaataaaattcaatgtgtgcatcaacttgcttcttttaaatgctgcaggatacattgcaacaaggtgaaatttttaaagcatatcttgactctggaaaccatatgttgtcaggtcaagatgggaggcatgcagtgctcttatctgtctcatatttgaatgcttctgacttttatcacagattaaatttactggaattcatttatttctatacatttctccttctgtcatcccctcttactttgtgtagtaaatatgagatatttttctccacagactcttcacctcagaaaactgtcattatctattctgtcagtcctaaacatctggagaattggcaaaactattagttcaaaatttatgatggcattcttcacattttacagaacaaattctggtaatgtttactatttccaatatctggaggactgttatttactatatatgctttttttcacaggagaaaagtttatatcactaccttgctatgcttcttagaaacatttttaaagtattatatagggtcacaattctatcagtgtttttgtaagagcttgaattcatactcatggtgtttgaaagaatttgtttttctctaggcagagctaagattgaaattagatttcacgaagatgacagttttcaagacatttgaaggcagtctttttaaattctaggaaaataaaatatcttagttctgacattcagatatcaatgtaggctagttgctagtgagtgagcactaatcagtcgtaactttcttctgctgaatctgaacaccacctccaaatactcagcccagcactccatcagtaagcacccatgagttgaagtttatatgaggtgagactattcgcatttcccattatatctgaagtacctcacttgtagcagttaagaaaaataaatataatcctataatatttacagagatattagtaccctatcaaattctgcttagtgctactaatccccatagaccctttcaacactttgttaagaaatagtgaaatttgattaaccctattctagaagggattgtagttaatgagagcttagcaactaagaaagttcacggggggtaagaagaaacatagcaaagtccccttggcctctttcataaccatactattgaggaaggaaaaagaaaaggaggcaaaaattgacaaagtaaatattggaaacttggaagtcagaaaatatgtttatacaaagggaaagcaaaacacatttactgttgaggcaagacaaccaaatacaaagtaaataaacacatatagaacaaatatggcaaatatatagaatgcatgctccccaacccctttccacagccatggcaaataccaattatcaattcacagcaattctcatgctgagcccatgtgcaatcttagcccaacacagtgtcagtataatcactgaaacatgagatgagataaggcttagttgtcattcccagtcttgcatctgttgctaaagctttcttaggttttttactatactgtatataaaaagctagggctctccaaggcacacaagtcttaaaacttgccacaagttagcagtgaggcagataagctgatctcatccaacctcccttcaatagcaaaggaaaaagaaaactaacttatatttctctaatgctccgtaatgtataaggagctttatcagcactacccaacagaattttgagcaataatagaaacatatatatatatatatgttcaatccaatatggcagccactaatcacatgtgcctattgagcatttgaaaattagcactagtataactgaggaactgatttttactataattaagtttaactggccatgtgtcttagtcattttgtgctgctacaacaaaatagcaagatgggtaatttataaagaacagaaatttattttctcatagttctggagcctgagaattccaaaatcaagacattagcaggtttggttgtctggtgagagctacatcctccacagggtaagaatacagtgtcctcacatggcagaaggcagagaggcaagctcaccaaatgtgtgaaaccttttataagggtcttaatctcattcatgaaggaggagccttcacggccctatcacctcttaaaggctccaccttttagtactaacacattggcaacacctgactttcggagaggacatagttaaaccatagcactatatatggctgctatattgaatagcacaggtatccatattatctaatttgatcttcacaataactttgtcaagtaggtcatctccattaaaaagagaaggtaaagagacacagaaatattgacttgccaacattacaaagctagagagtgaccaaatgtatacttgaatctcattctttcagaatctaagttatcagacccttctttggtaccacatcaaacttgaggtaggtatggatcaaaagaggaccatgccctgaaactagtggttctatgcagcccactatgagtttaccacgggaagtacactgcaaagaactaactctgaaaatctgagattttaccctatttgtaagctaacaaattagcatgccaatttcatgaaagccagcagaacacagaagactcctggatcagagtaaaaggactttattactcacagtaatagcagtagacagggtatgaacattttcttacagcaacttcccaagcccgaattcccacagaatgatggatgcagagggccggatgactcttgtgcatgcagtgggttgcattacagtttgcaaacttaccttagaaaacctaaatcatttatagtaggcagaaagcatgcctactccttattccaaagcggagtattatctttatcataataaacagtaagcatgactccctttctctatatctatcctccaaggatgctgtctatacaagcatccttgaaatgataacctgaaatgaaggaagtcccaaaacatgcataaatgtgagaaaccacacaccacttcttctcctgtttggtgaaaaactattttctcctgttttgtcaccaaagagtagaaaataagccaagaaaagagaaagatgactaaatatcaacataagagccaagttgaggtgtaagtgtgtatgtttgatagaaagactacgtgttcaaagttaaaaccaggaattaatgttaagccaggaaattaaagtgaaagtaaatttgggaaataatagtgccatataagtgtgatgaatcactgacatttttattgggcattaacaacacgtttttaaatataatttcccccaaactagaggctacttctttcttggaactgaatgataaatacatgcacataccccttacccaaggcagccatctgttctaagggatcctccaggttactgtccctaccccgacaccacactgcctcccagatgtccttctccctgaagccagccccagatcttctctccccaagcagctctcctttttgcctgtcttcctgagtaccggtccccaaatcaccaaattctaccttgaacatattgaatgaaagtgtgcagtgccttatgccctgatgagaagtggtcttggaagatgttttctgcaccaacttaagaagctatcacaaaatcatgataaaaaaaatgatgagctatttatactttgcagacataggtggttgttggaagaaaagagtgccttaggaatcaaataactggtattggaggattcctgtgactttgtaaaattcaattaaatatccaggggaaaataatagacaacattgtcacctgaggatacattattggtccttgttgaaaaagcagtagtttctaaccagttccttcctaacctatttgccattaatttctggaagttacaaactgtaataacaattaccataacactgactgtagcataaaaaccataggatgttagccccaaaagatggtcagaaataatgaggtgctaattttacagatagggaaacagagacctgaagcaaggagtgtctttttcagagtcacacaaccaatcattaatgtatctaagacacatttgcaggaggattctgttcttcactcctccatttttatacaacatactatctcttgcttttcaacctacagtaagttgagccaaaaaaaaaagatacctacaaatctccttcttgaacatgccctttgaggtggctggaacagtatcaagtggtctgagatagcaatgcactaggtggaagcttagatagatggcactaagtggaagcctagtaggaaacctcagccctgcaggcagcttccatgtgtattcccttgggtctgccacaaaagcatgttgcactacaaaagattcaaaaggcaaatgtgtgcacagcacaggagggagcccagttcttctctgaggagtttcctacttcagtggtgttattaagctgggtcaaaagaaagtcatttcatttttttaaaatatgctaatacaacctcaagcaccagctagcttaaatgataggcatttcataaagttcatttttattattctcagctgaaaagtaaataacaccctacaggtgtccttcatataaaaatgatgtatttgccttcaatggagactctgtattgactaaaaccttatctgtatttcacaagacagatcatttttccccatcacctttcaaagaggtgttgttgccagtctatacaggacaaacgaaaacagtctaataaaagaaatggttcagcaggaactaactgaaagagttcccagtgaccaaaactggaacaacttgagcaataaaataaataacctagtattggattataacccaaagaataaaataaatagccatgagttcatacttatataaataaacataaataggcatcaatagtgtatttataaaataatttccccagaactaaaggctactgcccccttgggactgaatcataaatatatgcacagtaaatatcaatataaataaatgactgaacaaataaagtaggggagaagagataaatcttcctttcagaattccatataatgtatgttcatattctccctctccaaaaggcagagcttaattcctcagttttggaggtagactagacttagtgattcacttcttaaaaaatagagcagggaaagggaaaaatagtaactttatagtggagaatcatggcaaatgctaccttaaccaaatgatgacagttaacaccaccagtaatgtcaagtgaatatcatgttctctaatatgatctaatgagaagggcttgacttctgagatactcttcaccaaaacttataaccccagtctaaacatgagggaaaacatcagataaactgagatcagggggacatttttttctacagaatacctggccagtattccttaagacagtcagtcatgagaaacaagcaaagattagaaagtcacagaccagaagagactggggagataagaaaaattaaatacaatgtggtgtcctgaattggaacagaaagaagacattaatgcaaaaactattaaatccaaataaaatctgaagtttagttaatagtaacgagccaatgtctttttcttaattttgaaaaatgtaccatggtaatacaagaagttaacaatgggtaaaactgaatgaggggtatatatgaactctctgtactttctttacagctcttctataaatataaatttctaccaaaataaaaagtttatttcttaaaatagatggtgcaaatgtatcttattgcatgctcttccctggagcatggtagagttttatagtgaatgcattgccaaatccaaggaagacagaagacttgagaaaactaaatactttcagcagccaggggtggagtggtgacaacaagctgtagaataaaaggaaaagtgatgtttgttcagtgaagaacaaactaagtcttatttgtgtagtggtctcagaagcagaatatgttctaaacaaagagttaaggaaggtaaaagctcaaaccaacaagtaaaccagatttcacagaaacacaaatgtgtagcggctgtccaataatgattatgtttaatagtagaatagactccagttgcaaacatatgttttatacaaactcttcaaattggagacatttctctaaattttccttgtaaattgtgcaggatattacatctgactttcatattatcatctcaaaagtggtgaaaccattttgccaatcacttgcatcacctttctgccaccctgccttctaaattacttccttttcccactcaggccatcctctactttcaattccaaaggtttcagttcctacccaaactgtccccctctacccatcccacttacaacccttagtctcattagaaaaatctcaaccacccgcttgcctttaacacctttttctggatttgccttctaaacaataatcccttcgaaatgactttgtgaatgaatgcaactgatttaaagggtaaagagaaatgtatctgctttctacaaaagctttatgtagatagggaaaattacttgtataacttgccctttttctcctcatctttctatagaaacatagagttgtgtttccaaaaattccaaggaaggcctgggcatagcttgtaatacatgtggtatggaggttattaaaaacagtttttcaattcaagttctcaagcctactatgaatgtttaccaaagaacgacgtgaactggactgacaaatgcattatactttggtcaatatatattaggttcacattttgttttatcaccttgatggctgaagaataaatttaaaagggatggactaaacattcaaagacgcaaacacgagtaaatacttcagagttcaatatgtagataacaaatccatcagcatataaacatgttcagcaaacaacagactgaacaaatgtttattgagtatctcttaggtgtcaggaaatgtgcaagcactttggcaaatgctgtcccatttaattctctctataaatgtgtaaggtaggtataattatcctcatttttcaaattgtaaaaccaagcttccaaagattaagtaacttacccaaggagaattgatgtgttacttaagtaatattagttccaaaatatcagtggcttaacacaataaaatattgaaatgtttctcactcatatcaccattcaatgcaagtcagtggtgggtgtggctaagaatattctatcccactcgtccattcagggacccaaaatactttcatcccatgtctctgccctcccctaggtccccagagacctctccatccaatagctagatggagattaagagcacattaaaggtttttttgtgcaagacctggaagtagcacataccacttatgctcaaagttcattctccaaaagaagaaccagaaaaggaacagccaagcaagaagaaaactttcagacaatgggtaaaactgggtgacagtatataagaactctctgtactatctttacacttttctataaatataaaattttaccaaaataaaaagtttatttaaaaaaaaaaagatggtataaatgtatctcattgcaagctcctgcctggagaatggtggggttttataaccaatgcattgtgaaatccaaggaggacagttaaagaaaccttgggaaaactaaatgccttcagcagccaggtgtggagtggtgacaacaggctgcagaatgagaggaaaaacgatgtttgctcttcacagagcaagtgaactattattcgtgtaggagtctgagaagcagaatatgttctaaattttactaactgtagccactatatttctaccaagcactacccaaaaaaaaaaaaaaagtgactctatctcctcccctgccagaaaaggccaaatttgctttccttctaccactgcatggcagcaatcatccagcactcctcttctctccctggagcaacgtcagaggaagactgctacaacagaagattcaaagaagatccagagtctcataatataatacccaaaatgtccaggttgtaataaaaagtcagtcatcatatcaaagaccaggaaaatttaacttaaatgagaaaaaaaaaatctgcagacgaaaaggatttttgaagcccatagcaaaaacatctcagtgaagaattatgagcacacttgaaacaaataaaataacagaaaatcttgtcaaagaaatagaagacataaagaagaaccaagttgacattttacaatggaaaaaaatacaataactgaaattaaagagctcagtttatggactcaagagcagcatggaaaacagaggaaaagatcggtgaacttaaagatagaaaaatggaaattacctaatctaatgacagaaataaaataaacagaagaaaatcaacagagtattggggacttgtgagatgtaacagaagatctaacatccatgtcagtggagtctcataagggagaaagaagacggggctgaaaaagtattttttaaaataatggctaaaaatgtcccattttggcaaaagatagagaaaaagattcaaagagttgagcaaaccacaaatataataagtcaaaaaaatcacaccagacatatcgcagttaaatttctgaaaattaaagacaaacaaaaaatcttgcagctgtgaaagagaaatgacaccatacctatcaggagaaaaaaaaattgaatgacaaggtttttcagcagaaaccatggagaccagaaaatcctggcacaacatttttcaagtgctcacagaaaagaactgtcaacccagaattctacatgcaaagaaaatatccttcactaatgaaggattcaatacagtcttaggtgaagggaaactaagggaatttgcctgaagatctacactaaaagaatagctaaagaaagttctctagacagaaatgataaggagaaatcttagaccatcaggaaaaaaggaaaaaaacagaaagagtgaaaatatgaatcaatgaaatatgctttcattttcctcttgttttctaaattatgtttgatagttaaagcaaaattgtaacagtctgatgtggttctcagtggatgtagaggaaatatttaagataattttattataaatggaaagagggtaaaattatataaaggaagtaaggtttctatactgcacttgaactggaaactggtaacaccaacagatgggataagttgtgtatatatcatataatatctagagcaactactaaaagagctctacaaagaggtaaatccaaaaacactaaaagtaaattatgatgaattccctttaaaatgtccccaagtaacccacaggagctgagagaaataaacagaaaaacataaacagtgaaaacaaatgaaaaccaaaaaataaaatggcatacttaaggattaacatatcaataattacattgaattttaaaaggtctacataccgacccggagccgtggctcacacctataatcccagcactttgggaggccgaggcaggaggatcacttgagctcaagactttgagaccagtctgggcaacatagcaagacctcatctctataatataataaataaataaataaataaataaataaataaaggtctacatacgaatgaaagacaaagattggaagagtggattaagagaacatgacccggccagacacagtggctcaagcctgtaatcccagcactttgggaggtcgaggtgggcggatcacctgaggtcaggagttcaagaccagcctggccaatatggtgaaaccccatctttactaaaaatacaaaaattagccaggcgtggtgacaggcacctgtaatcccagctactcggaaggctgaggcagaagaaacgcttgaacctgggaggcggaggttgcagtgagccaagatcacaccactgcactccagcctgggtgacagagtgagactccatctcaaaaaaaaaaaaaaaaaaaaaagaaaaaaaaaaaaaaaagaaaacatgacccaactatatgctgtctgcaaaaaactctaaatgtaactaggtaggttgaaagtaaaagagtagaaaaagatatgccatgaaaagattaatcaaaggcagtaggagtgtctatattaatatcagataaaatggacttcagagtaaagaaaattaccacagaaagagaatgacattacataatgataaaaagctcactccaccaagaagacatagcaattctaaatgttcataaacaaaatagcacctgcaaaatacgtgaagcaaaatttaacagaactgcaaagagaaactggcaaatccacaactagaactggagacttccataccccactcaaaaactgacagaacaaaatgacagaaaatcaaaaggagtataaaggaaaccaaaaataccatcaaccaacaagatctaatcaatatttataaaacacttcaaacaacagcagaataatcattcttttcaaggccccatgataaaccttatcttggaccataaaatagacctcagaaaactcaaaagaactaaattaacacaaagtatgtcctctgaccacaatggaacccaactagaaatcaacaacagaagtataacaggaaaatctctaaacagaaactaaacaacacacttctaaataattaatatgccaaagaagcaactcaggagaaatctttaaatactttaaatttttatagagaaaatcaatgaaaggttgtttttctttaaaagatcaataaaattgacaaaccttataactgacatagaaaaataaaagattgttattttgttatcaaattattgatatcagtaatatcagtaaaatgttatcaaattattggtatcagtaatgaatcagggaatatcattacaggcctgcaaatatgaaagagataagagaatactaaggacaattctgtacatgtaaatataacaacttaaatgaaattgatcaatacctcaaaaagcgtgaactattacaattcacccaaacagtttaaataggcctataactactaagaaaattgtattaataatcttaaaactcctgaaaaagtaatctccaggcctagattgtttctctagagaattctatcaaaagattaaagaattaacaccagttacacaatctcttgcagaaaatagaaaaggaacactttccaactcattttatgaagccggtataccaagcaaaggcagtaaaaaaaaagttagagatcaatatcttccatgaatatagacattcaagtccttaacaaaatattatcaaaagaattcagcaatatataaaaagaattatacagcacaaacaagcgagatttattctagaaatgcaaggctgtataatccaccagattaacaagctatagaagaaaaatcacatgatgatatcaatcaacacagaaaaattatttgacaaattttaacattcattcattataaaaaagattcacataaaagtagtagtagaggaatacttccttaacttgataaagaacattgacatgaaacctaaagttaacatgattcttaatagagaataactaaatgctttctctctaagatagggaataagataaaaatgtctgctcttactactaatattcaacatagtactggtagatctaaccgctaaaataagacgagaataaaaaagagaagacatacatatgagaaagaagaaataaaaatgttcatatttcaaatgacataatcatttatgaagaaaatttcaaataatctacaaaaaaactcatatctaataagttagttcagcaaggtagcataatacaagatcaatacccaaaataaaagatatttttatatcctaaaaatatatatgtgaaaaccgaaatttcaaacacaatgccatttgcaattattctaaaataaaataaaatacttaggtgtaaatctaacataacatatgcaggacttgtatgctaaaaattacaaaatgctaatgaaatgaatcaaaaaaggcttggacaaatagaaaataagttaaaagatggtagacttaaaccaaagcataccaataattacactaagtgtaaataatgtaaacatcccaattaacaagcagaggatgtcagactggataaaaatgcgagattcaattacaggctatctataagaaacctacttaatataaagatataaataggttagaaataaaaggattaaaaaaggcatgtcatgcaaacattaatcaaaagaaagttggaatggctatattaatattatacaaactaaacatcagaacagagaatattatcagggataaatggagatttacataatgttataagaactattcatcaaaaaaaatcttaaatgtgtatgtatatatctaatgacagaacttcaaaatacatgactcaaaaattgacagaactaaagggagaaattgacatacccacaattatagttggagattttaacacaatttcctcaataattgacagaacaagctgacaaaacactgatagatgtatataagatttgaacaaaactatcaagcaaattatcttatagaacattgtgtggaacaatcacagaatacacattattttgaaacataagcataatatcaccaagatagactacaagctgagccataaaataagtctcagcaaacttcaaaagattaaaatcatgcagaatatattctatgagcctgagtacaatagaactaaaaataagttttgaaagaatctataaaatctctaaaaattttaagttaataaatgccctcctaaatattgtgtaagtcaaataaggaatcatgaaattagaaaacatttcttactaacaacgaaaatacaacatactgaaatttgtaggatatagctaaaataacgcttagagcaaatggataattctaggtgcttatattgttactgacaaaatgttttaaactaattatcttagcttttacattaagagaccaggaaaagggtggtgaattaaaccaaagtaagtaaaaggaaggaaataataaatataaagactgaaaggaataaaataataggtaataatagaagaaattaagtcattcgaaagctggttctttaaaaagatcaataaaattgaaaaattattacttagactgatcaagaaaaaagaggaaaaaactgaaattaccaagattaagaatgaaagaaggaatattactatagatagtataggctaaaaggatatgaaaggaatattgttttgggggggttgtttttttgttttgttttcacttatttgtttattttcaaacagagtctcgccctgtcacccaggcgggagtgcagtagcgtgatctcagctcactacaacctctgcctcttgggttcaaacgattctcatacctcagcctcccgagtagctgggattacaggaacaggcaacaacgccaggctaattttttttatttttaagtagaaacggggattcgccatgttagtcagtctagtctccaattcctggcttcaagtgatctgcccacctcggcctcccaaagtgctggtattacaggcatgagccaccatgccgggccagttttggggtttttttgttttgtttttcaaaaataggttttaagatataccaaataaactatacagatatcctctaacaatacaaaaaaattaaaaatgaggttaaagtatatagcaaaagccaaatatgacaatacacatgaataatttataaaacaaggcttttaatcctaaataactaaaatggggagacctcactgagggctaacatacataaaatgaggactaatagcaaggaacaatcctaaacattttcccatgtgactgactaagccacaaaaagcaccttagaaaaactattagagtaatttttttctactcagttaccaccatcttttccttttcaccttttccctgattttctctaccaatggtttttctttggtttgatcagttgaacccaaaagatttggaacctaaaatgagtatcaactcttattggaatagcgcttgggaaatgcaatcctagaaaaggcaaatttttacctgaggtagcttgagaaagttcagcatccattctcagtgtgagagcatctcccatgttaatcactaggttaatagctgtgcttggctagattacatgaccctgcatgatactggagtgctccctggtgaggtgctactatctacacaaacacctgcccattaagccttcaataaatacaaagcaccattttaaaccatttcactagaataaatttttaaaatatatcatttcttctggcctaacttgcttcttcagatgggctggggtgctgctcatgacacggaagacataacagctaatgtgtggctatttcaagctctttagacttcagcacttcccacttatcaagcctcagtacttttttgcagcaataatggtattttccattaacattccctctgtcatgggaccaacacccccagtaacaggaatgatgtaactggcttttttcctgactccttaaaattccacatctccaaccaacttgagtttgccagttatgggaccttgacctctcttttttcccagatcaatgactgctgaaaaaggggtcaattcagctagaagataaaacaattgtaatataaaattatttttaaaaagaacttccaaaacctagagtaataaatcaatattcaagtacaagaagacgattaaacaccaagcaggtttaacccaaataagaccacctcaaaacatttaataatcaaactcccaaaggataaagatttttgaaaggactctaaaagcaggaagagaaaagaaacaacaaacaatggagctccaatatctccagcagcagacttttcagtggaaaccttagaggccaggagagagtggcatgacatatgtaaaatgctgaaagaaaataacttttatcctaaaatagtatatctagcaaaaatatccttcaaacatgaaagagaaataaagactttctcagacaaacaatagctgagggatttcatcaacaccagacctgtcctgcaagaaatgcaaaggaagttcttcaatctgaaagggggacattaatgagcaataataaatcatctgaatgtacaaaatgcactggaaatagtacacaaacaaacacaatattataaccctataattgtggtgtgtaaactattcatatcttgagtagaaagattaagagataatctatcagaaataataactacaacaactttgcaaaacagacagttaataagctatgaatagaaacaacaaaaagtttaaaagtagggggataaagctaacgtgtagcatttttattagttttctctttgcttattagtttattatttatgaaattagtctgttttaagttatcatcagcttaaaataatgggctgtaagggattatttgccagcctcatggtaaccaaaaatcaaaaaatatataacaaagacacaaaaaagaaaacacataaaattaaaacataccacctgaggaaatcacgtttgccaaaaggaagacagaaagaaaagaaggaaggaaaagaagaccagaaagcaacccaaaacaaatcaaaaaatggcaagagtaagtccttacttacggatagtaacactaaatgtaaatggactaaactctctactcaaaagacatagagtaggtgaacggatttaaaaaacaagacccaacaatctggtgcctacaagaaacacactttgttactgaaacaccagggcttctgtctaggtcctgctgcttgccacagagaaagtcaatcactgagaccatgagtattgccaaggaagaagattttaattgggtgctgcagccaaggagatgagagctcagtctcaaatccatctctctgactgactgaaactaggggtttatatagcaaggaagaaatgtaacaatgtgtaagaaagcaagaattagagaggggcaaggaagcaatcatgacaaatgaagcatctggcatcttattgtctggatgtagtgatctggtgagtttcagttctttaatactttttgtgagaggcctgaaggtcatttcctgaggaaggaactcagacaaaaataaatacaagtttcaagctttaagaccagaaggatcaatttttatgtctatcaaaaaagaactatctatgagactattgggtcagtttcaacttcatctataaggatgcatacacactgacaataaagggatggaaaaagatattcaatgccaatggaaaccaaaaaagatgaggagtcactatagttatatcagacaaaatagatttcaaaacagaaactataagaagagacaaagaaggtcattatataatgattaaaggggtcaattcagcaagaggatataacaattgtaaatatatatgcacccaacactggagtgtgttcggaatttattccttccggtaggttcttggtctccctgacttcaggaatgaagccatggaccttcacagtgagtgttacagttcttaaagatggtgtgtccggagtttgttacttcagatgttcagatgtgtctggagtttcttacttctggtgggttcgtggtcttgctgacttcaggagcgaagccatggacttggtggcgagtgttacagctcttaatggtggtgtggacccaaagagtgagcaacagcaagatttattgtgaagagcaaaagaacaaagtgtccacagtatggaaggggacccgaggaggttgccactgctggctcgggtggccagcttttattcccttatttgtccgcacccacatcctgctgactggtacattttacagagtgctgattggtccattttacagggtgctgattggtgtgtttacaatcctttagctagacacatagtgctgactggtgcatttttacagagtgctgatagtgctaattggtgtgtttacaatcctttagctagacacagagtgctgatcggtgcatttttacagagtgctgattggtgtgtttacaatcctttagctagacacagagtgctgattggtgggtttataatcctctagctaggcagaaaagttctccaagtacccacctgacccagaagcccagctggcttcacctctcaggagcacacagatatataaaacaaatattattacagctaaggagagagatagacctcaatacagtaatagctggagacttcaacaccccactttcagcattggacagatcatccagacagaaaatcaacaaagaaacatcagatttaatctgcactatagaccaaatggacctaatagatatttacagcacatttcctccaatggctgcagaatacgtattcttctcttcagcacatggatcattctcaaggatagaccatatgttagacaacaaaaaagccttaaaacattcaaaaaaattgaaatgatatcaaatatcttctctggctaaaatggaataaaaccacaaatcaataacaaaaggaattctaaagaccatacaaacacatggaaattaaacatgtttctgaatgaccagtgggccaatgaagggcctaagaaggaaattgaggccaggcacagtggctcaagcctgtaattctagcactttgggaggccaaggctggtggatcacctgaggtcaggagttcaagaccagactggccaacatggcaaaaccccatctctacttaaaaataaaaaaattagctggccatggtagcatgcacctgtagccccagctacttgagaggctaaggcaggagaattgcttgaacctgggatgcagaggttgcagtgagctgagactgcgccattgcactccagcctgggcaacagagagagactccatctcaaaaaaaaaaaaagaaaaaagaaagaaattgaaaagtttcttgaacaaatgaaaatagaaacacaacatatcaaaacctgtgggatacagcaaaaggttacaggaataagtgcctacaagaaaaaagtagaaaaacctcaaataaacaacctaataatatgtcttatacaactagaaaagcaaaagcaaaccaaactcaaaattattaggaaaaaaaggaaataataaagatcagagcagaaataagtgaaattgaaacaaaaaatacaaaaaaacaaagaaacaaacagttggttttttaaaaagattaacaaaatagacaaactattagtcaaactaagaaaagggagagaagatccaaataacatcagagatgaaaaaggagacattacaactgatgtcagagaaattcaaaagatcgttagaggctactgtgtgcaattatatgccaataaactggaaaacctagaagaaattgataaatccctaaccacatacaacctaccaagattgaaccaagcataaatccaaaacctgatcagactaataacaagtaatgagataaaacctgtaataaaaattctcccagcaaaggaaaatccaggatgtgatgacttcactgctcgattttaccaaacatttaaagaagaactaataccaattctagttaaactataccaaaatatagaggaggaggaaatacttccacatttattctgtgaagccagtattaccccccagacaaagatatcaaaaatagaagactacagaccaatatccctaatgaacattgatggaaaagtcctcagcaaaatactagcaagccacattcaagaacacaataaagattactcatcatgactaagtgggatttatccctgggatgctagaatggctcaacattatgcaaatcaatgaatagggtacattatgtcaacagaataaaggacaaaaaccatatggtcacttcagttgatgctgaaaagcacttgataaaattcaacatcccttcatgattgataaccctaaaaaaaatgggtatagaagtacatacctcaacacaataaaagccacatgacagacccacagctagtatcataatgagtggggaaaaactgaaagtctttcctctaagatcttgaacccaacaaggatacccactttcaccaatgttatttaacatagtgctggaagtcctagctagagcaatcagacaaaagaaagaaagaaagggcactcaaatcagaaaagaagtcacattatccttgtttatagataatatgatcttatatttggaataacctgaatactgcaccaaaaaactattagaactgatacacaaatacaatcaagtcaaggatacaaaatcaacaaataaaaatcagtagcatttctatatgccatcagtgaacaatcagaaaaagacattaagaaagtaattctattaacaattgctacaaataaaataaaatacctaggaataaacttaaccaaagaaataaaagatctctacagtgaaaactataaaacatgatgcaagacattgaagaggacacaaaaaagtgaaaagatattccatgtttatggattggaagaataaatattgttaaaatatccatactacacaaagcaatctatggctataaggcaatccctatcaaaataccaatgacattgtgcacagaaatggaaaaaataatcttaaaatttacatggaaccacaaaagacctagagtagtcaaagccattctgagcaataagaacaaaactggacgaataacattacttgatttcaagttatattacagaactatagtaaccaaaacagcatggtgctggcataaaaacagacacatagaccaatgaaacaaaatagaaaacccagaaataaatccgtacgtctaccatgaacttatttttgacaaaagtgctgagaacatacatgaggaaagaacaatatcttcaataaatgctgccgggagaactggcagcattccatatgcagaagaatgaaatagacccctatgtatcaccatatacaaaagtcaaatgaaagtggattaaagacttaaatctaagacctcaaactatgaaactacaacaagaaaacattggggaaactctccaagacattagtctggacaaagatttcttgagaaatactccacaagcacaggcaaccaaaagtgaacaaattggatcttgtcacattaaaaagcttcttcacagcaaaggaaacaatcaacaaagtgaagagataacccacagaatgggtgaaaatatttgcaaactactcatctgacaatagaataataaccagaatatataaggagctcaaacaactctattggaaaaaaatctaataatctgattttaaaacaggcaaaagatttgaatacacatttctcaaaagaagacataaaaatggtatatgaaaaggtcttcaatatcactgatcatcagataagtgcaaatcaaaactacaatgagatatcatcttacccaagttaaaatggcatttatccaaaagataggcaataacaaatgctggtgaagaattggagaaaatggaatccttgtacactgttggtgggaatgtaagttagtacaaccactatggagaacagtttggaggttcctcagaaaactgaaaatagaactattatatgattcagcaatccctctgctaagtatatactcaaaggaaagaaaatcaatatattgaagagacatctgcactcccatgtttattgcagcacaattatagctaagatttggaagcaacctaagtgttcatcaacaaatgaattgataaggaaaatgtggtagcaaagagataccatctcacaccagtcagaacagtgattattaaaaagtcaagaaacaacagatgctggcgaggatgtggagaaataggaatgcttttacactgttagtgggaatgtaaattactttaacattgtggaatatggtgtggcaattcctcaaagatcgagaagcagaaataccatttgacccagcaatcccattactgggtatatacccaaagcaatctaaattatcctattataaagatacatgcatgtgtatgttcactgcagcactattcacaacagcaaaaacatgaaatcaacccaaatccccatcaatgatacactggtaaagaaaacgtggtacatataaccatggaatactatgcagccataaaaaaggaatgagatcatgtcctttgcagggacatggatggagctggaagccattatcctcagcaaatgaacccaggaacagaaaaccaaacaccacatgctctcacttataagtggtagctgaacaatagaacacatggacacagggagagtaacaacacacactggggcctgcggggggagtggaaggaggcaggaagagcattagaaaaaaatagctaatgcttgcggagcttaataactaggtgatggcttgataggtgcagcaaatcaccatggcacacgtttacctatgtaacaaacctgcacatcctgcacatgtaccctggaacttaaaataaaaataaaaattaaaagaaaatgtagtgcatatgtacaatcaagtactgttcaaccataaaaaagaatgagatcctgtcattttcaacaacatgaatggaactggagatcattatgttaagtgaaataagccaggcacaggaagacaaacttcacacagtctcacttatttgtaggagctaaaatttaaaacaatgaattcatggaggtagagagtagaatgatggctaccagaggctgggaagggtagttgcagggggtggagagaatggggatggttaatgggtacaaaagtatagttagatagaaaaaataagatattgcatttgatatcacaacagggtgactatagtcaacaataatttattctaaattttaaaataacagagtacaattggactttttgtaacacaaagaaagaataaatgctgaggtattaaatactccattaccttgatgtgatgattacttgttgtatgcctgtatcaaaatatctcatataccccctaaatatatgcatctactatgtacccacaaaaaatttaaaatttttaaaaattaaactcttctggctgggcatggtggctcacacttgttatcccagcactgtgggaggccgaggtggtggatcacttgagctcaagagttcaaaaccagcctgggcaacacggtgaaaccctgtctctataataaatacaaaaattagccaaaggggtggcacatgtctgtggtcccagctgctcaaaaggctgaggcagaaggatcgcttgacactggaaggcggaggttgcagtgagccaagatcatgccactacactccagcctgtgtgaaagagtgagattctgtctcaaaaaaaaaattaaactcttctacttgtcaaaaagcaacattaaaaaatacaaaggcaaaccacagaatggaagaaatgttcacaaaacattgtgacaacaaaagacttgtatccagagtatataaacatctcctaaaactctatgcactgttttgagattataaaatggtaatgttttcttgttattatgaatataataaccttgtaataatcacatgtcatattccaatcacaatttaaataaataaaaaaagaaaaagagaataaagaatcccacgctgcagtatctcctctacatcctcccactgcttctactgaagatctaattgggaaacagagtatccacccttccttttccctggagaggcaaagaaaagtattttcaaagactgagaaagtaaatttaacaaacagaaagataaaattactaatatgagggcaagttgacattcctgaaataataaaaaaaagaagaaattggtacatggtacatattgaagacttctttaaataattggaagtaatttgggcaaaatgagaacaatcaaagaagagacgaaagaatatttatggtgaattaacaattattgaaaaccaatagattagctaaattggtgaaattaaaaatgaactgagcatgccatgtacatcaatgtccaaaagcagccattctctgtggggaaaggtgagtgttggctcttcctagagacaagaggtccttcataattaggttcacaggcactaattttagagtataaaatgcagcttgctgattaacacatgaaacagaattccaggctgaattattatttacatttaaaagcacctttttaaacctcttaaattaaaataaatgtatagtttattaaaatattataagatgatcacccctgcaaaccactacccagatcaagaagtataacttgacaaaacacagaagctgtgtctcaatcacaatcgtgtctcctcctctaaaaataaccactctccttatgtttaagcttccttgaaagttacatcactcaaatatatacccctgataatgatagttttggtttgcttgtttttatttttatgtgtcttttgagtcccttttagtctatacgccacacttctttttattttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccgtttaaccctgagtggacacagcacatgtttcagagagcacagggttgggggcaaggtcacagatcaacaggatcccacggcagaggaatttttcttagtgcagaacaaaatgaaaagtctcccatgtctacttctctccacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcggggggccgaccccccaacctccctcccggacagggcggctggccgggcagaggggctcctcacttcccagtaggggcggctggccgggcaggggggctgacctcccccacctccctcccggacggggcggctggccgggcggggggactgacccccccccacctccctcccggacggggcggctggccgggcggggggccgacctccccacctccctcccggacggggcggctggccgggcagaggggctcctcacttcccagtaggggcggccgggcagaggcgcccctcacctcccagacggggtggctggccgggcggagggctgacccccccacctccctcccggacggggtggctggccaggcggggggctgacccccccacctccctcccggacggggtggctggccgggctgaggggctcctcacttcccagtaggggcggccgggcagaggcgcccctcacctcccggacggggcggctggccgggcggggggccgacccccccacctccctcccggatggggtggctggccgggctgaggggctcctcacttctcagtaggggcggccgggcagaggtgcccctcacctcccggacggggcggctggccgggcgggggggctgaccccccccacctccctcccggacggggcggctggccgggcggggggctgacccccccatctccctcccggacggggtggctggccgggctgaggggctcctcacttcccagtaggggcgaccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgctccttgccctcgggccccgcggggcccgtccgctcctccagccgctgcctcccgggcggcgctcgccggcctatacgccacacttcttatcgccctccttgtctgcaatttatttaagaaactgggtgatttaacccgtgaatttttttacagtttggattccaatgattgcataatcaaaaggtagtttaacatgtttcttgattctctgtggtttctttaaagtagttattggtctaagatgcttaaacttttaatacattgactttagacagcttcaactccatttgcaatagctactatgtgacctctgaatttttggtaggcaagaggtaaagcaattgcagcccagaacatcatgtggagccaggaaatgctgctaggagagagggtggctaagctgacagagttgagggcagttttcctggatcagtttagaggccatgtgcaaaacagaaaccttgcagcaggagggaatgacttatcaaagggaagtggtatctggaagtgtctaggaatggacagaagtcagtacttaacacaggttgactgggaaaatgctgggaagtaaatagagaaaggcaagtataccctgggttccttcaaagcagttcaggaaaatattctctaaatgatggtggttacatgcaacgtaaatgagttgatcaggaatgctccaggtccaccagcatgttaaacttttaatggttgagacgttatataatattttctggtaattcaaagtcttagcaaaactttgtggtaaggatatttgtcccatatttcagataactctaagaatgctaggaaaggggaatatgtcaacaagaaatgttacatgtatggctggatgctattttctattttttccctttccttcagtcaagcatgtggcctggtttatgcttccttacctcacagatatttcagaaagcggaagtatcagacagtaatccctatttatgttctcaaaagccaagcccataggagatttattaataaaagatttgtaaataagtaaaaaaggaaaagagagcttttaataggtggctgaaagggttagaaaaaaaaatgaaggaagaaaggaatttctccaatggtctacatacctttcccgcgcaaaatggaggaacagaaaagatcctgggggtctaagacttgggccagaagttctggaagtgccttgaagagtctataatattttaaaaagggatacatgcatggtgtggctagggacttaggggctaggcatggggttcccaaccttaggacatttcctaagcgtgttacggaagcagtctggggatctgaaagaactgtaggagtgggggacagtaaatatcttaccagggactttctctgtgcatgcaacatctgaaacccctctccccaaccaaacctcaatgccttggccctaaataatcctccagagacttgggggtgtggttggggttagagaaagtctcaagcatgagaagtgagaagcttagaagcagcaattaggttgacacatgttctcacttataaccgggagctaaatattgaataacacatgaacacaaagaagggagcaatagataccagagcctacatgagggtagagggtgagtggagggtgagatttgaaaaactaccttttgggtactatgcttattacctaggtggtgaaataagctgtacaccaaaccctgcaacacacagtttacccatgaaacaaatctgcacttgtaccctcaaaacctaaaataaaagttggaaagaaaaaaaagaaagaacaaaattaagttgacttatttttaataggcttttattacacatcagagtttgtgggatgaaatctgtctccattacccaatgcaaaaatcactgggaaaattagtataacaaatgaccgcaaacacttacatagtacttactatgtattaggcgttgttctcagcttctacgtgtattaacacatttgatcttcacactacttactttagagaaagatgtcattattcctgatttaaagaggaggaaattgaagcaggctaacgttaaagaacatgcttaggattacactgcagctgacaagtggcagggtcagcattcagagtccatgtgggtagtcaccactccaagctttctctccaaaaccgctgactcaggcacactttttaggttaaagtaaatcaggacttatgaagtgaaatgtcagttttctaatggaggaaccagatccaaaatataaaaccctctttaagataatttttaagatgagcaggtgccagctgactcctccttcttgataatgcttaggtgctttggaaactcttcctggatgagaaagagattcttgtccctcttcatctgctgcaaaggacaaagccccagaagaataatatgccaaagtcggccttaacatctatcatccctataacctcatctccctggtgctctgaccttcactgggatggtataaagcagaggctctagagtatccctggaaatgaggagcagcgtacactaaccagtttggtttagagtaattctctcctatttgtaatttttatgaaaaacaatttaaatatggccttggactcatgatattttttatgtcacaataaagtggaaatttaaagttacaaatccccaaaaaggtcctccatcaactcctcataggatgtatccatttttagctctgattattgcagttaactttccaaagtgctgggattacaggtgtgagccaccacgccagcatatttactgtgaaagtttaaaatctgatttgaaagctgcttattataagcaatataattttttctttaacggccccagaatgtttaatgttacataatatgaatatatattttcaaatgtaaaaaaaagcctttttatatataaacatgtataaaagaataaatataaataagaaattaattggggtggcaaagtacatttaaaattttgtgatgtttttgtcaaaaacgatttgaacaaatttataggaaaaaaacaaacaaccccatcaaaaagtgggcgaaggatatgaacagccacttctcaaaagaaaacatttatgcaaccaacaaacatatgaaaaaaagctcatcatcactgtcattagagaaatgcaaatcaaaaccacaatgagataccatttcacgccagttagaatggtgatcattaaaaagccatcattctgagcaaactatcgcaaggacagaaaaccagacaccacatgttctcactcataggtgggaattgaacaatgagaacacctggacacagggcagggaacaccacacacccgggcctgtcgtggggtcgggggacgggggagtgatagcattaggagaaatacctaatgtaaatgacgagttaaaggatgcagcaaaccaacacggcacatgtatacatatgtaacaaacctgcatgttgtgcacctgtaccctagaacttaaagtataataataataataataataataataataataataataaggcaggaagcaacagatgctggaaaggatgtgaagaaataggaatgcttttacactgttggtgggagtgtaaattagatcaaccattgtggaagacagtatggcgattcctcaaggttccagaaccagaaataacatttgactcagcaatcctattactgggtatatacccaaaggattttaaattattctactctaaagacacatggacatgtatgtttattgcagcactattcacaatagcaaagacttggaaccaacccaaatgcccatcagtgatagactggataaagaaaatgtggcacatatacatcatggaatactatgcagccataaaaaaggatgagttcatgtcctttgcagggacatggatgagttggaaaccatattctcaacaaactaacacaggaacagaaaaccaaacaccacatgctctcactcacgagtgggagttgaacaatgagaacacatgggcacagggccgggaacatgacacaccagggcctgttggggggtggagggctaggggagggatggcattaggagaagtacctaatgtagatgattggttgttgggtgcagcaaaccaccatggcacatgtatacctatgtagcaaacctgcaagttctgcacatgtatcccagaacttaaagtataatttaaaaaaaaacagtttgaaaacttccctgaagtaaaaaaagtatcctttgaggaacaatgtaacgatgagctcaagttccacaggaaagagaaaattaaaatttataaagaatttataaatatcaaactattttcatgttttccaggaaaagtgtggctttctcattcattaaccaatagcataatattttccaggaaccttcactcagaagaaatgctgtggcccttccctttaccaacagaaaatggaacacaagagaccacatagctgaacaaattatagcctccttacaagtgagaaaccttcgaggctacatagttttcagccaaaggaaaataaccaacagcttctccacagtgtagactgaaacaagggaaacatgaacatcacaaactgtaccacagaggccagcatggctataagacccaagaccatcactgagaagatgctcatttgcatgactctggtggtcatcaccaccctcaccacgttgctgaacttggctgtgatcatggctattggcaccaccaagaagctccaccagcctgccaactacctaatctgttctctggccgtgacggacctcctggtggcagtgctcgtcatgcccctgagcatcatctacattgtcatggatcgctggaagcttgggtacttcctctgtgaggtgtggctgagtgtggacatgacctgctgcacctgctccatcctccacctctgtgtcattgccctggacaggtactgggccatcaccaatgctattgaatacgccaggaagaggacggccaagagggccgcgctgatgatccttaccgtctggaccatctccattttcatctccatgccccctctgttctggagaagccaccgccgcctaagccctccccctagtcagtgcaccatccagcacgaccatgttatctacaccatttactccacgctgggtgcgttttatatccccttgactttgatactgattctctattaccggatttaccacgcggccaagagcctttaccagaaaaggggatcaagtcggcacttaagcaacagaagcacagatagccagaattcttttgcaagttgtaaacttacacagactttctgtgtgtctgacttctccacctcagaccctaccacagagtttgaaaagttccatgcctccatcaggatcccccccttcgacaatgatctagatcacccaggagaacgtcagcagatctctagcaccagggaacggaaggcagcacgcatcctggggctgattctgggtgcattcattttatcctggctgccatttttcatcaaagagttgattgtgggtctgagcatctacaccgtgtcctcggaagtggccgactttctgacgtggctcggttatgtgaattctctgatcaaccctctgctctatacgagttttaatgaagactttaagctggcttttaaaaagctcattagatgccgagagcatacttagactgtaaaaagctaaaaggcacgactttttccagagcctcatgagtggatgggggtaaggggtgcaacttattaattcttgaacatacttggttcaggagagtttgtaagtatgtgtggtcttgtttccttgtttgtttgtttgttttgttctgttttgtttgaggattgttatttggcgtgctgttttctacctctggtcttatctgtgatacataatttcaaataaacattatcatacaaaaacagaaattttgtagaagtaataataagatgaaatactaaataccttttatgggttttttttttttagccatttcagttaccctgcaattaaagaatgccaaaaatatctttatttgcagaatttcttattacttataaattaaatacctgataatgccctccatggcattaaatctgagattatggctctatctgcgtacatattccagtgggaattgcatgactacataaagaattaaaagaaagtgatgtgctgtcatctactgcttgcagacctgagctaaagtcgtttgctgtagcactgtgactacatagcctattcatttcaggtaaaaatagtacagctggcttgtcctttttagttcatgattaaataaacttcctctttttctaaaatggaaatacctggaataaatgcactggcacttttctatgtcttttactatgaatataaaacataaagcaaataacaagtcatctaaatctactttggtcagtgtgttgcaatattacctgacagacacattgggcctcctccaattctaaaatctatcccagctaagccacccatatacactttcactgtagcaggacaaaggtaggagtacatgtcaaatttgggaaactttttaagaagcttaatgaggtgcagtgatcaaatgacagaatatattatctgaagaacttcattggagactattactcattaaattaccagttgcagccgggcgtggtggctcacgcctgtaatcccagcacttcgggaggccaaggcaggtgcatcacctgaggtcaggagttcgagaccaagctggccaacatggtgaagccccatttctgctaaaagggcaaaaattagccaggcatggtggcacgtgcctgtaatcccagctactcaggaggctgaggcaggaaaatgacttgaacctgggaggcagaggttgcactgagaagagatcatgccactgcactccagcctaggcaacagaatgagaccctgtctcaaaaaaaaaaaaaaaattaccagttgtgctcttggggaaaaaaagtaaaagttgaaaaactgtgtttacaccaaaggccactcatcaggatatgagaatgaaattgcgtctcccagaatccctgtggcttctgtgccagactgtaccctggggccaggaggctgcaggtgggacctgaagccctgggtgtggcctgagaaggagtgattgctctagtcacatggaggagtacaccattacaaaatcaagagtgatggtaggaggactgaaagtttgtacattcttgcatactcctaagtaggtgaccgttctcaacctctgctcctagtctgtcatccacagcctctccccatctcttcactcttctttgtagggagaagacattgatttgcctcctttccacctccgtgtttttagtccttcaatctaacccctctcaacgtttctagaatcttgcttcttacacccaacctccctctgcaacttcctttctccctccccatcccaacacttttcctcctcattcctctttaatctcacctattactttgctcaagtcccttggacacaaaaatcaacttcctctggccctacttccccatcaagctcctacttcatctctcccttaactcccttacctgggtttctccaatcattaatccactcattctgcctccacttttcaccttccactgacttttctatccttttccatctgagtatgccctagttctccccaaacttatctcccaaaggtcattggagacttgcccatagtccttctctgcatctctacctgtcattttctcatgagttacaacagctaaccatccctttcatgtttaagcccataccttccaggatattttgctctcctggttctccaactaactcctcatctattctttgtctcctttccttcctcctgaggttttgtcctcagcaatcacctcctatatctccatattccatcccaacttcggccatttcaacaattagtttcatgcctgtggctcctaaatttgtgactttagtcctgatctttctctttctcaaactgcagacccatgagttacatctggtgagcctctccctatgaatatttctttagtacctcaaacacagcctttctatactgaactcaagataattttcccacactcaagccttctcctctttctaccttctcagtctcagataacagaattaccatgctttttatcattcctattagatgaatgtaattctctctctttgcctcaggtctccaacatccagatagtcctgaagtcttgtccatttacctcacagaaacatgtgtttaggccacttgctctccaataagttggtcctctcccctagatcaaatgttatttgatccacctgcctctggattctcccacctgcaactcggcccccacacatctcccagtgtgagtttctcactgaggcatctccagactagcagcattagcagcacctgagaatttgttagaaatgcaaagtcaagggccccattcaagacctactgaatcaaaaactaagagtggagcccattaatctctgttttaagaagccatccaggagattctgatacaagctaaagtttgagtcactattttagagcatacagtagatttttaattgcattgttcaaaatcctttactctttccctatcaatataaaataaattaatagtccatagtatagcattcaaggcctcttactttgtggccccaaactatctttgcagagttatatctcaccacttcttttcacctacttcatgctccagaaaaatgtgagtattacctgtgctttctaaactcccctaacatttgatcccattgcttcagaaacctggcctccatggcttcacatctttcttccaccaaatcttcatatgcagctcaaatgcagtctcttctaaaaagtcttcctgagatacttcttccttccctgtccctatggaagtcttctctcccagctctatgctcccatataacttcacttgtatctctaatactatatgcatcctatcttctagtgcatttgtttgtgtatttgtgctgtcttccctagtagattgtgagctccttgagggcagggactgtgtctgtttcctctctgtatctctagggactcataccatgttttacacacagtcggcactcagtgtctgttaatgtgaatggaattaagtccctggaggagaaaatataaatgtgtcatcttttctcagtgagaaaacaaaacttccaaagtccatgatgcaatactgacctttttttttttccaaatcttaccctgacattccaggtttgtttcgaaaaattctgggaaaaacttatgtatggaaagaaaataaatttctcattgaatataagtgaatattctttattaattaggattccagataagctgttctcaaaagagggaaaggaaaaaggagagattcgatacaaggagacaaagaataatctctgccacaaggggatattggtttctgtatgagcaactcaaatattactgggaaagtcacatggctgcccagctaagggtgatctgtgtacaaggatgttggcatctaaattacaggtgattttaccaagattgtgcctatgctcaaaattcagtatttattatgactgcaatatctagaaagtatatgagccactcacactgctttcccatcatcctccagatgttatctttgaaaattcttggcaattataagagttttaaagttttaagagtctaagtaaataaaaagcaaaaagcagatacataataatttttacttgcttattttcattaactcatttcctaatcactaggtaaatcctaattaaatacatttatctcacagctgcctctgcccttagcaaagaagttgcatatatttcctggtataaaccaaacctgttgaaaaataatctattgtttgctttgcttattgagccaatagtgccagctgccactgactactattgtcccctttaaactaaaacttgaatgaagtaatagtaccttttaataagatcagtgtttctcatgcaaacattagtatgctaaaagtaaaccctagggatggcattttgattgcctccattagaaattaggacttcttagctttctattcttggtgaaagaattcttgaatataagtcactccctggtagagctgacaggtcctttagttacaacaggtggcagtaagaacccccatcagcattgctaccatggtctgctttgggtaacactacaggcctcctatactttcggacttcagttttcaaactctgataattacgtatgaggtaagttcctaaacaagttccagcaattgcactggcttccagcacaacgcattttagcttcaaccatcacactggtcttggtctactaatgtgtgtgtgt

SEQ ID NO: 1970 - DNA, 3392 bp, Homo sapiens
gttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaaccctggtaaatgacagtgggaaataacacccgaaaggcaaggacgggcagattggggagggaaaggatgttgggctaagggctgtgagcttatgttacaggcaactgagccactgaagaattttgacgaagaaaatgccaaccaaagcagtcattttaaaagtttatggctgttcagttacaggacaagttgtgaaaagaaagaaaaaaaatggaaaaaaaaaaagtttatggctgaaacagtgtaattgattaaaaagtgaaaatccaggccgggcgcggtggctcacgcctgtaattccaacactttgggaggctgaggcaggcagatcacctgaggtcgggagttcgagaccagcctgaccaatatggagaaaccccgtctctactaaaaatacaaaagccaggcgtggtgggacatgcctgtaatcccagctactcgggaggctgaggcaggagaatcgcttgaacctaggaggcagaggttgcagtgagcagagattgtgccattgcactccagcctgggcaaaaagagcgaaactttgtctcaaaaaaaaaaaaaaaaagtgaaaatccaggagttagtatgtctgcttccaaaaagattagatagatacattttttcctctcagtaagtacagctaaactccttggtcacataaacaaacacaagactctgaaaggtagagataagacggaagactatccctggaccttgggatctgaggaaggactctggtagttattccgtggcttttctttttgtctcaaggttgagtgctggcttcggaaggccaaggcgggcggatcaggaggtcaggagtttgagaccagcccgaccaacatggtgaaaccccgcctctactaaaaatacaaaaattagccgggtgtggtggcatgcggctgtaatcccagctactcaggaggctgaggcaggagaatcgcttgaacccgggaggcggaggttgcagtgagccaagatcatgccactgcatgggtgacagagcaagactctgtctcaaaaaaaaaaaaaaaaaaagatatgagtgctggagaagccaaccaatgggcacagacaagaaagcctgctctctctacctgcgttagtttcctagacctgccctagctagttaccacaactttggtggcttaaatgacagaaacttattctctcccagttccggaggccagaagtctgaaataaaggtgtgaacaggatcacacctcttctgaaggctctagggaggttctatccctggtggcgtccagcttctgttggctttaggcaatccttggcttgtgactgcatctctgcccctgggtcatattgctgccgctttctctgtcacatctctgctgtgtatctcttacaagaatacttgccattggatttagagccaatttgaaaaatccagggtaagcactttgtctcaagatgtttcatgtaatcacagtttgccatatgaggtaatgttcacaggctctggagattatgatgtggacatcttcttgggggccaccattcagcccactacagtccaccctctggcaccccaaaatccatatttgtcctacatgaaaaagacatttattcctcccaacatctcccaaagtctcaactcatacagcatgaactaagaccaaatttgcatctatatattagctcagaagtcctgcatctcatcatctaagtcagatgtgggtgagaccccgtgcatgattcattttaggattaaatttctctggctgtggacctgtgatactacaggttatcagcttccaaataactttggaatttggataaataaatttatttaaaatgatgtaataggcatatgatagatgttctcattctgaaagggaaaattggaagggataaagaagtcaccattcccaaccaattttgatctagcagagaaaattccattaggattcaaggcctgcaaataattccctagcttgaagtgccgcccactgggcccacaacagttgtgcagacctttgtgtctgctcacagcagaaccatgggcctctctgtacccatggtggctccataggcctctgagtctgtgctcacagtgacctcataggcctgtgtctctgcatccatcacttctgtctgctcctctggcctctgcctctgtgcccctggctctgcccttggagtcattcttgctttttcttgaaggatcgcatgtttgcagcccagtagctctatcagcccatttcttgcccgtagcagtttggatttcaacagccttttctcatttcacactgtctctgtcacttccaggctaagctgtctctgctgatgtaacattctcaaaaatcttgtgggtcccctgtgtaatgtcatggagttcaatgccattagacaagagggtcctccacaaattttctgggataatcccatctctattcctgacttctactgagatggttgaatgagtccaagagtcccatgcttcatctcttcgtgccaccacacccagtacatttttcttatttttgtaaaagagatggggtctcgccatgttgcccagtctggtcttgaactcctgggctcgatcctcctgcctccacctcccagagtgctgggattacaggtggccgtgtttgacacttcagcaaaactgcaatttaagttattaactttattgagtacttacgtggaaacaaaaattaagtcccttctcccgtggagctggcattgcacattggtgggaggaggagtgagcagggagtgcataatgtgcaaccacgtgtgaatatttccagtccttcttagtactgtgaaggaaacacacaagtaaaaacctgggcctggtccaggaacgtgacaagggtgtgactgccaggctgggacctgaatgatgagaagaaggcagccaggg

SEQ ID NO: 1971 - DNA, 69345 bp, Homo sapiens
ttctatctgtatctgaaaagcaatcaaccaccacaatcgatagccatgaaaacaatcttctctcttccagtctcctcctcatctcctgccatctctcctcaccctcaccacccaagcttcctgagtgcattctcttcacccccggctggcctccagcttccctctccacctaggggcactgggttctgggttctcttttcacccacgtgttcttctttcctgaaatcacccagttctgtggcttcagctaacacttctacctctccctctttagacctcactctcagggttcaagactacttctttaaaaaagttttcatttattaaaaaatatataatacatacacttggttcaaaattcgaaagggtgcggtagctcacacctgtaattccagcactttgggaggtcaaggcaggaggattgtttgaggccaggagtttgggaccagcctagacaacataatgagaccccatctctacaaaaaatgcaattagccaggcatggtggcgtgtgcctgtggtcttagctattcaggaggcctcccaaagtgctggggttacaggcatgagccactgtgccctgccagtctttctaaaatacaaaacaaatcatctcacttccttttctaagaaccttctgtggctccccattgcctacagataaagtcgagctccttattggagtagaaaggcccttgcccgctgctctttgcttgatgccaccgctgtgtctccatcgccgtcacatacgtttgtccctgtagtgctgtttccatcaaacggcattcctggattctgccagaatccttttgaggcccttgtcccatatatcagtaggagtctcaactgggaccaaaagcacattccagtaatgtaactgcccaaggggttcaccttgcttgctgcctagacagagccgattcatcaagacagcagaattgcgatagagaaagaataattcacacagagccagctatgcaggggaccagagttttattatcactcgaatcagtctcctcgagcatttgggggcagagtttttgaggataacttggtaggtcgcgggggaagccagtgagctgggagtgctgattgatcagggatgaaatcatcgggagtcggagctgtcttcttgcgttcagttggttcctgggtgggggcagcaagatcggatgaaccagtttattgatctgggcagtgccagctgatccatcaagtgcaaggtctgcaaaatatctcaagcactgattttaggagcagtttagggagggtcagaatcttgtagcctccagctgcatgactcctaaatcataatttctcatcttgtggctaacgttagtcctacaaaggcaatctagtccccaggtaagaaggaggtctgctttgggaaagggctgttacgatctttgtttaaactataaactataaactataaactaagtgtctcccaaagttagctcagcctacacccaggaatgaacacggacagcttggaggttagaagcaagatggaatcagttaagttagatctctttcactgtctcagtcataattttgcaaaggcggtttcagtaagatttatttacaaagaggggggtttatttataaagggagtaattataaagctgtgacaggcctaagggagccatcagggactttccaagccctgggcaagcaggtctgttgccacccctgggtttatgggttgaggagagggagagctcaccagggtctggagagagtcatgtggagctggcttccttctgaggaacagttggtcttttgtgaaggacatagctgtccccaaacaacctcaatgggagaacacccggacctcactgccctcctccctctagtcttctgttgagccccctcatctgccaaatccaatgggaatccagagggcaacagagtcctggtgatggggtccctgcaggttgacctcccaggccacagagctgagcggcaatgggtagaaagtggatttggggatggggcagaaggcagaggagcacattccacatcactttatatgtgtgtgcccttcccttttctagaatctactccttttgtatatctggcaaatccttccttccttccttccttccttcctcctttgctttcctttcctttcctttcctttcctttcctttcctttcctttcctttcctttttttcttcctttcttccttttcttcgaagtcttgctctgtgacccaggctggagtgcagtggtgcgatctcagctactttttgtatttttaatagagatagggtttcaccatgtcagccaggctggtctcaaactcctgatctcaagtgatccacctgcctcagcctcccaaagtgctgggattacaggtgtgagccacctcgcccagctgggcaaattatttcctgttcttcaagattcagtcaaacatcaccacattccctgattcccttgggcagaattaacgaaaattttccataccactttgtccttgtttatttacttatttatttatttttaagagacagggtctttctctgtggcccaggctggagtgcaatggcgtgatcatagctcactgaagcctcaaccttttgggctgaagtgatcccccaccctcagcctcctgagtagctgggactacaggcatgtgccaacatgcctgactaatttttaacgtgtgtgtgtgtatatatatatatatatatatatatatatatatatatatatatatgtttttaacgtgtgtatacatatatatatatacacacacgttaaaaattatatatatattatacataatttatatatatatttaacatctatattttttatagagacggggtcctatattctcattgttcagcagagggctgacatgcaaaaaaacccaaaacaccaagtgtcaaattacttgattcatactcttttccccttccccagggtgtcctcaagaggatagtgacattgccttcttgattgatggctctggtagcatcatcccacatgactttcggcggatgaaggagtttgtctcaactgtgatggagcaattaaaaaagtccaaaaccttggtgagggcccaggggtaggttagggaagagcccacacggggctggaagatacatggcaaccgggccaccatgttctcctcccagttcaactgcagacattgccaaattgacgatcgattatggtttgccttcctgagtctcttttctgctctgttggatgcagcctcagcattctttcagccttttataaagcgggcagctctaattgttaaggttggcatgggagatgaagcccacgtgtcattgctggctgagttctattttcatttttatttcttatttttttgagacagaatctcactctttctctcaggctggagtgcagtggtgtgatcttggctcactgcaacctccgcctcccgggttcaagcaattctcttgcctcagcctcccgagtagcggggattacaggcgcatgccaccatgcctggctagtttttgtatttttagtagagacggggtttcaccattttggccaggctggtctcaaactcctgacctcaggtgatccacccgcctcggcttcccaaagtgctgggattacaggtgtgagccactgctcccggccgctggccgtgttctagtattgaggagagatgggagctgctggcagctctccgtcctggtgaggcaggggattaggggcagcacagaggaggaatttggagagtggagtgtttaagatcttcgtggagcttgctgggagatgtctgaggggtgggggcaccttctccagcatcacaccagccgccccctccgcagttctctttgatgcagtactctgaagaattccggattcactttaccttcaaagagttccagaacaaccctaacccaagatcactggtgaagccaataacgcagctgcttgggcggacacacacggccacgggcatccgcaaagtggtgtaagcttccccttttcccttaggatggagggaggaggagacacttttagctgggctttgatggatgaagggagccgttcagacaggggtggtagaggatgcttccccaccggcagaggtggggaggctgtgcgtggtgtgttcatcaaaggacaagttgtgagtgaaaggtgggagtggagtggggaagtgagggaaaggtgtctggagggaagctacaaagatcagctcaggccagggagccaaaggcagctttacagcctgtggtgagatatcgccatgtctcattttgggaagttcactctgattttgaggtgggtgtagaggcaaggatggggttgggacagaagtacaagaagcactggagagtcctagaggggctggggagctggtgcagtgctctgggagaggtttcctgaaggccaattaactatatatatatatatatatatatatatatatatatatatattttttttttttttttttttttttttttttttttttttgagacagagtctcactctgtcacccaggctggaatgcagtggcctgatctcggctcactgcaacctccacctcctgggttcaagcaattctcctgcctcagcctcctgagtagctgggattacatgcgtccatcaccaccatcagctaatttttgtatttttagtagagacagggtttcaccatgttgaccaggctggtcttgaactcctgacctcaggtgattcacctgacttggcttcccatagtgctgggattacaagtgtcagccataaatatatatatttttaaaattcaaaagtaataatactcagttaaaaaacccaaattatgcgaaagtataaaaacaaaaaccgtgaaggcttcctttcccttccctgctgcttttccaggtctcggggcagttgcatctcagtgctaagtctcaggggagacggagcccctccgagacctcgcctagctgtatctgtgtctgggactctgctgacatttcctttctgacgttaatagcatctctggctaggtgcagggtctcataccagtaatgtcagcactttaggaggccgaggtgggaggatcacttgaggccaggagtttgagaccaattgacaacatagtgagactctatctctaaaaagataaaaaaataaaccaagtgtggtggtacatgcctgtagtcccaggtactcaggaggctgaggcaggagaatcacttgagcccaggagttcaagtctgcagtgagctatgattgtgtctctgcactccagcctggataacagagtgagtgtctatttcttaaaaaaaaaaaaaaactagtgtgtcatctacttgcatttgactttgtccctcctgtttcctgcacagacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtagggaatgcagctctcaggttgatgcttctgtggagggtttctatgtggatccatcctcccttcaatttgcaaatattattaaaatcaaagtgacatgagagctaatgctagctcatatacaccgtatcagctatctgttgccacatcaatgctgtgtaataaactatcccaaaattcagcagcttaaaataataagtaagcctgtgggtcagcctgccaagagttctggtctcaatggccttcctcactgtcattagctacaggttggcaggctgctctgctgatcttggccaggctctctctgtttctgagggttgccagctatgtcatctgctggaccagatggccttgggtggaaccactggggtgacttggccctttggcaacctggctctcattctccagggctagcctgggcatgtcctcatggtgaaggcaggggagcaagagaacagtggagatgttgcaagtgcttttttacgcctctgcatcatgtttgataacatccatgggtgtcacgagcagtgcaaggttagcgataaccaggtccatgcaggtttgtgtttttccacaacatctttcgctgatgctatttcaatcacaaacgccacaagctgcatggaattcccaaggaggcagttcttcttagtgcatcctgttccctcagacactctggctcaagccacccacaagtcagtcaatattgcaaaccatatataatagtatacttaatcaatatataagttataggttaaacattccacagcaaacaaagtaacatttaacatcagaagaaaaagaaagaggagaaaggatgaatgaaaaggactcctggtctgggcccaagggtcctggtcctgttagtcttgcaaggcagagtctttgatacggcagagccctcggcagcaaatgccaggctctcatcatgagcgactgcgaggtgtgagttccaacagctgctttgagctgctgaaggcctgatctcttctagtcacagagctgtctggtgagaacagacagagaagaatgtgcttgtttgcatccttatctggttggatgtagtctttatttgtttattttatttatttatatttatttatttatttattttgagactgagtcttgctctatcgctcaggctggagtgcagtggcatgatcttggctcactgcaacctccacctcctgggttcaagcagttcttgtgcctcagcctcctgagtagctgggactacaggcatgcaccaccatgcctggctaatttttgttttgtattgttagtagagatggggtttcaccatgttggccaggttggtcttgaactcctgatctcaagtgatctgcccgccttggccttccaaagtgtgggattataggcatgagccactgcacctggcctatttaaaaaatttgtttaaaacgaccttatccttgttggcaaagtgccctgtgaaatatagaatggagcctttttctaagatggagtcagttatgtcaagggtgctctgtatacaatgggctaaagcaagactcatgtctgagcccagaggcaatgaagggggcagatgactccaccaagagcaggagggcacagcagagtgctgggggaaagggcttggatacaggaagaggcaaggagtcaggatcatcagtgtaatcaaactactacagcacctgcatgacacagaaagcgatatcaccatggatacatgccttggcacgtaggacataccttcatataaagaaaaaggctccccttcctctagggggaggtcagctccataccaggagacgtggcacagcagatggatcagcagccgggtttctgccccaacttgcttccttggcacagtgccttgtgcagtgtacaacctgcccaactatacctggcaaccctgtcccagggaccttctgatgcatttcctcacttgataaataatggttcagactagtttcctgcagaattgtctttgccagatgatattgctagcctcacaccatgatttagcctctgttccttggtaacaggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtgagtcaggcatctgtgttcccagagcagctccagaggcagccccccaccccagaacatagtcccctctagaatccagaccttcctaacccttggtatcccccagcatcaactctctccacttcctacagctcccagtcccagcctcacttggtcaattcctttgaagtcaaagaatccatacttttatctgtaattttgcaaatcttggctataggctggtaaattggagtatgggggagtcaaatcccacccagtattttaacaaaaatttggatgtgttgccagctgtcgtctgttcggttctctgttgtatcccaattgcctagaatagtgcctggtactcagaaggtgctcaataaatgtttgttgaataaaaggaatttagaaattgggggatttcataaacagtctgggtttatggcttatcttgaaaagctggaagattagacaccttgaagaccgcattcccacttggcaggatgttgctggaggtgaatggctgccatccttctaagagggacgtatgctgtccagcttgacacagatcctgtcggagtctcctttgtctgtggccaccagagcacttgggttttcagtacctgttctaggttcttctgctttcttttcttttctttctatttttttttgagactgagtcttgctctattgcccaggctggagtgcagtggtgcgatcttggctcactgcaacctctgcctcccaggttcaagtgattctcctgcctcagcctcctgagtagctgggattacaggcgcataccaccacgcccagctaatttttgtatttttagtagagacggggtttcaccatgttcaccagactggtctctaactcctgacctcaagtgatctgcccatctcaggctctcaaaatgttgggattacaggcgtgagccaccatgcccggccttctgctttctttaatatagaaacttctcctctttacaggtactcagacaggaagtagcagctcctttgagcatgagatgtctcaggaaggcttcagcgctgccatcacctctgtaagtggcccttcattaaattgcgggggtggggcagggggtagcaagaagagataggagagatgtgggggtttggggactcttctctgtgatagatacttgggaagtagctctgtgaggggcagcggttgtcccttcttccttcctcatcaaccctgttctacacctttcccagaatggccccttgctgagcactgtggggagctatgactgggctggtggagtctttctatatacatcaaaggagaaaagcaccttcatcaacatgaccagagtggattcagacatgaatgatgcttacttgggtaagtggggagggcaagggttactctaagaaggggtgaggatttggcataagtcaactagcatagatgtctgggtcttgaatgaatgggatacatatgtatgggatactagctattagtctcttgggatagctttaaagacagaaacttcaatttttttttttgaggtggagtttctttcttgtcgcccgggctgtagtgcaatggcactcggctcactacaacctctgcctcctgcgctcaagcgattctcctacctcagtctcctgagtagctggtattacaagaatgcaccaccacccctggctaatttttttttttttttcgaaatggggtttcgctcttgttgcccaggctggagtgcaatggcgtgatcttggctcaccacaacctccgcctcccaggttcaagcgattctcctgccttagcctcctgagtagctggaattacaggcatgtgccaccatgcccagctaattttgtatttttagtagagatgggatttctccatgtcggtcaggctggtcgcgaactcccaacctcaggtgatccacctgcctcggcctcccaaagtgctggaattacagacgtgagccaccgtgcctggtctttttttgtattttcagtagagaccgggtttcaccatgttggccaggctcgtctggaactcctgacctcaggtgatccgcctgtctcggactcccaaagtgctgggattataggtgtgagccaccgcacccggccagaaacttctaaattgaattgtaattatgttcataaagagaaatatagcgtagggatcagttaccccaacacagcaagcgtggggctgccccagtgcccctactcaaggggtgggtctgcatggtggaggagggggcagggaatgcacttcacctctcagacccccaccttcaggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccaggtgagtgcggtttgtggagcatgaatgtgcaaacagaggcgccctggggtcttagagattccaggaggggcattcagatgacatgcatggccctcttgtaaaggaggctttgggggctgtgagctggggagttgtgggatcagcttagcatttgtgaatgctgtgtcctcagcttttttaacaatgataaataacaatgcttgcctgtacagagctctctatgggtctttctgtactcagggctggtattcaacccgtatataaccaggatagccatgttagttaataaaatattgaaacaattccgtattcattgataaatggtggattccccctcacccatgcactctggtgcttccccagtctctgtgggcttccccatgatccagcaactatgaggtcaggcaggacacttcacacaccctctaggatctgctccagccatgcccctgctcagtacctgtgcagctccagctgttcattattttgaatatcacccctgcaaaagcagcatggtcacatattatgtgggaactagcgagtgaggcaaaactctctagtcaaaatcattcttgcaaattcctgaaataggactgcacccatgatatggtgcctatagttctttattttatttttattttattatactttaagttctagggtacatgtgcacaacatgcaggtttgttacatatgtatacatgtgccatgttggtgtgttgcacccattagctcgtcatttacattaggtatatctgctaatgctatcccttccctctccctccaccctacgacgggccctggtgtgtgatgttccctacctggtgtccaagtgttctcattgttcaattcccacctatgagtgagaacatgcagtgtttggttttctgtgcttgcaacagtttgctcagaatgatggtttccagcttcatccatgtccctacaaaggacatgaactcatccttttttatggctgcatagtattccatggtgtatatgtgccacattttcttaatccagtctatcgttgatggacatttgggttggttccaagtctttgctattgtgaatagtgccacaataaacatatgtgtgcgtgtgcctttatagcagcatgatttataattctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacgtgttgtttcctgactttttaatgatcaccattctaactggtgtgagatagtatctcactgtgattttgatttgcatttctctgatggccagtgatgatgagcattttttcatgtgtctgttggctgcataaatgtcttcttttgagaagtgtctgttcatatcccttgcccagtttttgatggggttgtttgattttttcttgtaaatttgtttaagttctttgtagattctggatattagccatttgtcagatgggtagattgtaaaaattttctcccattctgtaggtggcctgttcactctgatggtagtttcttttgctgtgcagaagctctttagtttaattagatcccatttgtcaatattggcttttgttgccattgcttttggtgttttagtcatgaagtccctgaccatgcctatgtcctgagtggtattgcctaggtttccttctagggtttttatggttttaggtctaacatttaagtctttaatccatcttgaattaatttttgtataaggtgtaaggaagggatccagtttcagctttctacatatggctagccagttttcccagcaccattattaaatagggaatcctttccccatttcttgttttttcaggtttgtcaaagatcagatggttgtagatgtgtggtattatttctgagggccctgttctgttccattggtctatatttctgttttggtaccagtaccatgctgttttggttactgtagtcttgtaatatagtttgaagtcaggtagcgtgatgcctccagctttgttcttttggcttaggattgacttggcaatgtgggctcttttttggttccacatgaactttaacgtagctttttccaattctgtgaagaaagtcattggtagcttgatggggaaggcattgaatctatgaattatgttgggcagtatggccattttcacgatattgattcttcctatccatgagcatggaatgttcttcaatttgtttgtgtcctcttttatttcattgagcagtggtttgtagttctccttgaagaggtccttcacatcccttgtaagttggattcctaggtattttattctctttgaagcaattgtgaatgggagttcactcatgatttagctctctgtttgtctgttattggtgtataggaatgcttgtgatttttgcacactgattttatatcctgagactttgctgaagttgcttatcagcttaaggacgttttgggttgagacaatggggttttctaaatatacaatcatgtcgtctgcaaacagggacaatatgaataccctttatttctttctcctgcctgattgccctggccagaacttccaacactatgttgaataggagtggtgagagagggcatctctgtcatgtgccagttttcaaagggaatgcttccagtttttgcccattcagtatgatattggctgcgggtttgtcataaatagctcttcttagtttgagatacgtcccatcaatacctagtttatttagagttttcagcatgaagggctgttgaattttgttaaaggccttttctgcatctattgagataatcacgtggtttttgtctttggttctgtttatatgatggattatgtttattgatttgcatatgttgatccagccttgcatcccagggatgaagcccacttgatcatggtggataagctttttgatgtgctgctggattcagtttgtcagtattttattgaggatttctgcgttgatgttcatcagggatattggtctaaaattctcttttttttgttgtgtctcttccaggctttggtatcaggacgatgctggcctcaaaaaatgagttagggaggattccctgtttttctattgactggaatagtttcagaaggaatggtaccatctcctccttgtacctctggtagaattcagctgtgaatccgtctggtcctggactttttttggttggtaggctattaattattgcctcaatttcagagcctgctattggtctattcagagattcaacttcttcctggtttagtcttgggagggtgtatgtgtccaggaacttatccatttcttctagattttctagtttatttgtgtagaggtgtttatagtattctctgatggtagtttgtatttctgtgggattggtggtgatatcccctttctcattttgtattgcgtctatttgattcttctctcttttcttctttattagtcttgctagcggtctatcagttttgttgatcttttcagaaaaccagctcctggattcattgattttttgaagggttttttgtgtctctatttccttcagttctgctctgatcttagttatttcttgccatctgctagcttttgaatgtgtttgctcttgcttctctagttcttttaattgtgattttaaggtgtcaattttagatctttcctgctttctcttgtgggcatttagtgctataaatttccctctacacactgctttaaatgtgtctcaggattctggtatgttgtgtctttgttctcattggtttcaaagaacatctttatttctgccttcattttgttatgtatccagtagtcattcaggagcaggttgttcagtttccatgtagttgagcggttttgagtgagtttcttaatcctgagttctagtttgattgcactgtggtccgagagacagtttgttataatttctgttcttttacatttgctgaggagtgctttacttccaactatgtggtcaattttgtaataggtgtggtgtggtgttgaaaagaatgtatattctgttgatttggggtggagagttttgtagatgtctattaggtccgcttggtgcagagctgagttcaattcctggatatccttgttaactttctgtctcgttgatctgtctaatgttgacagtggggtgttaaagtctcccattattattgtgtgggagtctaagtctctgtgtaggtcactaagcacttgctttatgaatctgggtgctcctgtactgggtgcatatatacttaggattgttggctcttcttgttgaatttatcggtttaccattatgtaatggccttctttgtctctttgatctttgttggtttaaagactgtttcatcagagactaggattgcaacccctggttttttctgttttccatttgcttggtagatcttcctccatccctttattttgagcctatgtgtgtctctgcacgtgagatgggtttcctgaatacagcacactgatgggtcttgactctttatccaatttgccagtctgtgccttttaattggagcattgagcccatttacatttaaggttagtattgttatgtgtgaattagatcctgtcattatgatgttagctggttattttgctcgttagttgatgcagtttcttcctagcatcggtggtctttacaatttggtatgtttttgcagtggctggcactggtttttcctttccatgtttagtgcttccttcaggagctcttttagggcaggcctggtggtgacaaaatctctcagcatttgcttgtctgtaaagtattttatttctccttcacttatgaagcttagtttggctggatatgaagttctgggttgaaaattcttttctctaagaatgttgaatattggcccccactctcttctggcttgtagggtttctgctgagagatcagctgctagtctgatgggcttccctttgtgggtaacctgacctttctctctggctgcccttaacattttttcctccatttcaactttggtgaatctgacaattatgtgtcttggagttgctcttcttgaggagtatctttgtggtgttctctgtatttcctgaatttgaatgttggcctgccttgctagattggggaagttctcctggataataccctgaagagtgttttccaacttggttccattcgccctgtcactttcaggtacaccaatcagacgtagatttggtcttttcacatagtcccatatttcttggaggctttgttcatttctttttactctttttttctctgaacttctcttcttgcctcatttcattcatttgatcttcaatcactgataccctttctccacttgattgaattggctactgaagcttgtgcatgcatcacgtaattctcatgccatggttttcagctccatcaggtcatttaaggtcttctctatgctgtttattctagttagccattcgtctaatctttttacaaggtttttagcttctttgtgatgggtttgaacatcctcctttagctcggagaagtttgttattaccgatcatctgaagccttctcctctcaactcgttaaagtcattctccgtccagcttcgttccattgctggtgaggagctgtgctcctttggaggagaagaggtgctctgatttttaaaattttcagcttttctgctctggtttctccccatctttgtggttttatctacctttggtctttgatgatggtgacatacagatggggttttggtgtggaaatcctttctgtttgttagttttccttctaacagtcaggaccatcagctgcaggtctgttggagtttgccggagttccactccagaccctgttttcctgagtttcaccagtggaggctgcagaacagcaaatattacaaaacggcaaatgttgctgcctgattcttcctctggaagcttcgttgcagaggggcacccagccgtatgaggtgtaagtcggctcctactgggaggtgccccccagttaggctacttgggggtcagggacccacttgaggaggcagtctgtctgttctcagatccaagctgcatgctgggagaaccattactctcttcaaagctgtcagacagggacatttaagtctgcagaagtttctgctgccttttgttcagctatgccttgcccccagaggtggagtctacagaggcaggcaggcttccttgagctgcagtgggctccacccagttcgaacttcctggccgctttgtttacctactcaagcctcagcaatggtggacgcccctcccccagcctcactgccaccttgcagcttgatctcaaactgctgtgctagcgtgagcaaggctccatgggcgtgggaccctctgagccagacgcgggatataatctcctggtgtgccatttgctaagaccattggaaaagtgcagtattagggtgggagtgtcccaattttccacttactctctgtcacggcttcccttggctaggaaagggaattccccaaccccttgcacttcccaggtgaggcgatgacccaccctgctttggctcatactctgtgggctgcacccactctcctacaagccccagtgagatgaacccagtacctcagttggaaatgcagaaatcacttgtcttctgcgtcactcacgctgggagctgtagactggagctgttcctattcggccatcttggaacctcctctgcctatagttctttaaaaaaaaaaatttcaggcagggcatgttggctcatgcctgtaataccagtgtagcaggacaagctgcatacaaaacccctcagacaccgagttaaagaaggaagggctttattcagtcaggagctacagcaagactcacgtctccaaaaactgagctccccgagtgagcaattcctgtccttttaagggcttaaaactctaaacaggtccacgtgagggggtcgtgatcgattgagcaagcaggaggtacgtgactgagggctgcatgcaccagtaaacagaacggaacagaacaggacagagattttcacaatgcttttccataccatgtctggaatctatacataacataactggttaggtcatgagttgatctttaaccagacccagggtgcagcacagcccgtggatttaatttctgccttttagtttttacttctttctttggaggcagaaattgggcataagacaacatgaggggtggtctcctcccttaccagcactttggaaggctgaggcaggtggatcacctgaggtcaggagtttgagacgagcctggccgatatggtgaaactctgtctctactaaaaataaaaaatattaaaaaaagttagccaagcgtggtggcgtgtgcatctgtaatcccagctactcgggaggctgaggcagaagaatcacttgaacctgggaggcagaggttgcagtgagctgggatcttgccactgcactccagcctggatgacagggcgagacttcatctcaattaaaaaaaaaatttcaagttttagatttggggtacatgtataggcttgttacatgcatacattgcatgttgctgaggtttgggctgcagatcccatcacccaggtagtgagcatagtacctgtggtggtttttcttttttctttttcttttcttttctctctctttttttttttttagagacagggtctcactatgttgcccaggctggttttgaacacctgagctcaagcaacgttgcccaggctggttttgaactcctgagctcaagcaatcctcctgccttggcctcccaaaatgctgagattacaggtgtgaaccactgcgcctggcccaataggtggttttccaacccacacctcctgctcctccatctggtagtctgcagtatctatcattcccatctttatgtctatgtatacccagtgtttagctcccacttataagtgagaacatgcagtatttgattttctgttcctgtgccaattcacttaggattatagcctccagctgcatccatgttgccgcaaaggatgtgattcatttttttttttatggtggcgtagtatttgatggtgtatatgtaccacattttcttttccaatccaccactgatagacacctaggttgattccatgtctttctattgtgaatagtgctgtgatgaacatacgagcatgtatctttttgatagaacagcttattttcttttggatatatggccagtaatgagattgctgggctgaatagtagccctgttttatattctttgagaaatcttcaacctgctttccacagtggctggactaatttacattcccaccagccaacaatgtataagcgttcctttttcttcattgccttaccagcatctgttattgtctttttaataatagcattctgactggtgtgagatggtatctcattgtggtttatgatttgcatttctctggtgattagtgataatgaactttctttttcaaatgttttttggctacttgtatgtcttcctttgagaagtgtctgtttatgtcctttacccactttttaatggggttatttgtttcttgcttgttgatttgttgaagttccttatagattctggatttcagacctttgtcagatgtggtttgcaaatattttctcccattctgaaagttttctgtttactctgttgatagtttcttttgctctacagaaactctttaattagttcccacttgttgatttttgtttttgttgcagttgcttttgagggcttagccgaaagttctttgccaaggctgctgttgagaaagtatttcctaggttttcttcaatgattttaatagttcgagggctcacatttaaatctttaatccatgtgatttaagtctttaatcacatttaaatctttaatacaccttgagttgatttttgtataaggtgtaaggaaggggttcagtttcattcttctgcatatggatagccagttatctccacactctttattgaatagggagttctttccccattgcttgcttcatagtctttattgaagatcaggtggttataggtgggtggctttatttctgggctctctgttctattccgttggtctatgtgtctgtctttgtaccagtaccatactgttttggttactatagcctcatattcggatagtgtgatgcctccagctttgttatttttgcttaggattgcttttgctatttaggctctttttttgttccgtattaattttagaatagttttttctatctgtgaacaatggcattggtagtttgatacaaatagcattgaatctgcaaattgctttgagcagtgtggccattttaacaatattgattcttccaatccatgagcatggaatacttttccgcttatttgtgtcgtctctgatttctttcaacagtgtatttctctttgtagagaccttttacctccttggttagctgtgttcccaggtacttcatttttcgtttctgcctgtagttctgtgtgtttttaaaatttttgtcggtggttctctttgacttgtaattaatgcattgtatggggatgaaaccagtttctcctgatacctgaacagcttgtcataattctttgccaatagtcaaattcttcacgtggtctctctaaacacatactggccattgatggtgtcaatgcctgacatgtataagggatggggtggggaaaaaagtgtagaggaattacgggaagtcaagtgtggattggatgccacttctctgttttcggtgtgtggtcaggaccacatgaggaaggctggctggtcaactcccccaccccacacaagtacacgcacattaccatcaagggtgatagatgcttaaagtgggacagtctgggagttatgagagcaaatgggaggggcacccacagaaaggcagtatggaagccttcctggtggaagtggcagctaagccaaggcctgaggtggaagcacaagagaagtgaaaaggggtgtggggaagcaaggggccagaggagggagagagaatggaatggagggtcagaatatgcgtatagggtggtgggaggagtggtgggagaaaacaggaaagaagggtaggtgtggcttatcccagacatgcagggcttgttcaatatcccaaataccaatattgcagaaatggacaagctgatcctgaagtccatatggaaacagaagggacccatatattagacttatacctaaatgtttcatgacctttggcactattgtaaattgtactggtttttaaatttaaatttccaattgttggaacagaacagagccctcagaaataattccacatgtctacaaccatctgatctttgacaaacctgacaaaaacaagaaatggggaaaggattccctatttaataaatggtgctgggaaaactggctagccatatgtagaaagctgaaactggatcgcttccttacaccttatacaaaaattaattcaagatggattaaaagcttatatgttagacctaaaaccataaaaaccctagaaggaaacctaggcattaccattcaggacataagcatggtcaaggacttcatgtctaaaacaccaaaagcaatggcaacaaaagccaaaattgacaaatgggatctaattaaactaaggagcttctgcacagcaaaagaaactaccatcagagtgaacaggcaacctacagaatgggagaaaatttttgcaatctactcatctgacaaagggctaatatccagaatcatcaaagaactcaaacaaatttacaagaaaaaaacaaccccatcaacaagtgggtgaaggatattaacagacatttctcaaaagaagacatttatgcagccaacagacacatgaaaaaatgctcatcatcactggccatcagagaaatgcaaatcaaaatcacaatgagataccatctcacaccagttagaatggtgatcattaaaaagtcaggaaacaacacgtgctggagaggatgtggagaaataggaacacttttacactgttggtgggactgtaaactagttcaaccattgtggaagacagtgtggcgattcctcaaggatctagaactagaaataccatttgacccagccatcccattactgggtatatacccaaatgactataaatcatgctgctataaaggcacatgcacacgaatgtttattgcggctctattcacaatagcaaagacttggaaccaacccaaatgtccatcaacgatagactggattaagaaaatgtggcacatatacaccatggaatactatgcagccataaaaaaggatgagttcatgtcttttgtagggacatggatgaagctggaaaccatcattctcagcaaactatcgcaagaacaaaaaaaccaaacactgcatgttctcactcataggtgggaattgaacaatgagaacacttggacacaggaaggggaacatcacacaccagggcctgttgtggggtgggggaagggaggagggaaagcattaggagatatacctaatgtaaatgacaagttaatggatgcagcacaccaacatgacacatgtatacatatgtaacaaacctgcacgttgtgcacatgtaccctagaacttaaagtataataaaaaaataaatttccgattgtttagggatatagaaatacaactggccgggcccagtggctcacgcctgtaatcccagcactttgggaggccgaggcaggtggatcacctgaggtcaggagtttgagatcagcctgaccaacatggagaaaccctgtcgttactaaaaatacaaaattagccaggtgtggtggcacatggctgtaatctcagctacttgggaggctgaggcaggagaatcgcttgaatctgggaggcagaggttatggtgagccgagatcatgccattgcactccagcctgggcaacaagtgtgaaactccatccaaaaaaaaaaaaaaaaaaaaagaaatacaactgattcttacatattgatcttgtatccaaaacaatcttagaaaaggggaacaaagctggagggttcacactttccaattcaaaacttacaaagccatcaagccagaaagtaaattagtggtttccaggggctgggggttggactggggattggaaatactgctaacaggtagagaatttctttctgggaagatggaaatgttctggaggtagtggtgatgattacacaacattgtgaaggtactaaaacccagtgaaccttatactttaaaatggtaaattttatggtctatacatttaatctaaattataaaagctactttgaagaaaacaatgtgattcaccataacagcagattaaagaagaaaaaacatgtaaccacctgaacagatatagaactctaatttgacaacatacaacatcgtttcatgattaaaaatactctcagccgactaggaactaaagggaacttcctcaagctgaaaaagagcatttacaaaaaatctctaccaggcattatacttaaaagtgaaagagaatgcttttcacctaaaattggaaacaagacaagaatatctacttttataattcctatccaacattgtactgaaagacctagccaatgcaataaagcaggaaaaagaagaaaaaaaaatataaagaggaaaggaagaaataaaaccctctctatttgcagatgatacaattgcatggaaaattccaaagaacctataaaaaagctatgataataggttttttcagtaagttctcaggatataggagcaatgtataaaaattagttttatttctataatataattgaacaattggaaatttaaattaaaaagtaccatttacaatagcataaaataccatgaaatatttaggtataaatcaaacgaatcatgtacggtaactttatgctgaaaactacaaaacactaatgagagaaataaaagacctaaataaatggagagagacgctgtggtcatggattcgaatattatagttccaatattgttaagatgtcaattctccctgggttgatctacagattcaatgcagtaaaaatcctggataatattccattgtgcacatgtaccacattttctttatccattcatctgttgatggacacttaagttgattctatatctcgactattgtgaatagtgctgcgataaacacgggagtgcagttatctcttcagtatactgatttcctttcctttggcaatatacccagcactgggattgctggatcatgtggtagttccatttttagttttcttgaggagcctccatattgttctctatagtggctttactaatttacattcctactaacagtgcatgagggttcctctttctctgcatctttgccagcatccatcattgtttgtcttttcgataaaagcccttttaactggaatgagatgatatctcattgtggttttcatttgcatttttctggtacacaaaggaatattattcagccataagatgaatgaatcttgtgatttgcaataacaggattggaactggaggacattatgttaagtaaaacaacccgggcacagaaaaacaaatattgcatgttctcattcatgtgtaggagctaaaaaaaaatggatctcatggaggtagagagtagcatgatgggttactagagactgggaagggtagtaaggaggatggggtaaagaggggatggttaatgggtacaaaaatacagttaggaaaaataagacctagtgtttggtagcacagtagggtgactatagttaacaataatttattgtgtatttcaaaataactacaggaatggaattggaatgttcccagcaaaagaaatgataaatccttgaggcaacggatatcccagttaccctgatttgatcatcacacattgtatgcttgtataaaaatatcacatgttccctataaatatgtgcaattattacatattcataaaaaggtaaaaatcctagaagtatattttgcagaatttagccaattctaaaatttatataaaaaataaaaaagtagagtatccaaaagaattttgaaaagaatcttgatacataccattaagtagctgtcactttttatttatttatttaatttaaaaaaattagattgatattttataatttttcaacttttactttaggtttgagggtacacatgaaagtttgttatataagtaaactcatgtcatgggagtttgttgtacagagtattttgtcacccaggtattaagcctagtatccaatggttattttttctgctcctgcctcctcccaacctccaccctcaagtagaccccagtgtctgttgtttccttctttgtgttcataagttctttatagtttagctcccactaataagtgagaacatgcagtatttgtttttctgttcttgtgttagtttgctaaggataacggccttcagctccatccatgttcccacaaaagacatgatcttgctatttttatggctgcatagtattccacggtgtatatgtaccacattttaaaaaatcctatttgttattggtgggcatttaggttgattccatgttttgctattgtgactagtactgcaataaatattcatgtgcatgtgtctttatggtaggatgatatatattactctgggtatatccccagtaatggggttgctgggttgaatggtagttctgcttttagctctttgaggagttgccatactgctttccccaagtggttaaactaatttaccactcccaccaacagtataagtgttcccttttcttcacaacctcaccagcatctattttttaacttttactaatagccattctaactggtgtgagatggtatctcattgtggttttgatttacatttctctaatgataatgattttgagctttttttgtatgcttgttggctgcatgcatgtcttctttcgaaaagtgtctgttcatttccttttcccaccttttaatggcgttgtttttctcttgtaaatttgtttaagtaccctgtagatgttggatattacacctttgttggatgcatagtttgtgaatattttctctcattctttaggttgtctgttcactctgttgatagtttcttttgctcttgcatttaattagatgccatttgtcaatttttgcttttgttgagattgctttttgtgtctttgtcaggaaatctttgcttattcctgtgtctagaatggtattgcctaggttgtcttccagggttcttatagttttgggttttacatttaagtctttagtctatcttgagttgatttttgtatatggtgtaaggaaggggtccagtttcaatcttctgcatatggctagccagttatcctagcaccatttgttgaataggaattcttttccccattgcttatttttgtcttagatcagatggtcataggtgtatggccttatttctgggctctctattctgttccattggtctatgtgcctgtttttgtaccagtatcatgctgttttggttactgtagccctgtagtatagtttgaagtcaggtaatgtgatgcctccttctgtgttctttttgcttaggattgacttggttattcaggttcttttttgattccatatgaattttaaaatagtttttcctagttctgtgaagaatgtcattggtagcttaatagtaatagcactgaatctataaattgctttgggaagtgtgtccattttaatgatattgattcttcctatccatgagcatgagatgttttaccatttttttggtgtcatctctgatttctttgaacagtgttttacaattctcactgtacagatctttcaactctctggttagctgtattcctagttattttattctttttgtggcaatcgtgaataggattgccttcctgatttggctcccagctcttgttggtgtataggagtgctagtgatttttgtacattgatttcgtatcctgaaactttgttgaagttatttatcagctgaaggagctcctaggccaagactatggggttttctaaatatagaatcatgttgtctgcaaacagggatagtttgacttttttacttcctttcttcctatttgtatgcccttttttctttcttttgcctgattgctctggctagaacttccaataatatgttgaataggactagtgagcaaaggcatccttgttttgtgctggctttcaaggggaatgcttttgcccatcaagtatgatgttggctgtgggtttgttgtagatggctcttattattttgaggtatgttccttcaatacctagtttattgagaatttttaacataaaggggtgttgacttttattaaagccttctcttcatctattgagataatcatgtggtttttgtctttagttctgtttatgtgatgaatcatatttattgatttgcatatgttgaaccaactttgcaccccgggaatgaagcctacctgatcatggtggattagatttttgatgtgctgctggatttggtttgcaggtagtgtgttgaggatttttgcattagtgttcatcaagaatattggcctgaaattttctttttttgttaagctgacactttttagtttgatgccaccccatttgtctggtttgcttttgttgcctgtgcttttggggtcatatccaaaaaatcatttctcagaagcttgattgtcaagaagcttttccctttgttttcttctagtagttttacagtttcaggtcttgtgtttaagtctttaatccattttgagttgattttgtatatggtttgggataaaggtctaatttaatccttttgaatatgaatatccagttctccccacaccatttgttgaagagaatgtcctttctcctttgcatattcttggcacctttattgaagatcaattgaccataaatgcatagttttatttctagcctccctgttctgttccattggttgatgtgtctgtttttatgccaccaccttgctgttatgcttactagagctttcttgacacagtatgttttgagatcaggaattatgatgcctccagtattttttttcttgaggattgctttggctatttagggtcttctgtggttctacataaattttagttttttttctatttttgtaaaaaaatgccattgggattttgataaggattgtactgaatcagaagattgcattaatactccagtccatgaacataggatatctttccatttatttttgtcttgtttaacttccttaatcaatgttttatagttttagtgtacatgtttttcacctctctggttaaatttaagcttaggtattttttttgatgctattgtaaatgagattgtttcttgatttctttttcagatagttcattgttagtgtatagaagcactattgatttttcacattgattttgtaacctgtaactttactgaatttattcattagttctagtagttcttttttggtggagtttttagggttttttaaaaatatatttatatatatatgtttttatatatatatcattttaagtgtaaacagagacaaatttccttttttatatctgatttgggtctctttcatttatttttcttgcctaattgctgtgaccaggacttccagtactatgttacatagaagtagtgagagtgagcattcttgcctttttcctcattttagtggtaaagctttcaatttttcaccattgagtatgatgtttgttgtgggcttgtcgtatatggcctttatcatattgaggtacattccttctgtagcgaatttattgagagtttttattataaaagaatgttgaattttgtcaaatgcttttttttgcgtatattgagatgatcatgtggttttagtccttcattctgttaatgtgatatgccacattaattgatttgcatatgtggaatcatccttgcatctcgcatcccagggataaatcacacttgatcatggttattatctttttatcttttttttttttttttttaacagagtctctctgtgttgcccaggctggagtgcagtggcgttatctcggctcactgcaagctccacctcccaggttcacgccattctcctgcctcagcctcttgagtagctgggactataggcgcccgccaccatgccctgctaatttttttttttttgtatttttagtagagatggggtttcaccatgatttccaggttggtctcgaactcctgacctcaggtgatccacacgccctggcctcccaaaatgctgggattacaggcatgagccactgcatctggccggttatatgactttatatgtttgtcaaaactcataaaactatgtactaaaaggctgaattttattgtatgtaaactcttccccaataaatctgacctaaaaaacaatcaaattctgttgactttaggataaagtattcagttatcaatgagtcttccctcaatggtgtatgaggcagaaatcacgttgcagagccgtggcatgatgtcccctgcacattccctttctagaacttgtcccagtttgaaattgctatacacatctccctgttaatccattgattactctcctctcctccacctggctgcactgagggccctggaaggcactgtatctctattacccagctgtgtgcttagcaataagaaacacttgtttgttgaatgaatgaataaatgaatgaatgaatgtatgattaaataggtgaattttatggatgaattctacatattgaccttgaagatatttcttaatatcacaacaaatattcaaataacaaatagttatttttaatctaagccagttattagccttattagtcagagtgccaactttgactttttacctccctaaagattcccaatatattgaaagggtggtattctgtcttctcttctagaattttctatgtattttccaacccaaattcttctttgctgccttaataatctcccaggaataccacctggagtaaatcctcactcactgcccattgactctactataggcttattttttatcttttaaattattaaaaaatatatatatacacttagagattgggatcttgctctgttgcccaagctggagtgcagtggtgacaaagctcactgcagccttaaactccttggctcaagggatcctcccacttcagccccccgaggagctgggattacaggcagaaaccattctgccaggcttattatataggttcctttagctggcagcacattcaagtgataatttatcatgaaccatatagaagatcacatctgctccagagggattcccccagcaggcataacttttcttcagagagagaaaacctccacatctgctttaggtgggaagaggtgtgtgattacggtcctgtctctttcagatcggcgcctacttcggggcctccctctgctccgtggacgtggacagcaacggcagcaccgacctggtcctcatcggggccccccattactacgagcagacccgagggggccaggtgtccgtgtgccccttgcccaggggggtgagtggcaatgggacctgggctgggtggggcccggtgtgggtggaggggtcgcctgggttggggcctgatactgtttgtgtttagcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccaggtgagacctggtcactgtccttgtcatgacagtagcctctttgttgatctttctcctaattcagtgtgcccacagctgccagataagttctcacagtactcctttcagaaccttcaaaaataataacatgtggctgggcctggtggctgacgcctgtaatcccagcactttggaaggctgagttgggaggattgtttaagcccaggagctcaagaccagtcagggcaacatggtgagaacccatctctccaaaaaaaaaaaaaaaaaaaaaaaattagccaggtgtggtggcatacacccatggtcccagctactctggaggctgaggccggaggattacttgagcctgggaggttgaggctgcagtgagtcctggtcacaccactgtactccagcagccagagtgacagagtcagacttgcacatgcatgcgtgcacgtgcacacacacacacacattcacagaaatctcaaagactcttagttccagattgattatttctacagcaataggaggtgcatgatagcctcatcacccccactttacagatgagtagatcaaggcccagcgatggcaaatggcaagctagcagtattgggatgcaggcattcctttcttctgaatctcggtcctggtaaggtgaccaagagctctagtttgcttaactctgtcccagatttagtactgaaatcccacatcctgggaaacctatgcggttggccaccttacgggattgcacacttcacagatgtggaattgtgcagtcacacgtgcccctctctcagaatcgccctgtgcttggcttaatgctctgctattgccatcttcaattcttagtaatttttcaacaaggggtcctacgtttttttgcattgggtcttgcaaagcatggagcccatcctgatgacttgtcaccctatattctggacctgacaactgttttgctctgtaagttggctttctgtctcctgccaggtggagcccactgtctggagggacccttacagtctggttccatcttccctgttcatattctttcccaccatagccacctgagaccatctagttttctggcctctggtctctgggtttttgctagccttacatttttctttctttatgtttaaaaatttttttattgtggtaagggcacttaacatgagacctatcctcttaacagattttaaaatgtacaatgtaatactgtcatctattggtgcaatgttgtacagcagacctcttgaacttcatcttgcatattgaaaatgtatacccattgattagcaactcctcattgttctctagcctctggcagccaccattatattctttgcttcaatgagtttggctgttttatttttttttagtttttgagacaaaagtttcagtctgtcgcccaggctggagtgcagtggcacaatctcggctcactgcaaccttacctcctgggttcaagcgattctcctctctcagcctcctgagtagctgggattacaagcatgcaccaccatgcctggctaatttttgtattttttgtagagactgggttttgccatgttgtccaggctggtcttgagctcccggactcaagtgatccacctgccttggcctcccaaagtgctgggattacaggtgtgagccaccgcaccctgccagtttggctattttagataactcatataagtgaaaccacgccgtattcatcctttggtgactggcttatttcacttagaataacgtcctccaggttcatccatgttgtcacaaatgaaagaatatctttcttctttttcttctcctcctcctcctcttcctcctcctcctcctccgcctccccctcctcctcctcttcctcctcctccccctcctccccctcctcgtcgtcctcctctcctcctcctcctcctcctccttcttcttttttgacaaagtcttgttctgtcacacaggctggagtgcagtggtgcaaacacggctcctggaagcctcaacctcctgggctcaagcgaccctcccacctcagtctcctgagtagctgggactgtgggcccattccaccatgcctgtctaatttatttttattttttgtagagatggggtctccctatgttgcccaggctgatggctttcttttttaaggctgaataatatcccactgtatgtatataccacaattaaaaaaatccatcatttcctggtagagagggaaggaaaaatccctcatctgttgataggcatttaggttgttttcacatcctggctattgtgaatagtgctgcaatgaacatgggcacgttcatatctctttaagatcataatccccattcctctggttaaataaccagaagtgggattattaaatcatatggtagttctatttctaattttttgaggaacttccatacgttttccctaggagctgcaccattttgcagtctcgccaacagtgtgcaaaggttctgatttttccatgtgtttaccaacacttgtcttttgtttttttggcaatagccaggctagcaggtgtgcaagtgaaatttcactgtggctttgatttgcatttccctgatgattagtgatgttgagcatcttttcatgtatgtattgggcatttttgtgtctgaaaaaaatgtctcttcaagcccttaagcttatttttaaatcaagttattaaggccgggagcagcggctcatgcctgtaatcccagcacattgggaagccgaggcgggtgtatcacctgaggtcaggagttcaagaccagcctggccaacagggtaaaacttcatctctactaaaaatacaaaaattagccgggctgtggtggtgcatgcctgtaatcccagctattccagaggctgagatgggagaatcgcttgaacccgggaggtggaggttgcagtgagccgagattgtgccactgcactccagcctgggagacagagggagaccttgtctcaaaaaaagagaaaagttattagattttttgctattgagttgtatgagttcactatatattttggagattaaccccttatcagatacatggtttgcaaatactctctcccattccataggttatattttactctgcttattcttgcctttgctgtgtagaagtctcacttggtttgatgcagtcaggcttagttatttttgtcgtctgtacttttggtgtcatagccataaactcattgctcaaaccaccatctttccagcttctcccctgagttttattctagatgttttactttttcattgaagtctttaattcattttgaattgatttttgtgtatggtatatgagtcaagttgcattctcctgcatttgtatatccagtttcccaataccatttgtctaagagagtatcctttacccattgtgtattcttggcattatttaggagaatcagttggacccatatggatgggtttatttctgggctctgtattctgttccatttgtctatatgtctatctttatgctagtaccatactattttaagtactataactttgtcatttatatatataatcctgcattttattagagtcaaataacattaaaagaaagacacttatattcgctttagaaaacccattgatgttgatgaatttggcacatacttataaaagcaaggcttattagctcatatatttggaactaaaaagtatttgaagttgatcacagcataatgaatcctcaatttccagagtactagagatgattatatacaaaaatccagtgaaacttattttactaatttaccagttctatatcactcctaaatttccctaaaaatatggatttataaaaggtagtattctataattcacaaatatgaagagctttattataatttgagtatgaactgtgtatcacccatatcatggcttcagaaaactattgcttttcttactaacttatttaaggtttcactacatgagtcagtatgcagaactcactatgttgtaactacgatctgtaatgataaaaatatagaacctctttgactttaatctaaaaaagtcaccttatcataaaacagtgttaacataatcaaaaattaaccctgacaaaaaaaaacccacttattttggcttttaaaaatagctcatgctcatggttctttcaaagtggtgttgtagctaccgtcttttctaacagaggaatattttcatcatagcaactatttctgagccaaaaataaaccacactaaaaacagaagaaaattctcagtgtagaaaggaaaaggctcatctgttgtgcaatagcaggcatcgggctctgtgagtgcctttcagacatcctcaatcaacccaactagaggcactattgagtttatccagtaagagcactgtgcaatctagtgctgtgagggcattacttaattagccaaaggaagaacaatctttttttctttcttttcttttcttttttcttttcttttcttttttctttctttctttctttcttctttctttctttctttctttcttccttcctttctttctttctttctttctttcttttttctttccttctttctttctttcttttttttctttctctttctcttttgtttttgtttttgttttgagacggagtctcgtgctgttgcccaggatggagtgcagtggagtgagctcggctcactgcaacctccgcatcccaggttcaagctattctcttgcctcagcctgccgagtagctgagatgacaggcgcccgccactacgcctggctaatatttttctctttttaggagagacggggtttcaccatgttggccaggctggtctcgaacacctgaccttgtgattcacctgcctcagcctcccaaagtgctgggattacaggcgtgagccaccgcgcccagctttttctttctctttctttcttctttctttctctctctctctttccctccctctttctttctttctctctctctctttccctccctctttctttctttctttctttctttctttctttctttctttctttctttctttctttctttctttctttctttctttctttttctttctctctttctttctctctgtttctttctctctctttttatttttttgagacaaggtctccctctgttgcccaggctggagtgcagtgacgagatcatggctcactgcagtcttgacacccaggctcaagcaattcttccttctcagctgcccaagtagctgagactataggtgtgcacccccacgcttggctaatttttcaattttttgtagagatgaagtctcactatgttggccaggctggtcttctggcctcaagccatcctcctgccttggcctctcaaagtgttaggattatagatgtgagccactgcacccagccaaagcagtcttcaagttatgtaccagtaatttatatagcttttctaaaatttaagaaagtactgaatggactatagttattatctaaaatttaagcaagtactgagtggactatagtcattatatgattttttaaaaaatttcagtaacttttggggtacaagtgctttttggttacatgaatgaattctatagtggtgaattctgagattttagtgcacctgtcatcaaagcagcgtacactgtaccaaatatatagtcttttgtctcttacctcctcccagactccccttccccaagtcctcaaagtccgttacatcactcttgtctttgcatccttatagtttagctcccacttataaatgaaaacatatatttagttttccattcctgtgttacttcagtaatggcctccagttctatccaagttgctgcaaaatacattatttgttcctttttatggctgggtagtactctgtgtatatatacacatatacacacacacatatatataactttttaaaatccactcattggtcgacgggtaccacagtttggttccatatctttgcaattgtgaattgtgctgctataaacatgcatgttcatgtatctttttcatataatgacttcttttcctttgggtagatacccagtagtgggattactgaatcaaatggtagatctactattagttatttaaggaatctccatactgttttccatagaggttgtgctaatttacattcccaccagcagtgtaaaagtgtccccttttcatcacatccatgccagatctattgttttttgactttttagttatggccattcttgcaggagtaaggtggtattttattgtggttttaatttgcatttccttgatgattagtgatgttgagcatttttttcatatgtttatcggccatttgtatatcttcttttgagaattgtctattcatatcctttgcctactttttgatgggattatttgttttttccttgctgatttgtttgagttccttatagtttctggatagtagtcctttgtcagatgcatagttggcaaatattttcttgcattctgtgggttttctgtttgctctgatgattatttcttttgctgtgcagaagctttttagtttaattaggtcccatttattggttttgttgcatttgcttttggggtcttggtcatgaattctttgcctaggccaatgtccagaagagtttttccaatgttatcttgtagaattgttatggtttcaggtcttagatttcagtctttgatccatcttgagttgatttttgtataagttgagagaagaagatccagtttcattcttctacatgtgatttgcctgttttcccagcgccatttactgaatagggtgtccttttcccaatttatgtttttgtatgctttgtaaaagatcagttggctgtaagtatttggttttatttctgggttctttgttttgttccattggtctaagtgcctatttttataccagtaccatgctgttttggtaactatagccttgtagtataatttgaagtctggtactgtgatgcctccagatttgttctttttgcttagtattgctttggctatttgggctctttttttttgttccatatgagttttaggattgttttattctagttatgtgaaaaatgatgttggtattttgatgggaattgcattaaatctgtagattgggcagtatggtcattttcacaatattgattcttcctatccatgagcatgggatatatttccatttgtttgtgtcatctataatttatttcagcagtgttttgtagttttccttgtagggagcttcacctccttggttaactatattcctaggcattttattttatttttgtagctgttataaaaggggttgagttcttgatttgattctcagctttgtcattgttggtgtatagcagtgctactgatttgcatacattgattttgtaacctgagactactgaaattgtttatcagatctaggaatcttttggatgagcctttagcattttctaggtaaatgatcatatcattggcaaacagctctaatttgacttcctcttttccaatttggacccctttatttctttctcttgactgatttgatttggctgggactttcagtactgtgttgaatagaagtgctgaaagtgggcattcttgtcttgttccagttcttagtgagaatgctttcaacttttcccccttcaatatgaagttggctgtgcttttgtcagataatggcttttattattttgagataagtcccttctatgtctaatttattgaaagcctttttttaatcataaagggatgctggattttatcaaatgcttgttctgcatctattgagatgattatatagttttcttctttaattctgtttatgtgatgtatcacatttattgacttgcatatattaaaccattcctgcgtccttgggatgaaacagacttgatcatgatgtattatctttttgatgtactgttggatttggttagctagtattttgttaaggatttttgcttctatattcatcagggatattgttctgtagttttcttttttttgttatatccttttctggttttgatattagtgtgatactggctttatagaatgatttagggaggattccctctttctctatcttttggaatagtatcatatcattggtaccaattctttgaatgtctgttaaaattcagctgtgaaaccttctggtcctgggctctttctgatttgatctcgctgcttgttattggtctgttcttggtatctatttcttgctatagctattatatgattaatccaaggtaccgaaaagcattttgaatgatttagcaggccatcctttttccttgtgtcctaatgaggaatttttttgacgcttcataattctcttaacaaggaattttagctcctcctccatcattttgtaaaataacgatgataatttaaaacttccatcaacatattaaattttcaaaattaaacaactaaaagctacaaaaatctcaaagtttgagttttaaactgaatatttgaagctaatatagaaatttttgataagaatatcagtgcagacatataacactcaaaccttcacagctaatggcaatatctattagcaatgcaaggtactctttttttttttttttctttttgagatggagaattttgccctgttgcccacactggagtacagtggcatgatcttggcttactgcaacctctgcctcctgggcaagagattcttttgcctcagcctcctgagtagctgggattacaggagtgcgccaccatgcccagctaatttttgtatttttagtagagattgggtttcaccatgttggccagtctggtctcgaactactgaccttgtgatctgcccgtctcagcatcccaaagtgctgggattacaggcatgagccaccatgtctggccgcaaagtactcttaatgacttttaaatcatgtttaacagagagtttacacaagttagtccaatgtagttagtattagtgtccaataatatatgaacacccttcaagacaattgctgctacattttcaatataattattaattgttgtctgaaaaacacacataaacgcaagtgagactaaaagttgtgtcacaaaagaaaaaaagaaaagaccagtaccatgctgttttggttactgtagcctggtagtatggtttgaagtcaggtagcgtgatgcctctagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacaatattgattcttcctacccacgagcatggaatgttcttccatttgtttgtatcctcttttatttcattgagcagtggtttgtagttctccttcaagaggtccttcacatcccttgtaagttggattcctatatattttgttctctttgaagcaattgtgaatggaagtgcactcatgatttggctctctgtttgtctgttactggtgtgtaagaatgcttgtgatttttgcacattgattttgtatcctgagactttgctgaagttgcttatcagcttaaggagattttgggctgagacgatggggttttctagatatacagtcatgtcatctgcaaacagggacaatttgacttcctcttttcctaatcgaatgccctttattcccttctgctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatatgtcctatcagtacctaatttatggagagtttttagcatgaagggttgttgaattttgtcaaaggccttttctgcatctattgagataatcatgcggttttcgtctttggttctgtttatatgctggattacgtttattgattttcgtatgttgaaccagccttgcatcccagggatgaagcccacttgatcatggtggataagctttttgatgtgttgctggattcggtttgccagtattttattgaggatttttgcataaatgttcatcaaggatattggtctaaaattctctttttttgttgtgtgtctgccaggctttggtctcaggatgatgctggccttataaaatgagttagggaggattccctctttttctattgattggaagagtttcagaaggaatggtaccatctcctccttgtacctctggtagaattcggctgtgaatccatctggtcctggacttttttttggttggtaagctattagttattgcctcaatttcagagtctgttattggtctattcagagattcagcttcttcctggtttagtcttgggagagtgtatgtgtcgaggaatttatccatttcttctagattttctagtttatttgcgtagaggtgtttgtagtatcctctgatggtagtttgtatttctgtgagataggtggtgatatcccctttgtcatttttgtattgcatctatttgattcttctctcttttcttctttattagtcttgctagggctctatcaattttgctgatcttttcaaaaaaaccagctcctggattcactaattttttgaagggttttttgtgtctctatttccttcagttctgctctaatcttagttatttcttgccttctgctagcttttgaatgtgtttgctcttgcttctctagttcttttaattgcgatgttagggtgtcaattttagatctttcctgctttctcttatgggcatttagtgctataaatttccctctacacactactttgaatgtgtcccagagattttggtatgttgtgtctttgttctcattggtttcaaagaacatctttatttctgccttcattttgttatgtacccagtagtccttcaggagcaggttgttcagtttccatgtagttgagcggttttgagtgagtttcttcaccctgagttctagtttgattgcactgtggtccgagagacagtttgttataatttctgttcttttacatttgctgaggagtgctttacttccaactatgtggtcagttttggaataggtgtggtgtggtgttgaaaagaatgtatattctgttgatttggggtggagagttttgtagatgtctattaggtccgcttggtgcagagctgagttcaattcctggatatccttgttaactttctgtctcgttgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagttcttcttgttgaattgatccctttaccattatgtaatggccttctttgtctcttttgatctttgttggtttaaagactgttttacccgagactaggattgcaacccctgcctttttttgttttccatttgcttggtagatcttcctccatccctttattttgagcctatgtgtgtctctgcacttgagatgggtttcctgaatacagcacactgatgggtcttgactctttatccaatttgccagtctgtgccttttaattggaacattaagcccatttacatttaaggttagtatttttatgtgtgaattagatcctgtcattatgatgttagctggttattttgctcgttagttgatgcagtttcttcttagccttgatggtctttacagtttggcatgtttttgcagtggctggtaccggctgttcctttccatgtttagtgcttccttcaggagctcttttagggcaggcctggtggtgacaaaatctctcagcatttgtttgtctgtaaagtattttatttcttcttcacttatgaagcttagtttggctggatatgaaattctgggttgaaaattctttcctttaagaatgttgaatattggcccccactctcttctggcttgtagagtttctgctgagagagaaagttcgggttacccacaaagggaagcccatcagactagatcagctgccagtctgatgggcttccctttgtgggtaacccaacctttctctctggctgcccttaacattttttccttcatttcaactttggtgaatctgacaattatgtgttttggagttgctcttctcgaggagtatctttgtggcgttctctgtatttcctgaatttgaatgttggcctgccttgctagattggggaagttctcctggataatatcctgcagagtgttttccaacttgattccattctccccgtcactttcaggtacaccaatgagatgtagatttggtcttttcacatagtcccatatttcttggaggctttgttcatttctttttattcttttttctctaaacttctcttcacgcttcatttcattcatttcgtcttccatcgctgataccctttcttccagttgatcgcgtcagttactgaggcttgtgcattcgtcacgtagttctcgtgccgtggttttcagctccatcaggtcctttaaggacttctccgcattgattattctagttatccattcgtctaattttttttcaaagtttttaacttctttgccattggtttgaacttcctcctttagctcagagtagtttgatcttctgaagccttcctctctcaactcgtcaaagtgattctccgtccagctttgttccgttgctggtgaggagctgcgttcctttgtaggaggagaggcgctctgatttttagagtttccggtttttctgctctgttttttccccatctttgtggttttatctacctttggtctttgatgatggtgacgtacagatgggtttttggtgtggatgtcctttctgttgttagttttccttctaacagtcaggaccttcagctgctggagatatagaccaatggaacagaactgagcactcagaaatagtgccgcatatctacaactatctgatctttgacaaacctgacaaaaagaagaaatggggaaaggattccctatttaataaatggtgctgggaaaactggctggccatatgtagaaagctgaaactggatcccttccttacaccgtatacaaaaattaattcaagatggattaaagacttacatgttagtcctaaaaccataaaaaccctagaagaaaacctaggcaataccattgaggacataggcatgggcaaggacttcatgtctaaaacatcgaaagcaatggcaacaaaagccaaaattgacaaatgggatctaattaaactaaagagctgctgcacagcaaaagaaactaccatcagagtgaacaggcaacctactgaatgggagaaaatttttgcaacctactcatctgacaaaggggtaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcatcattactggccatcagagaaatgcaaatcaaaaccacaatgagataccatctcacaccagttagaatggcaatcattaaaaagtcaggaaacagcaggtgttggagaggatgtggagaaataggaacacttttacactgttggtgggactgtaaactagttcaaccattgtggaagtcagtgtggtgattcctcagggatctagaactggaaataccatctgacccagccatcccattactgggtatatacccaaaggattatacatcatgctgctataaaggcacatgcatacaagtgtttattgcggcactattcacaatagcaaagacttggaaccaacccaaatgttcaacaatgatagactggattaagaaagtgtggcacatatacaccatggaacactacgcagccataaaaaaggatgagttcatgtcctttgtagggacatggatgaagctggaaaccatcattctcagcaaactatcgcaaggacaaaaaaccaaacactgcatgttctcactcataggtgggaattgaacaatgagaacacatggacacaggaaggggaacatcacacaccagggactgttgtggggtggggggaggggggagggatagcattaggagatatacctaatgctaaatgacgagttaatgggtgcagcacaccaacatggcacatgtatacatatgtaacaaacctgcacgttgtgcatgtgtaccctaaaacttaaagtattataataataaaaaagaaaaagaaaagaaatccaatgaatcaattaatgctatcaacaaagaacatgcaagaatgtaacattacatgtaatttttgttttcaaaaaagacactaaaatgccactgcattaaaatgtatttattatttattattattatttttgagacagggtcttggtctgtcatgcaggctggagtgaagtggtgcaatcatggctcactgcagccttgacctcccaggctcatgtgatccgcctgcctcagcctcctaagtgtctttgactgcaggtgtatgccaccatacctggctaatatttaaatttcttttgcagtgacagggtctgtctatgtttcccaggctggtctccaactcctgggctcaagtgatcttcccaccttggcctcccaaagtgctgggactactggtgtgagccactgcactcagccggactataatttattcagaacatctttagtgttcattcccagagatcttgatctgctcagtaatgctttcacaagatcgattatagccatcttttgcagtgaatgcttaggctggtccgtcctcctgtggtagtagggagcagtctttttttttttttttttaaatcttcatgtttttatttattttttcttttttaaattacacattgggccaggcacagtggctcatgcctgtaatcccagcactttgggaggccgaggcgggcggatcacgaggtcaggagttcaagaccagccttgccaacatggtgaaaccccatctctactaaaaatacaaaaattagctgggcttggtggcgtgtgcctgtaatcccagctacttgggaggctgaggcaggagaattgcttgaacccaggaggcggaggttgcagtgagccaagactgcaccactgcacgccagcctggcaacagagcgagactccgtctcaaaaaaaaaaattatacgttaagttctgtgatacatgtgcagaacatgtaggtttgttacctaggtatacaagtgccatggtggtttgctgcacccatcaacccgttgtctaggttttaagcctcacatgcattaggtatttgtcctaatgctctccctcccccttgatccccacccctcaacaggctccagtgatgttcccctccctgtgtccatgtattctcattgttcaactcccacttatgagtgagagtatgtggtgtttgctttcctgttcctgtgttagtttgctgagaatgatggtttccagtttcatctatgtccctgcaaaggacatgaactcattctcttttatggctgcatagtattccatggtgtatatgtaccacattttctttatacagtttatcattgatgggcatttaggttggttccaagtctttgctattgtaaatagtgcttcagtaaaaatacatgtgcatgtgtctttatagtagaatgatttataatcctttgggtatatacccagtaatgggattgctgggtcaaatggtatttctggttttagatccttgaggaatcgccacactgtcttctacaatggttgaactgatttacactcccactaacagtgtaaaagcattcttatttctccacatcctctccagcatctgttgtttcctgactttttaatgatcatcattttaactggcatgagatggtatctcattgtggttttgatttgcatttctctaatgaccagtgatgagcttttttttttcatatgtttgttggccacataaatgtcttcttttgagaagtatctgttcatatcctttgcccattttttgatggggttgtttgtttttttcttgtaaatttgtttatgttccttgtagattctggatattagacctttgtcagatggatagattgcaaaaatattctctcattctgtaggctgcctgttcactctgatgatagtttcttttgctgtgcagaagctctttagtttaattagatctcatttgtcaattttggcttttgttgcaattgcttttggtgttttagtaaggaagattttgcccatgcctatgccctgaatggtactgcctaggttttattctagggtttttatggttgtaaattttacatttaagtctttaatccatcttaagttaatttttatataaggtgtaaggaagggatctagtttcagttttttgcatatggctagccagttttcccagaagcatttattaaatagggaatcctttccccatttcctgcttttgtcaggtttgttgaagatcagatggttgtagatgtgtggtgatatttctgaggcctctgttctgtttcatttgtctatatatctgttttggtatcagtaccatgctgttttggttactgtagccttgtagtatagtttgaagtcaggtagtgtgatgcttccagctttgttgttttgcttaggattgtcttggctatatgggctcttttttggctgcatatgaaatttaaagtagttttcacaagatcagctacagccaacttttacagcaaacggttaggctgttcctcctgtggtagtaggaggcagggtttttttttttttttttttgagatggagtctcagtctgtcacccaggctggagtacagtagcgtgaactgcaacctctgcctccaggttcaggtgattctcctgcctcagcctcctgagtagctgggattacaggtgcccaccaccacacccagctaatttttgtatttttagtagagatggcatttcaccatgttggccaggctggtctcaaactcctgatctcaagtgattcacctgcctcagcctcccaaagtgctgggattacaggtgtgagtcaccgaacccggccctctttgcccatttttaaattgggttatttattttcttactattgagttctttatgtgttatggatattaaccatttatcagttgtgtggtttgcaaatattttcccccagtctgtaggttgtctcttcactctgttaattattcctttattgtgcagaagctttttagtttgatgcaattccatttgtctgtttttgtttttgttgcttgtgctttcaggatcatataaaaaaatcattgcccagaccaatgtcatgaagctttccctctacgtttccttctaatagtttatagtgttagatcttacatttaagcctttaactcactttttaatttttttattttttaatttaattttattttagatggagtctctctctattgcccaggctggagtgcagtggcacgatctcagctcactgcaacctccacctcccgggtcccagcgattctcctgcctcagcctcccaagtagctgggattacaggcctccgccaccatgcctggctacttttttgtatatttaatagagacggggtttcaccatgttggccaggctggtcttgaactcctgatctaaggtaatccacccgcctcagtctcctaaagtgctgggattacaggcgtgagccactgcacccggcccagcacttttgatttttgtatttggtttgagataaaggctcagtttcattcttttgcctgtggatatccagtgttcttaacaccatttgttaaaaagactgtcctttccccattgtatgcccttggcacctttgttgaaaattagttgattgttggccgggcgcggtggctcatgcctgtaatctcagcactttggaaggctgaggcgggtggatcatgaggtcaggaaatcgagaccgtcatggctaacaaggtgaaaccccgtctctactaaaaatacaaaaaattagccgggcgcggtggcgggcgcctgtagtcccagctactcgggaggctgaggcaggagaatggcgtgaacccgggaagcagagcttgcagtgagtcgagattgcgccactgcagtccgcagtccggcctgggcgacagagcgagactccgtctcaaaaaaaaaaaaaaaaaaaaaaaaaaaaaaaaaaaaaattagccaggcatggtggtgggcacctgtagttccagctactcgggaggctgaggcaggagaatgggggaacctgggaggaagaggttgcagtgagcctacatcatgccactgcactccagcctgggtaacagagcaagactccgtctggaaaaaaaaaaaaaagaaaagaaaattagttgattgtaaatgcatgggttcatttctgagctctgtattctgttccattggtcaatgtctctgtttttatgtcagtgtcatgctgttttgctgagtatacctttgtggtgtattttgatgtcaggtagtgtgatacctctacctttgttgtttatgctcaagattgtcttggatatttgaggtcttttgtgacttcatattaattttagtattgttttttctatttctgtaagaaatgccattgggattttggtaggaattacattgactctatcgatcactttgaatagtatggacctttaaaaatattctttcaatccataatatgggatatctttccattgatttttgtcttaactttctttcgtcaatgttttatagttttagtgtgcatatttttcaccttcttggttaaattaacttgtaagcattttattttttgatgccattgtaaataggattaatttctttttcagatagtttgttgttagtgtatagaaacaaataatttttgtatgttcattttgtattccatgactttactaaatttgtttattaaatttgataactttttcgtagagtatttataacaagtttcttatatataagatcatgtcaattgcaaacagggacaatttttttttctttatttctaacttgaatgcatttcttatctttttcttgcccaattgctctggctaggactttcagtactgtgttgaaatagaagtggtgagtgtgggcatccttgccttgttcctaattttagtggtaaaatcaaattttcaccactgggtatgatgttaactagacactttttttaatgttctttatcatgttgatgtaatttccctgtatttctagtttgttgagggtttttaatcatgagtggctattcctgtggcctgaatgtttgtgtcctccccagattcatatgttgaagcctaattccttgtgtgatggtatttgtagatgggacctttggaaggtgtttaggtcatgagagtgtggccatcattaataggattagtgcccttagacaaaagcaaaatgatggttgcctatgaaccagaaaataggctctcaccagatattgaatctgcttgcaccttgattttggatgtcacaagtcttcagaactatgagaaataaatttctattgcttataacccatccagtctatgttatttgttataccaaataagctaagacagatgtttagttttattaaatgctttcttttcttattgataagatcatgttatttttattccttattctgttaatgtggtgcatcacatttattgatttgcatatgttgagccatccttgcatgccaggaataaagcccacatggtcatggcgtatgacccttttgtgctattgaattcagtttgctagtattttatttaggattttggatctatgttcaatagggaaattggcatgtagtgatcttttctcatggtgtgtttgttgggatttagtgtcaggatagtgcttgcctcatacaataagtttggaagtattccctcctcttcagttttttggatgagtttgagaagaattcatattaattcttatttaaatgtttggttggtagaatttgcctgagaagccaccaggtcctgggcttttctttgttaggaggtctttgattactgattcaatttccttactcattatagatctgtttaaactttctattgccttatgattcaggcttggtaggttgtatatttctaggaatttatccattccttcaaggttatcaagtttgttaacatataattgttcatagtagtctcttaatgatcctttttattgctatggcatcagttgtatgttctttcatttataattttacttatctgttgtttctgttttttctccctttttccttggtctacctaaaagcttgtcagttctttttttttttttttttgagatggagtctcactctgttgcccaggctggagtgcagtggcatgatcacagctcactgcattctccacctcccaggttcaagtgattctcctgcctcaggctcctgagtagctggcattacaagcacgtgccaccacacctggctgattttcgtatttttagtagagacagggtttcaccatgatggccaggctggttttgaactcctcatctcaggtgatccacttgcctcgacatcccaaagtgctgggattgcaggcgtgagccactgcacctggccaaagcttgtcaattctatctttttgaaaaatcaacttaatttcattgatttttttctattctctatttgatttatttttctgtaatctttattattttcttccttctactaactttaggtttagtttgttcttttatttctcatttcttgaggtgtaaagttaggttttgtaattgaaatttgtctttttgttttaaaattaggtgtttatcccgaactttcctttagtactgcttttgctgcctcccattaagtttggtatattgtgtttttgttttcatttatctcatgttattttctaatttatttttttatccattagttgttcaatggtgtattgtttaatttttacatatgtatgtttttttccagtttttcttctggtattgtttttagtttcattccattgtggttggaaaagattcttgatataatttaaatcatttcaaatttgttaagacttgttttgtgacctaacatgtggtctgtcctggggaatggtccatgtgcacttgagaagaatgtatattctgcagtagttggcttgtgtattttgtatatgtctgttaagtccatttggtccattctcccttgggttttttttttgtctagttgttctatttgctattgaaagtaggattttgaagtttcttactattgaattgctgtctatttctcccttcagttctgtcattattagctttatatattcagatgtctgatgggtgtgtatataattaattgttgtaactcctggtgaaatggccatttcatcattatataatatcattatttgttttttgacttaaagtctattttgtctgatattagcatgtcatcctgctctcttttggttaccattttaatggaatagcattttctactcctttacttttagcctatgtgtcagtaaatacaaagtgggtatcttgtagatagcatataattggattttgtatttttattaattctgccactctgttttgagagtttgcttctgtttacatttaaagtaattattgatagagaaggatttactactgccattttgttaattgttttctgttagtcatgtaggtcttttgtccctcttttcttctcttgctgtcttcctttgtgttttattgttgttaatttttgtattaatatgctttcattttgttctctttttgtacttttttttttttgagacggaatctcattctgtcacccaggctggagtgcagtggtgcgatctcggctcactgcaagctccgcctcccgggttcaggccattcttctgcctcagcctcccgagtagctgggactacaggtgcccaccacctctcctggctaattttttgtatttttaatagagatggggtttcaccacgttagccaggatggtcttgatctcctgacctcgtgatccgcccacctcagcctcccaaagtgctgggattacaggtgtaagccacgtgagccaccgcgtctgaccctttttttgtgtatataacttctaaaggtattttctttgtggtttccacaaaacatctcataattatcatggtctattttaagctgataacaactgaacttaaatcacatgcactctatacttttattccccactacacgttttacgttattgattcacaatttacagttatttatattgtgtatccagtaacataattttagctatagttatttttaatatctttgtcttataacttttataccataattaaaagtgtccaattcacttgcattaaggacatgacaaaatcacttttaaaatttctttaaaatttattatttggctgtcatttttttcaatattactcttgcacatactttaaagagtcaaaatagttccaaaaagctcactattaaaaaacaacaatttccacatacacgatggttttggcttcatttcccttgctcttgagggaaccactttcagctctttcaattctctatttgttccaattacataataataattttgctactttttgatttttgttttaccactgacttcccaccatggaaggtggagattgatctctttttcagttttccttttgccacatagtagcactcttttaccccccattcacgcctcatgtttatgtgatcattttgtttagatcaacattcagtgtttgcattattctgactacgtaaatgaaattcagctgagccaaataatatacttttacttttccctgtatgcagggaaatgcaggtaattaatagaaattggggttgggcgtggcggctcacacctataatcctagcacttgagaggctgacagggcagaatcgcttgagcccaggagttcaagaccagcctgggccacaaagtgagacccccgtttttattttaaaagtttttttaaaaaagaaattgtaggtatcctcttgaggttgtggtctaaaggtgaataattccttgataagttctaagctgtcctagttccttggttagttgcaagagatgagacttgagtagagcttagagaacctctgtctgggccatgctggatgactgagttatacatctcctgtctttcctacccctttctctctccacacctcttttttaccctcagcggatagcaggctccaagctctctcccaggctccagtattttggtcagtcactgagtgggggccaggacctcacaatggatggactggtagacctgactgtaggagcccaggggcacgtgctgctgctcaggtgagaatgccttttggagtcaaccggacattctcccttgaaggaatgtttcctgtttgaaggtccctgatggttttctggtgtccctttaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggtgaggcttggtggatgagtctcaagaggttaaacgaccgaggacatgaatgggtgctgcaatccactctgcccagccttctggctgtcctgaactgagttctcacaggctctgacaaccttctccaagccttacctgagtgagcaggctattgtcctgctgggtagggaagtccagtggacctccctaaagaggtgagcatgtggcacttccttactcactcagttctccagagaactgaaggccccatgcctgtgaacaaactatgtttttgttttttaataaacggagagaaaacctatttggggagattgaattgatgaagctaaacagagatttacaaagcactcacatacgcattttatcaccagtgacttcttcccttgttcctattctcaaagagtagaactgtgtttggggtgggagaatagtaatgacaatactaagaataactgtctctagtagtgacagcactaggaataactgtctctagtaatgacagtactagaaagaattgtaccctctttaaaagtaaaattattagctaggcatgatggcatgttcttgtagtctcagctacttgagaggctgaggtgggaggggaggatcacttgagcccaggaggttgaggccagcctgggcaacatagcaagacccatccctaaaaaatgattacctttctaggaacagttttcctgtgctgaggagatagcattccagatatgagagcagccagcatggctagaaattaagagcaaaatgttagagagtagggaattgaagaagaggtacccttaaacctacatagaagtccccctctactctttggctgactcttaagacacgaatgcctaggtcagtactccaagacacccagtagaaaacagcaactgaaaagccaaagagctgatcagagaattcagcagctcctcagtgctggggagacagagatttgagaggccttggtaaataccttggtctttccattgagacaactgactagcaaccaagagaaacaatatacaatagaaatagacccacaggtgattcagaaattagagtgattggataggaatttttaaaaggtaactataattaatatcttcaagaaaaaagggaaaggatgagaacttcagcaaaaacctggaattcataaaatagagtcaaatggaaactctagaaccaaaaatcgcactgactgaaatgaagaattcagtaaatagatttatagcagattagaagcagaacagagaattagtgaacaagaagacagtcatttgaaagtatctggataaatatgcgataaaaagaaagaaaaatacagaaaaacaccataagagatgtgtgggatatggtgaaagatctaacaaacatgtaattggaattacagaaagtggtggtgggggaggagagagagagagagagaaagaaaataggaaagatggaataggaaagacagaataggaaagatggaataggatggaataggaaagatgcagtagttaaagaatttccccaaactggccagtcacggtggctcacgcctgtaatcccagcactttgggaggccgaggcaggtggatcacctgaggtcaggagtttgagaccagcctggccaacatggtgaaaccccatctctactaaaaatacaaaattagcaggtgtggtggtatgcgtctgtaatcccagctactcaggaggctgaagcaggagaattgaacctgggaggcggatgttgcagtgagctgagatcgccccattgcactccagtctgggtgacaagagcgaaactccatttcaaaaaaaaaaaaaaaaattccccaaactgatgaaagacatcaagattctttacaaaatcaaagcaggataaatatgaaggacattatatcattgtacgttataatcaaactgctgaagaccaaagacaaagagaaaaaaatttaaagtagtcagaaaaatacaataaattttttagtgagtgacagaatagctaccatttattgagcacttattgtataaaagacactgtgctaaatacttgataagcactatttcatttcctttttaccattgggagggtatcattattatcctcactttaaaaataaagaatggaggccaggcgcagtggctcatgcctttaatcctagcgctttgggaggctgaggcaggtggattactttgagaccagcctggctaacatggtgaaaccccatctctactaaaaatacaaaaattagcacggcgtggtggcatgtgcctataatcccagctacttgggaggctgaggcaggagaaacgcttgaacctgggaggcagaggttgcagtgagctgagatggcaccactgcactccagcctgggcaagagagtgagattctgtctcaaaaaagaaaataaaaaataaaaagaaaggaaggaaggaagaagggaaggaaggaaaggaaggaaagtaggaaaggaaggaaaggaagaaaaggaaggaaggaagaagggaaggaaggaaaggaaggaaagtaggaaaggaaggaaaggaagaaaaggaaggaaggaaaggaaaggaaaaaaggaaggaaggaaggaaagggaggaagagagcgaggaaagaaagaaagaaagaaaaaggaaggaaggaaggaaagaagactcagagaagtcagataacataccccaagtcacacagctgagaagcagaggagctgggccttgaactcccatctgccgggttccgaggctcaggcccctcactgctgtgccaccctgtcccttcaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccggtgagcaggctagtggccagacccctgggtcttccaagcatggagtgggcttggggagctgaggagggcagatccccaaatcccggctatctcttagaattgcatcgaggacccagtgagccccattgtgctgcgcctgaacttctctctggtgggaacgccattgtctgctttcgggaacctccggccagtgctggcggaggatgctcagagactcttcacagccttggtgagtccagagttggggtcctgcaggggtgtggaagagaccagagaccaaggtggttgaaactcattttatttgattgcatctaattttacttcaacatttgattttattgtttaatttcacaatacttggttattttctttcctttcatttgatcatatttattttttaaaagtttccctttgagaagaattgtggcaatgacaacatctgccaggatgacctcagcatcaccttcagtttcatgaggtgagtttcctttcctcctcacctcctccagagaaggacccgtaccatgacccgctcttttctcctcctggcccccaagggagccgggtgttcctgggctataaggtccggtgtggctgcccctccactgttgtctcttcatcaagtgtctgcgtctctgttctgctggagcaggcttgccacagggaagcccagcgccccatcccccggcctgtcttcttcttcccacagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacgctccaggtagccacatccttctcaggctctatctgacctttgcttccccatcctcacggccggaggtggatatcaccgcctttgcctcccctgccttccagaaccagcgctcacagcgatcctggcgcctggcctgtgagtctgcctcctccaccgaagtgtctggggccttgaagagcaccagctgcagcataaaccaccccatcttcccggaaaactcagaggtcagaactcctggctcctcccctccttttctctttgatttctttggggattcttttcttcttcttctcttctttagtagtggttcctttttgtacaaaacagctttattgagatataattcatataccatccaattcacctatttaaagcatacatttcaagcccggcacagtggctcatgcttgtaatcatagcactttaggaggtcgaggcaggaggatcgcttgagcccgagagtttgaaaccagcctgggtgacacggcgagaccctgtctctacaaaaaatgtaaaaattagctgggcgtggtggtgcacacctgtagtcccagctactcgggaggctagggtgggaggatcgtctgggcctgggaggttgaggctgcagtgagctatgatcacaccactgcactctagcctaggcgacagagtgagaccctgtcttgaaaataaataaaatgaaataaaataaaataaagtatacagttcagtggctttgagtgaattcatagggtcttgcatccgtcatcatgatccattttggaacatcttcattacctcacaaagagcttctgttcccgttggccctcagccccagtcctcccatatcccccagccctatgcaaccactaatctactttgtctatagatttgcctattctggacatttcatataaatgaaataatcccgtatgtgatcctttccctagcataatattaagcaaggacttagcaaggatcattcatgtcgtagtatatgtcagtacctcattgctttaaaaaaattgtttttaaattttttatatatatttttgagatggagtttcacttcgttgcccaggctggagtgcagtggtgcaatcttggctcactgcaacctctgcctcccaggtttaagcaattcttgtgcctcactctcccaagtagctggggttacatgcgcccgccaccacacccagctaatttttgtatttttagtagatacagggttttgccatgttggccaggctggtctcgaactcctgacctcaggtgatccacctgcctcagcctcccaaagtgctgggattacaggtgtgagccaccgcacctggccttcattgctttttatttggtgaacaatatcctgttgcatggatgggccatatttcatgtctccattaatcagatgacgggcatttgggttattttttctctcatatttctgtcattgtctctcctttctctcactccaggtcacctttaatatcacgtttgatgtagactctaaggcttcccttggaaacaaactgctcctcaaggccaatgtgaccaggtgctctctgctaccaggcttctgcaggcagttgcccgtctgacgccccagcccctggcccatggtgggcctttgccctttgcccactggttctcccttcaactcatttgttcactcagcaaacactcactgaccacccaccacgtgctgggccttgtgctgagtgctggtgggatggtggtggatcagacgatagtggttcctgccctctcggagatgataatttagtggcaaagacagacaagaaatctagccattaatcttgcatccatctcaaatccagtatgagatgcaagattagatgggggacggccagtgttcttgggagtttggtgttcagagaagattcctaaagaaaatatatttaggagctgggcgtgctggctcaagcctgtaatcccagcactttgggaggctgaggcaaaacaattgctcgaacccaggagttcaaaatcagcctggacaacatatcaataccctgtttctacaaaaaaaaaaaaatacaaaaattagccaggcatggtggtgcatgcctgtaatcccagctactcaggaggctgaggcacaagaattgcttgagcctggaagattgaggctgcagtgagctgagatggtgccactgcactccagcctgggcaatagagtgagacccagtgtcaaaataataataataataataataataaaaaataaaagggaaaaaaagaaaatatatttagacaaagcaaaggcatgaactgagggcgggcatgaagacagaaggcaggaagcagataccagggacgggaagatcagggtgtgtttaagagtggcctcagcatgaaatgcagggctgaaggagttggtggtggttagatacaggccatgtcccaaaatgactgacgggtgttgtttgggatttgcagtttcgcctctgggagtgacataatcatatttgcatgttagaacgatcactcttcaggagggctggcgattggggtgggagcaggtgtgaattcaggggaccagttagaagaaggtggttgcagacatccagctggagagggatgggcctgggctaggcgggggcaggggttggagaacagtggggtttcagatgcagagataacagaacttggtggctgattggaggcagggagtgagggagagggaggagcaaagactaactgtcagttctcaagagccggctggagctctttctttccctccagtgagaacaacatgcccagaaccaacaaaaccgaattccaactggagctgccggtgaaatatgctgtctacatggtggtcaccaggtgctggcttccaggactttagctgagcctccacttctgggctggacatggctgattgtgcatctgtgtgcatgagtctgtgcatgtgtgtgtgtgtgagagtctgaggatctctgtgcatgtatgtgtgcatgggtgtgtatttgggcatgggtgtgtgagtgtgatgatctatgtgcatgtttgtgtgcatggacgtgtatttgtgcatgtgtgtgtctgaggatgtatctgcatgtgtgtatgtgtgcatgggcgtgtatttgtggatgtgagtgtgatctatgtgtgtgtgcgtgcatgggtgtgtatttgtgcgtgtgtgtgaggatccttgtgcatgggtgtgtatttgtgcatgtgtgtgtgaggatctatgtgcatgtgtgtctgggcatgggtgtgtgtgcatatgtgtgtgtctgaggatatatgtgcattgtgtgcatgggtgtgtatttgtgcatgtgtgtgtatgaggatctgtgtgcctgggtgtgtatttgtgcgtatgtctgaaggtctatgtgcatgcgtgtgcgcatgggtgtgtatttgtgcatgtgtgtgtgtgaaggtctatgtgcatgtgtgtgcgcatgggtgtgtatttgtgcatgtgtgtgagggtctatgtgcatgtatgtgtgcatgagtgtgtattcgtgcatgtgtgtgtgtctgaggatctatgtgcatgtatgtgtgcatgggtgtgtatttgtgcgtgtgtgtgtctgagggtctgtgtgcatgtgtgtatgtgctcatgggtgtgcatttgtgcacgtgtgtgtgagtggcccaaatgggcacgcactgtgtgtccagcacacattggttcccccatccccctgcaccccaccccatctccaccccccaggacttcatacccattacccatgtgcctgttcgctccttacacacttagcctgagacaccctcccagggcacccctcatgttttgtcacctcctgtcccttttttctcccttcagccatggggtctccactaaatatctcaacttcacggcctcagagaataccagtcgggtcatgcagcatcaatatcaggtgggcagctgggacgtctgggtcctgagaaggaggctggggaggaaaatcgatggtagaaaatgcagaaacagggatgggaaatgtgcgcaaggcacctgtggtgtgccaggcttggttccacgctgctatcactcagtatgcacacatacacgcacgtatgtatgtgacatgcacgcacgtagttatcttgtattaccttcgtagcgactctgtggggcactgtcatgatccccagtttacagatgaagaaactgaggctcagagaggtttacagaacaagctcgaggtctcccaccgagtaagtgggagagctaggactggagaccaggccgtgtggcactggaatgcgtattacatgtacactctactctctcaaacaggaaggggcaggacgcccgggcctatggcctgccccgtggggaggggaggctgattctccaggctggtgggggaggaaggccagagccctgaccccgccctccccggtgcaggtcagcaacctggggcagaggagcctccccatcagcctggtgttcttggtgcccgtccggctgaaccagactgtcatatgggaccgcccccaggtcaccttctccgaggtgagcggagctcggcctgactcctgcacggccctgcgcgttcctctcacctctgttaatgctattgggttttagagccgctccgcccctctcctggacccaggccatctcacctcccgagatgaggccctggcgccttcatctctgccccttctcagtgcgtctctttcctcagaacctctcgagtacgtgccacaccaaggagcgcttgccctctcactccgactttctggctgagcttcggaaggcccccgtggtggtgagaagctaagtcagccccagggccacacagagacccagagcgcttccctgctggaacctgtatggtctctgagcaaacggggaggggtgttctctgccttcggcttccttacccgtcccctcccctcctgcgttccccagaactgctccatcgctgtctgccagagaatccagtgtgacatcccgttctttggcatccaggaagaattcaatgctaccctcaaaggcaacctctcgtttgactggtacatcaaggtgtgtggggtcctgaggcttcgccgggcacaggcgtggtgctcagggcccaggtgcagtgcccacccgctctcttccacagacctcgcataaccacctcctgatcgtgagcacagctgagatcttgtttaacgattccgtgttcaccctgctgccgggacagggggcgtttgtgaggtcccaggtacctgtcttgggcgctgaggaactattggagggagaggggctgcgcttgtggagatttctgggggaggagagagagacacaaagagagagggagagagagagacagagcgacagagagacagagagatacagagacgtaaggagagagacagacagagacagagagatagaggcagagggagaaacagacacagagacagacaaaggagagagagatagagagtcagagagatagagatagagacagagacagtgagagatggagatagacagagagatagagataaagagagagatacagagcgcgacagagacagagacagtgagccatggagatagagagacagagagaggcagaaagcgatagagagagatagaggacagagaaacggaggagggagaggagggagaagaggtgggggaggaggactgagggctggggttctgggggacatgaggaggggttccccacttgattcaggggtgcacacggtgtgaatggggaacccccagaaatccagagtcgtctcccctgacgcccctccttcctcccccagacggagaccaaagtggagccgttcgaggtccccaaccccctgccgctcatcgtgggcagctctgtcgggggactgctgctcctggccctcatcaccgccgcgctgtacaaggtgctccccgctgctcccccaccccctcccttcatcctctcgggcctcgcgctgcagctccgtgcctcggtttccccggcggggctgccagctgtgtgactggggcgagtctgggagcctctctgcgcctcagtctcttagggagggtggccgggttcatgcgcggggcgcgctgagaacgagtcgccctccttgtagtttctgtttttctccaggccccgacgcggatgtcactcccctcccgccccgccctcctgggtcccttctgtctctgccggccctcccgccccctccccctggtctgcggagccgcacgctccctggctgctgtcgctctcactgccctcctctgccccgcagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcaagtgtctgtgtgcaagtgtgtgcacatgtgtgcgtgtgcgtgcatgtgcacttgcacgcccatgtgtgagtgtgtgcaagtatgtgagtgtgtccaagtgtgtgtgcgtgtgtccatgtgtgtgcaagtgtgtgcatgtgtgcgagtgtgtgcatgtgtgtgctcaggggcgtgtggctcacgtgtgtgactcagatgtctctggcgtgtgggtaggtgacggcagcgtagcctctccggcagaagggaactgcctgggctcccttgtgcgtgggtgaagccgctgctgggttttcctccgggagaggggacggtcaatcctgtgggtgaagacagagggaaacacagcagcttctctccactgaaagaagtgggacttcccgtcgcctgcgagcctgcggcctgctggagcctgcgcagcttggatggagactccatgagaagccgtgggtggaaccaggaacctcctccacaccagcgctgatgcccaataaagatgcccactgaggaatgatgaagcttcctttctggattcatttattatttcaatgtgactttaattttttggatggataagcttgtctatggtacaaaaatcacaaggcattcaagtgtacagtgaaaagtctccctttccagatattcaagtcacctccttaaaggtagtcaagattgtgttttgaggtttccttcagacagattccaggcgatgtgcaagtgtatgcacgtgtgcacacacaccacacatacacacacacaagcttttttacacaaatggtagcatactttatattggtctgtatcttgctttttttcaccaatatttctcagacatcggttcatattaagacataaattactttttcattcttttataccgctgcatagtattccattgtgtgagtgtaccataatgtatttaaccagtcttcttttgatatactattttcattctcttgttattgcatcaatgctgagttaataaatcaaatatatgtcatttttgcatatatgtaaggataatttataggatatgttcctggaagtttgggttctcccagaagcaaacccaagaatttgggtgaaacaagcgtatttaagaggtggcaggccaggcatggtggctcacacctgaaatcccagcattttgggaggtgaaggtgtgaagattgcttgagctcaggagttcgagactagcctgggcaacatagtgagaacctgtgtccacgaaaaattaaaaaaatttagccaggcctggtgttacatgcctgtagtcacagctactccggaggctgatgcaggaggattacttgagcccagaaggtctagactgcagtgagccatgatcgcaccactgcactccagcctgggtgacagagtgagatcctgtctcaaaaataaacaaaataataaaataaaggtcgggcacagtggctcacgcctctgtaatcccagaactttgggaggccgaggctggtggatcacctgatctcaggagtttgagaccagcctgtcgaacttggtgaaaccccgtctctactaaaaatacaaaaaaattagccatgcatggtggcaggcaactgtaatctcagctacttgggaggctgaggaaggagaattgctttaacctgggaggtagaggttgcagtgagatatgattgcatcactgcactccagcctgggcgacagagcaggactccatcttaaaaaaaaaaaaataaataaaataaaataaaataaagagatggctccaggaaataccgaggaagggaaggctgccaataacaggtgtatcacccacagagaagctgctgtgagttcctggagcttcaccccactgggcagttctcggaggcagtgcagaacacgcacctcagtatcaccccacccaggggagaaggctggagcgcatagacaccgattccacttagctattggatgagggctgctcttggtggggagagtgtgttaatttcctaccacttctggcctgccctgagtgtgaggagagtgggctctagtggccagagaaagtgataccagtgctgctggctggatgtttgacaggtgaacacagcccctgacacggtgcctttggttcaggtcagggcaccaggagcacttgctgccaaggtgtgtgcaggtgacattttggtggctgcttcctcagagggaggatgcccagtgcctgtccctcatactttgcaaacacagtaaacactagcctggcctgaacatacatcctctctaatcctcacaccagtccttggtatttacatgaatttcacttatgaggaaacctaggcttagatagatcataccagttgcctgaggtcatacagctgggaaggaatggagctaggagttaatcccagctctgcctaggtctaaagcttttctcttttactgtcctgacagcctcagaggaatggccccagaacaggcatgagggagtgtggggagagggtggctgttatttaactgttatgatattgggttaaagcatatgaaattgatgacatgtttttggacaaaaatgtttctttcttttctttctttctttctctttctctcttttctttctctctctctttctttctccttctttctttctttctccttctttctttctttcccttccttccttccttcctttccttccttccttccttccttccttccttcctccttccttccttccttccttcctccttccttccttccttccttcctttcttttttctttctttctttccttccttccttccttccttccttccttccttccttccttccttccttctttctttctttctttctttctttctttctttctttctttctttctttctttctttctttctttctttctttctttcttttttttcatggagtcttgttctgtcgcccagactggagtacagtagtgtgatctcagctcactacaacctctccctcccgggttcaagtgattatcttgcctcagcctcctgagtagctgggattacaggcgtgcaccacaatgtctggctaattttttttttttgtatttttggtagagatggggttccaccatgttggccaggctggtcttgaactcctgacctcaggtgatccatctgccttggcctcccgaaatgctgggattacaggtgtgagtcactgtgcccagccaaaaaatggtaatttcatgatcttcattgaaatacaagaaaatcatggcttagagggacacttgtttcacatgtggcaggaggagagagggcttactccttagggaggtgaaggaagggtccccaagggaggtgacacctgactgaagcagggccagaagatctccaggcagaagggagggcaggggaggctgggagagtgggcagggcttgggcatgagtgctttgtaagccagagtgagtagttccaatttcactcaaagtgaagtgagatgccctcaaaaggtggctaatgagacaatggccctttgtatctgtgggggtgacacaaaacacggtcacctttagacggttctttgctatttcctctcctgacttaaataaagtctgttaagaatttctgtgtttccttatgttgaaagataaaagtcctcaatatctgcagaagtcctgaattgctccgggaacagagagagttctgtacctttagtcgcctgtcctttcaccctccatgtctgtagtcgcctgtccttgcagcctccatgctggtccttgtagccttcgtacctagttgcttgtcctggcagcctccatacctgtagttgcctgtccttgcagcctccgtgcctgtagccgccagtctttgcagggcagttaaagtcctgtgaactcagagttcacctccgcgtcttcaaatgagaagcttgtgttgaattcagccagataggagctttatgatgggttagaaaagtcaatcatttcaagcgacagatttccctagcatgaccacaaagtgactaataaacaggaccataaatctggtgataagtggccaagtccaggaacgtctgcttgcttttatttttggggatttctcacttcagaataaatgaatcccttcagtatccactctccttttcctacttagagtagaatcttaatttgggccaccatgggagatggttacaattctgactcccagtgaatggtgcttcccggccctacacccttgcagtgtgacattgctgtccctgacatcacatggtgcggcctgtctacctctttgaatctgggctggtcccgtggtttgctttgattaatagaatacagtaggagtgtggtcgtgtgagttctggagcctagacctttaggagcacagcagatcctgccctgcacccctcggaacactgaggtcaccacgccgtgatccatatggcccactggagaaagagtggactcatggaggagacagcggaggccactgccactgtgcatgcatgaggctgctgtgatccttccatccagctgtccaacacctgcagccactggagagtcccacagaactgcctggattgtcacctcatgcaactgtgagaaataatcaattactgatgtctcagtcctgcgtggtggtttgttacgctgcaatggatattgcgtatagccccttagttatagggttcgtctccccacctcctgtgcagctggtgtggctgcctggcgaggttctggctgatgggatgtgagcagcagtgaagcgagcaacttcggagccaggtcctttgagggaagaagtgtcgtttcttttcaccaccttcccgctggctggagtgtcagcatcacggtgcacaattttggaccctgaagatgagtttgacatcgaagaatgcaagagtggaacagaggaggctgggtcccgcctctgcggaggcaccatgtcagccctggactccatattctcatgccattacaggagagagatgagaacactggtcttgttgaaaacactatcactcagagcctccgatacagcagtttatctgttttgttaattgatatcaccaccttcccaaagattctgttctcccaattgtggtaaaggccgaagtcgtcttcttcttattcttctttttcttttttcagacagtgtctcgctctgctgccaaagctggagtgcagtggcgtgatcacagctcactgcaaccttgagctcctgggctcaagtgatctcccacatcagcctcccgagtaggtggaactacaggcatgtgccaccatgcctggctgattgttttatgatttttttttgtagagacggggtcttgctatgttgcccaagctggtcttgaattcctggcctcaggtgatccttccttcttggcctctcaaagcactgggatgtcaggtgtgagctgccactcccggcctctgaaggcctcttgatggtgcagctaccccagcttctagcattttaatccctttcctcttatcactactcatgataaggccagcactcaaaatagagggtccccaagatggtc

SEQ ID NO: 1972 - DNA, 12997 bp, Homo sapiens
acatttcttttcctttccatagacttttattctcccagtgagaagacaaatctgtttcccctccaccagaaggcctcaagccacagctacttacattatagtaattaaatccctgctgctaggagggttcaggagacaagcaggactcgtgccaagggctggcctgcagggaggaggcagcagggagggaggctggccagaagggcctgtctctcagctgtctcctgagagtgagaaaatccccttagccacgatgtcttcacaggctttcgcttgtgggataggaagataacgccccccgcagcccaccctgccaacatgcaccatcgatgaggacccccgccagctggaatagcgtagctttcttccagttctctccgaaattccatctggtgctcacgaccttcccgcagatggccagtgcaggaaacatcccctcctcaggctccttctctcactctctagatgacaaaacagaggaccagaaactaagctgccccacacctagcctaggatgcttctcctcacctgcaactcagctggccttcacagagcgctccatgtgtgccagaaaccatgtcctctgccttacaaacagcaatatctcattaactctcatgacagccccagcggccaggttaggattcacccccatggaaactgtgaatcaaagcactgagacagcttcccaaagccacacagcctacagtaagtgacacagccagcgctgtacccaatatctgcttggcactaaagcctgttctcctaacaccaggctagatagcccatatagaagaatcagaggatggcctgggagacagatatgagggaggatggaagaagtgagggtgagatggaccttcaggaaatggggggaaggggagcagacggaggcgtgggacaccaagtctcaggcttgtgggtcaaacccaagccacatgtgtgtgcccttgtctctcgcaaagctcacatcagacctgttgttacttgttcagtgcctgcctcccccaccagcctgtgagctccatgtctatttggtgctgaacccccagaaccaaccagaacacgccaggcagtgcccttgtctcatttattcctcatgacacccattctcatgagagagagaaaacactgttaaccccattcacagacctggagactgaggctcaaagaggtcagttttctcaacaaggctgcacagccgagaagccacagagctgcggcaagaacactaggacgcatgctgttgagggctcgggtggcccctccagggcccacaggagactttcctcagccccagagcccagcacggcacctggagcttcagcaaacccctgtatctaaactgccagcatcctcctcccctcctccctctacccttaccccactccatgagcacaaaacatcccctgaggctctgggggaggctggcaggggactgagggtggcacagtaaggggtggggtgggcgggagtggagagctcaggcagggcaggagaagctttttggcttgaaagagcccagtctaggatctgatatgcaaaagcatgtctgctgcacaatgtgagggcgtcggagacactcccctgtgtgcaaatccaaactccaccacctcccagctgtgagaccctgagcaagtcacttaaactctcggagccttgggtctgtcatctgtaaaatggggagaattatatctacctcacagggttgttgtgaggacttaatgagatgaggtgtgtaaacacacatagtaggcccttaataaatattctcttctccaccgcctgtcacctcttcactcctgaataagacccggtgttgctttggagtcattcttacggaaggaaaaataagttcccatgtaatgagagcggtgccttcccccaagctgctgtggacacaggctttctttctatatgatcccgtccacccaccaggaaaccctcatgactcaactccatcctagacttgctctcagcttgcatcaatttcatttcactcttaagggatctttccatcgctggcacatagtgtgcaccccgtcaggtgtcttctgccaaaatgccctcccaccaggctcagcaccattactctcccagagcaggggaaagcatcttggcagagcttaacaccaggtccagcccagagcaggaggggctgggaaccatgggcccagctgtgagggaccttgcatgatcccaaggccactgagctctcagaagaaacaaccaaggtaaaacccaccattgcccagcatggacaagagccccctgggtgacagctctggcccacgttgaattcttcacctctccacccacaagaggaattaaaataccacctcccaaataaaggggccgctgcgcaaggccacacagccaaatagccaggatttgaatccaggtctatggggaaagcctgtgctctcttaggaagagttggtggagaacaacacatctggctggggagagacccccctggagtctgtaaggcacagattctctgcactcctgccgcctggagcagggcttgccacacagtgggtgttcaggatatgtttccagaagagggatgggagaaacaaaaagagaggaagaactaaaaccaggaattccaggattccagctatgcccctgccactaacaatgctgagtagcctcggacaagtcatgtaacttttttttttttttttttgagacaaggtgtcactatgttgcccaggctggtcttgaggtcctggactcaaccgatcctcccgcctcagcctcccaaagtgctggattacaggtgtgagccaccgcataacttctatgggccttggggtcctataaggaggaggatggtcctttccctgccttcctcacagggctgggaggcatatgcagggatcttgcccacccaggctagcacacctggctggcctacagagcttggccatctagggcaggtatggtgcccccctgaggaggcctcccctgcatcctccaccaatgccatccagctctgagccctccaaaggcggtggctcaaccctgagcaacatgcctaccccaagccctcaccttgggagaaggtaacatcacccatgcaggcagctccggccattcccatgtatgggagatttttggggagccaacatcttacccactggaagccagaaaagaaagaaaatagctaaactccaattcgttaaaatcagaaatctcaaaaggggttttgctctgcaaaaatcgctgctagtggaagcttgcgaggaggcaggctgatgccaactcaggcaaaggggctaggaggagccaccacttgctggcagcccaggagcacccacagccaggctggccacttgaccaaccactagcaagtgtcatcctccccaggttagtggatgtcagtctccccacatccattacaaacggggacactgaggctcggagagtttgaggcacagagcttaaggaaaaccaacggtggcagatggaccagaatgagcaagggcagcctctccctgcctccctgcagggccccctcagctcaaagccactgacaggtcagcaaggttcaatggctcaagccaggcaacaggtcatctgcttcctcctccctacctactgggtaacctgggcagggcacccacctttataggtctctccatctataacctgaagcaaaacaccaaacaactgtccttgcagatgtcgcgtggcaggcctggtatcagcaagctctaaggagtaggtgccagctcagtccctgcaaggagtgtcctttaagctgactttcctgttaatttgacactgagcagcactcctgtcctttaagaaaaatgcccaacaagctgactcaaaaataacagatgccaatttgcatattatttcacacatcatttgcatgctgttcatttagtatcatcaaggctctgctcagaatacaactctggttaccctgtgcccagggcttgtgaaacagatatggcttccacaaagggcaagccctgggcacgtccctcccctgcccagctgctcttgctgcctgccccctggcacctggctgggaacgtcacccactgccacagccctggtgctccaagcagggtgaaggggcagaaagaatctttagaattctaggaagcaccctgactcaagtcttgaaggggaaattgtgttctcttgacgacgcatcaggcaagctgtggcaatgcttttcttccctgcttctgtcccaggtcagcttcctagttcggctctccctgtggccctactctctcagcctttttctgcctggtcatcgtgtgtccccctgaccttcctccaggcctctcagcctctggcctggccccacgggtttatttttgttctctctccacctgtccgatttgcatgtccacacccggttagctctgcccagaccacaaattgctaactgagtgtagaataacagggccccatggggtaagaaggctccagaagtccagcccaggccaccactgcagccctgccctccggagaacagcccacttcctttttactcacacagattcacccaacaaggtctatccagaaacatgactggggagcttgtcacggacgggaagccatttggctcatgagaaaaggggcatgttccacacgtgctctccaggcagggacacctgcagacagtggaggggtgacatgggcgcatatgcccctcctgtcttgatgctccaggtggcatcttctaaccaccactctaataaaggcaacagttgccagctgctgagacccagtgtgtggctggctctgtggtggctgctgtgctacagccagtagttgtgattccctcttaacactgaggaaataggctttgggttcagtaagttcccagagcgcccatcactggtgtgccacccaagtttttttttttttttttttttgagatggagtctcactctgttgcccaggctggagtgcagtggcgcgatctcggctcactgcaacctccgcctcccgggttcaagcgattctccagcctcagcctcccaaggagctgggataacaggcgtgagccaccaggtccggctaattttcttatttttagtagagatgaggtttcgccatgttggccaggctggtctcgagctcctgacctcaggtgatccaccctccttggcctctcaaagtgctgcgattacaggtatgagccaccgcgcctggccccaagtccttaactaccaagcctggccacctctaaaaggaaggatatcaggtcttcggggcctgagtgtgcagaactctgcagccctggtggttactgatgctaccaaatattccatccatcactgtgccctcgccctgggcctgtgttcactgcctgcccaaagcctctccagacgagacagtctcctctttcctccctacatgcccctgtgtgcaccacacggcagcaacctgaagctgccctcatgcctgctctattccctacacactctgccccctctccccgggcttctcacactcagaattgagcccctgcccgagcccctcccatcatggcttgtctagtccttcagggaccccccaacctcctacagggaatccacccagcatccccagtctgagtcactgtctccttcctcagtcctcccaagcaccaacaccataaaccaccgtccgcctgggatggatgccatctgggtgctgtctgacacccctaagaacaggactctccggactgtggctgctcatcctcgtgatgaaacatgatctggaatcagattgcgaagcctcggcacaggaagggagttcagctcctgtttttaggccagagaaacgaggcccagagaggggaagggactcgacaaagatcacacaacaagctggaagcaagaggcagaagcacctcctgaggggctcaaagcagagacgggccttttctcggcactcactgcccatgacagagctcaacagaggcatgaggcacagacagggacgcaggaaaatgggactcaagaatgaaaaagaaacttctagaaccaggaatggagaagcccttcgaggtccctcactcaaatccccagcagaagtttgtggtggggtttggaatagggaaatcagaagtgtactgagacctgagctctcattctagaaccctctctttcctgagatgggcacctggagtgaggcactcaaccctgggaacccctgtgcagccgagttttctcatccctgagatagttggtcatcatgagccctgggccagccaccgtgagggtcatgagggacccaggggtgaaaatgccttgtaagatgtaagatgctgagctcatgtgactgtcccccgataaacagccacacagccagtgctggaggagaaaggcagcctaagagaagagcaaggtggaggtgaggggtgagagagttatgtatggacatgtccagtcaggtctaggggtcctgctggccctccaggggtggaaggtgggggtgctaggggctgtggaaggagcttttgcaggaagggctttcattttccctgtattctccacacctaccctcctcacaacctgcccggtatcaccctgagggcagcagcaccagaccccagagaggaggcatcaagaactgaccttgggccagtccacaatctcaccctgatcccaggccaacctggggtgcccacacttgccctggccacccctccagcactgtcttctccaggacctgcgccagcatctcccgccctccatcaagcccttcctgcccagctcgtggtaaagttcctcctgttccaacattttgcatcacgggtctcagtgccataaactcaatttttctcttttaaggatatgggcagcagcaggcaagggaaagggcatgaacttgggagctaaacgggcttgggttcttatctcagtgccaccaccgctggcagtgtcagtgtggcccggtgacttcatctacacagggggcggtgagcacgacctgctccttgtactcccgggtgtaatgtaaagccagcccagcactcagcaaatggtccttgccttcccctctcctgtcactcagcaacatcccggccagcccagcgaagtgctgggtgaccagaaagtagcgtggtccctgcccccagctgctcctcccctcctttccctcagatcccagctgagctcctgggggtggaatgacagggtcgggggagggggcacttaaaaacccattcgcctcctccggactttcctcacccgaagaaaaggcactagaattttcctccctacagctcctgggaaaagcacagtctcagaattccccaccctcattatttaaagaggaataggtgccttgctttcttgctctccttttggggttttgaaagaaagagaagaaaaagaactacaaatgaatgtgctggcctgcctgtcactgagctgagtaaagtggtatttcatcaatatacagccgcccctcacaacccccgcacacactcattttctcccccaaatgtgcttcacaaataactgcaacagagctgaagcgctctattctgatcttacatttccatccaggccccagattctctacagaggttactcaaatttcttttcattttgactttctttaccttatatttttttaaagcagatcttttgaccatggccttacaaatccctcttcctaaaagcacaataagagaaatacgaggcatcagccgcctttctacttaggctgtgcaggagataagtgccccagccaggatgcccctggcggagcacctgggtaatgccgcctgtggggaagggaagtccggatgtgtgatgaagtctttccccaggacagttataaatagtgtgatgacacgcaaaggagaagcatatataaaaagttagctgtccccctgtgggttacagatgtttgactcatttacagactgtccacaaagattataaataaagtcaccaccaccctggggcgggtggcggagaaggccattttcacgctgtcaaaaggccattttcacgcttgccctcctgtgggccgacacactcagtgtgacctgtgaagacaaaatgtgtgcctagggccctcggcagtgggctcgcaggctctcagccagtctcctgccttctgcatcctggtcctgcaggtcaccccacagggagggtccatggaaagggctggaaagggtctatcctactcctacttttccaccatggcctgaaacacaggcaccagtacccagaggcatcttctcaaaaataccaggacactgtgacagccaacaacctatcccaaagcagcacctgggtccaaacagaaggtgcagagccacttggctagccaagcctgcactgctgctctgcccttctgcagacaaggcttccgtgaccagggagagcagaggatcagaactggttccagtgatactactcaatcatttggtctagaggctggggatggactcagggacctctgtgaggtctgcaaagagacagacaagttggccttggccattctgtttaaagagtgaatggccagacgaccaggctcccctgggcatacggagaagcggcctcccatgaggttgtctgaagaaagagtaactagaagtgggaaaagaagacactgtgggagcagacagggcagcctggataagcatcttcacaccaactcctctctgccacctgggttaccccagcaacgaggccaggcaggggccacagagaggagcagaggggcaggaaatcagtggggcaggcgagacaggagcatggtgggggagtgggcagaggactggttctgcctgggaggagagatgcagaccagtttcaaggccgggcatggggaagtggcttgaggttgtacagattggtggaaaagaagagccatgctgccacaccagcactctccagcctcccctgagaagatcccacagcccaacgcctgagatcccgagaaacaaggcccctgggtgccttgccagccacacagaggtaccagctcagccaccaacatgatggcagggtcagggtggtgaagtcacagcctggggaaaggggagggcagccaggcctttcccttccctaattctttctgaacccagggaagagagcatacaggtaatttaatgcaatggagtgggtgtgccccaaaccagctctaaaagaaaataaagaacactaagaaggactccccaggtccttgctggtctacccaggtggcaccgatcagtacagatgatgtgattaagattctcaacagaatctctagaccaggcctcgtcacaatgtctaagacttcagagagtaaacctgcctattaaaaaaaaaaaaaggactcctcatttggttcaagggtcacctggtacctttaggagcccactggggccatctcaggcatctctgccgtttgatctcatgtcccaggcataataatgagaagctctcctcttatctgagctcacccaggaatcaagccccacctccctgctccaggctgatgcctcctagcagagcttacttccatcatcagcacctacaggcctgtgaggcaggagctggggatgttctgtcccggttgctcaaccccctcacattggctcccatttgcattaactgaacatgctcagggcacatgccaccctccttttcaaaagacccaggcctgcatgacaagttacttccccagcagcagccacccgccaaacataggtgaacagcaaggccacaaccccacggaaaaaaaagcagagaacttcagaaagcagcagctcaggcacaaggttagttaatcttcaatcacctggggaaaaaaaaagtttgtcacctcccaagggcctttgagtgggagctgccactggatgggcagaattacctaatctgcctggtacccctgaggttgccttgtccatccgcctgcctccagactggtcagcagggccaaccaggcacacaaagctctccagcaaaagagtgtcacccatccctccccagggtccactgaatgtccctgagctctcctgggctgtgactaacccagaccatggaggagtagagaccacttcctccatgaaactgggacacagatattcacctccccccaagaataaaccatgcttaaaggtggtctctagtcagacccagtcccttctcaggacttcttccctcccagatacaacttctcactccgttgacaagtcttagatcccaatctgttaaagctccaactaattttacagccagagttagataacaggaaaaagatatctcctttcctctcatcattgtcatcatcagtaacaatcacaataggtcccatttgttgagcaggcagatacgtgccttacacgtctctaatttaattctccctactcgacagctggggaaacaggctcgctaaagctccatgacttatccaagatcacacaaatagtagtggcagagctgggattccaactctggcccagttccttgaaatgttcccatttgcctccaggagagagggatatctatcttggccctgcagtgtgtacaaggcctggtacataggagacacccagaaaatacttgtttcataaatgactcaaaacatggatggacagtgcagggatgggtgaatgagtgagcaagttaaatgagctctgcttatctcaagaccagccccaaggcacacaggaagtggccgctgaggcaagaaggacctctcagctactgccccctcggtgcacgccactgctgctatgagggtctgtgattcagaaatgcggggagccaagcacctcaggtggcctcccctttcattcacctaaaatctgccttccgcatctctgggaaagcccctttccctgagctccccctcaggggtggcacctgccccaggcagggaagagggcctgatcctgcagagtggtgactctcccgtcgcgttaagacaaatgtgcatagatcccacactgggatctgtgcacagccactgtctctgggaatagccgtttccttaagaactctgactacgggtgtcactgaaagagaaggtgctgggattgccccttccccacaccccccttgcatttgggccttcatcagttttccccagtgagggcccctggtctccaagggaggactggagagagccagggctgtgaccagggcagctgccagtcctagcgaggctgccagccccatatcctggagcgcccagcaggagaggcggttctgagaaggcagcgagcagaaggacccgcagacgcagaggctcattacagggaatgactaagtgagctgcgcttccaagggaaaccccactcgcttctgctcgctgagacgctcatccttgagctattttgactaaggcggcttccaggtgctgccctccgctggggcagcccactgagagagcagccgggttgctggaggaccctctgcctggaagtcttggtcctggctattcaggtcgtctgacaggtctgccccacccgtttccagggcgggaaagtctgcccatcaccgattaaagtgagatgctgggaatgggggaaatccgatcagcacctcctaggtttttgcggctggatttcaataaggaatgtgacagtctcgcagcagctgtgccctgcctgaaacaagctctatttgaaacctccaacagctgaacccctcccagctacccgatggccagcccgcccagccacccccccaccaagccaccccctgccccaaatgacaaataaatagaaaaacccaagcaacaagcaggcgcatgcatacgtacaaacattacgcacatacacacacacacaccaacaaattgggggtgggggtatcgtggagccacttgtccaccgattcccaggtctccaagccttccagcccacagcaggagagctccccggcaagcagagcatcggcagaaacccaccttcctccatctccactccctctgggagggaaaccccctcctccgtcttggggctggactgagaggctggagcagtggggccagctccccgctaaagccagtgcctgctgttctccatccgggcgcgcactcacacacacactcatctttatttatcccaaggaggagttgaggtgggaggggagaactggggctgagctggggcgcgggcttgtggggaccgcctgggaagccctgtcatcccgtcccaaggagaggtgctcccccagctgattccaaggcggcgcccagctgctctgcccaggtaacacctgtagccatttttatcaggagatgtttacgaagcagcagcaggtttattctgagtcctctctcctgagggaaaggaccactgatttcctccacctatatttttaccccatgccctcaggagacccaggtcatggatggttttctattttgcccgagactctctgagaagaggagggaaacagaaacttgggaagagatggagaagacagggagagaagggacttgggcaatggtacggaatccccaccccccacccagacatttatttcttttttatcctcaggaaaatggagtggagcagggaggggaggaaagaaggggaagtcgcaggaactggcaaacacatgaaggcggagtgtaattaattggtgcgttaagctgctgggttatgctttagtacgagtgagccaggaggaaaagcgatttctcagaagggattattgaatcctccctaacagagagtctgcaaattagacacagtgtgtggggatgtcccctaccccccagaggaagctaggaatgaattctcccgggatcaagaaggaaaaccacgggaagttagagtgttgaatataactgagcaagcgcctctcaccaccaccaccacctctctctcccagtctccctcccaatctctcaatctctctctctctctctctctctctctctctctctcaatctctctctctcacaatccccctctctcaatccctctcttgctacctacatattccttttgttcaaggtataaagagaaaccacagcccctacctttgagtacaaaccccaagagagctcg

SEQ ID NO: 1973 - DNA, 4718 bp, Homo sapiens
cttagacctccaagcaagttctttaaaggtgacaagttaaacagtagtttttaagataatattttgatgaaatttttaatcatattattacaagattttagaagaagcaagatcttgtgaaaacaaaaccttaatgtccatatctagctctctaaatctatagtcagtctttaaaagagtgacacaaaaatgacacagatccgccctctggttcgctccccatatattagagcctggtaatcttccaaagtttttacagcatgaggcatacacagaatagatgcaaaaaaagtacaccttctgaaatttcctgaatggattcaaacttttactattctaagttaatcaattggtagtctacttactttataggattattgtaaggataggatcaatgaagtgaaatatattttattttcactggtcaattactcgtattaaagcaatttcatgcactttatctccctctcttggaaactggagagtagtactttttgtctggttacttaagattaaaaaaaagacaatatgtcacttttgacttgagtgtcatggtatctatggccttcaacctgcatggttttatcgtttcagtaatcttgggaggaaggtattattaagttcatttgataaataggagactgagcctccacaagggttaagtgaattgctcagggttatacaatgaacacttgatagaaatgattaaatgacactttacttgatttgttgtgggttactaaataaagcataggtgtgcataagtcattcaattattcaagcacattcttcatccctagtcctaatatcgaaagtctttgctcttagtttttataactacaaggatattcatcaaaagacccaagctcaggaataagcctaaagaggtagtcagactagaacaaaagacaattcacagacttaaatgaataatttgcattaatgaagtttgccaggctagtttccacttgaatcttcagatctttcttccttcattgtcttgttaactgtccagatttattacctaggagtttttgaaaactcacatattaggcaatagagtgtattctggaattgagagcctattttaaacttttgactaaaaagtttacccattaaatgtcatagattcaaccatcagactgaaaatcctcagtgtatttgaaggagggtattgtctcaaaaatccagagctcaaagtgaagaagaaaggcaaaatttggaatttagctctaagaccaactcatcagttcaggggtcagagatttatatagttaaaggacaagtgtgtgtttacctgagtttaaagagcaaagttgcctctggaaagaagccctcactggaggctctggcatttgaaatggtgggcaggagcacatgttgcttaaatttctgacagtggctggagattaccgattggttaggggagaggaagtaaagtaaaatatttataaattctccactgggtggagtctgagcagttctttgaatttctcaccctaagatctggcctgtacattttcaaggaattcttgagaggttcttggagagattctgggagccaaacactccattgggatcctagctggtaagcttgaggcgctgataaaaactctctaccctaatgtttactccatgttttttccaaatgaaacttctgtcagctagaatccttgtcatagtgttttagaggtttttttctgctactctcttctttttttatatatattctttttgtaaataaaaatggtatgaccttcctaaaggccccacctttagaaatgggttaaatgaaaagatctttactaatgtaatagaaaagaactgatgaacatagtgcactgaatatggttacatttgacaaaccaaagttagtcctgttcttatttgagtttaagcggtaagattaggtcaaactccagacgagggaaagatattcttaaacagattttaagtcctctgttttctggtaactttaattgtcttatgctgctagtagtcatattaaatatttatttagagaagtgaaaatgcctactcttgaacagagtttcttcccctttcattttatgaaacctaagaaaagaaagttgatacactttttaaaaatatactagattttcttttttcctttctgcttttattttgaggccagtggggtgttatttagtagtaacactgaagcaaatgtattgattttcttaacgtgttcagcaagtaattcatatcctagatatgaaatatacactcgtagcagagtaatgttacccatttctcaatgatatgcttaaagaatcttgctcaatatgcatattgtttttccttttttctttactaatgaaaaactacacgctttctcaacatatttttaagtcaggttctaaactttgaactcctatgtacaatttgcttatttcaggcatgaatgtgaaactgtgtaaagattaactaccagacactcagtcatttatttaactatttagccctaaatcagtgggtgactaggagattctgaattctgtgatttcgttaaaatcaatcagtttttaattattatacaagctttttactttaaagttgtagctgtctaaataaaattgtgaaagcacaatttccaaacctaaatcgaaggcacattgatgctgtccatcagaaggtattgataatttaaaaaaatattacaaactatcttttatctttttataaaggacctaatgtcatttgagcttaaccataatcctttgaagaaagtaaaatttaactttaaataacattgacatacagagcagttaggtgatttgtctgagaccatatggtatgtatgtcccccgtcttgataaaattaacactaaatatgtaacatttgaaaatttgtaaaatatgtaaaagttgaagtttttaaaagtttggatttaagttcttcctttcagaatatgagcatgtcactttatttgcaaactaaacatggcataacattatggcttgtgaacactaattgtcttagctgctggggtgaatgcagaattaagcagcaattagtatgagtgaataaattgcatccttagagtgagtgcactatgctattctgggaactaaagactatatttgagaccatgcgaagttgtgcaagtggtggagtagggcagggtgcagtcatttggaagactatgcccatcaggtatctcaaggtaccccagatgtgacaggcccaggagcggaaccagccactttaacttttgcctggctgaaactggactgggaaggatggattaaaaaggtaaatcaattcatacgtagcttgtggtcctttgcagcttaagtgtaggactgaaaaaagaagccaaagaaaaagggaatgagctgaagaaatacacacacgtacacacacacatcaggaagcaacaggcaaggaaaaataaagtgagaggttcaaggcttcgaggaggaattgagctctgtgcattccattcatgggctttgccaaagaccagcacaatggactcagcatctcaggcatggttaagtaccctactgtgcactctgctatccttttagtccactggtttctactctgtctgtgccaggttttcatctcaatatagaggaaaaggattctgatgcctcaggattattacaagcattaaataagatacagatagaatgacgctaatgagtatcatttttaaaataaggaaagttgaattttattcagaatctgttggtaacaaactaatctctttatttaagtaaccccacttagagtttaaagtcacctccaatcaactcaaagggctgacctcccaaagaaagtctcaaatataaggcaagctctcttgattctgaatttcattagaaatgtttgtctaagtctttctcatatggtcagaatgagagagggtgcccttctagtaatatgtcattatgtcaaataattcatcaaccaattttgtttattctctcgaactgccactttggcggcaggggtactctgtctaaatgagatgtctataaagataaattaaacatgattcaggcccccaggtagagttcagttcagtagggtagaacagcaactcagtccagctaccatcagtaatatgtttgtagtaagactaatctgatagtaaggcagaaaaacatctcatggaattttaggaatagccaagaagatgggtcccctggagacttgcacatagcatgttgcatgaaggattcagtgacttgcaagatgggcttgtcttgtcaccttttcaggagacatagctgttcaatcccttgccattgtgtaactaagtgactcttacttgctgctggaatcacttcatgcttttcatgctttaacaatcagtggttctgttttactttgaaaaatgagtcattctatgacagtattcctcctagaccctagcatttcatagcttctatctatgattattttaaattctagctcctgtatctaactgaatgaataagcacatcccacagctcagattcctgaaagaatttgattatgtactcagctaaacatcatcactgtttggttagagcttttatagcaaataattcacagatctttgatgaaactacattgtctttagtgggtaagtgtccaacagaggtctaataaactatgaccaggcaattgataatgccaagcggtagagacacagtgatctctcttcaaaatgcagtttccttcatcagaaagctatgtgtgg

SEQ ID NO: 1974 - DNA, 767889 bp, Homo sapiens
aataggaatatcatggtaaacgttgctttaattgaacagtggaatctatgctagtcttcatgacgaaccttgaaacacaagagtgctgcagtaaccatcattcctgaattgtggaacttcacagactcaggttagccccaagtgatgctttgctgagcaatttaaaacccagtcatgcaaagccaagtgctttcatgtttgagaaacaaaaacatttcaactgctcagcacatctaaatcagtactcccttaacaacccaccttggttcttccccttgattctgaaagccaatttagtaagaaaagcatattaataatcttgccctctcactggccttccctccctccctcctattccagcatcttgcagctggtaccttgggtcatttgttttgtttttgtcccttaggctgaagtgcgtccacagttttgaaactgctaactagagtttatatggaaaattcagattagaaacaaattcaaatgcactctctcattttcctgtaatacactgggtttcttcccccaatcagctagaagacttgctgggtacctcctcattgtgtcctgttggaaagtgtctcttctggtcaccttgactgttaaataagtaaacagactcattggggttgctgtgtcctgtgacattggcacagactctcaccccagccaagcatgcacatatcaatgggccaccatctgtggcagaattaccagacccaagatggaatttgatgcatctgtcctggtgaaatggcattatacttctgccatattcttctggttcaagaacattgtcctcaagcccaagggacagccctgtccagcataaacatgattaaaatgcccattgcccgactgccctgctgaccaagaaacatggccaagcacagagtctgcaagcagcctgcatgtgggtctaaagaagaggaagggggaaagtgtttccagaaagtaaggttgccaagatttgaatctcaatgtcacaatctggctttatgaccttgggtgagtcccttaatcccacagagcctcagtttccccatctgtaaaatgaagagtaccaatatcctgatgtgttgtgaggattacatgagatcattttcgtaaagcaccctagcacagagcctgatacagtgtcattgggagctaagatttaccagcactcatcatataccaggccttgtgcatgaaccccacctacattatgtcattaagcatcactgcatgcataagaaatgggtgttaccatccctatgttacaacagagaagactgatggtcagaaaagttaagtaacctgcacaaaggcaaggaggtagagacgagtgaacttaggattggaactcaggactctcttaaccacatgaagagaatccaagtggaaggtgcctcctaccaacgctgagatgaggttcgtgtctgtgggcccctgtctgaggctggttgacaagaagctttagagagacgcttggggatggcaggcttgcagccagaggccagggtttgactcctgtatgggctgtgtgaccaggggcctctttaccgctcgggtgtgcttcacctccttcctccataagacaaggacaactgcatcttccctgtaagactattgggaataaaacaatagggctttgtgacctttgacctaaggtaggattcttatactaccccatgctctatgacatgataagaagacagtaccaacactcagcacagtgttaaaagattccagcaaataataatggatactaacataataatagctaccatatatagaatacattatatttcagaaactgtactaaaaccttaattaaagcacttaatcctcaatgcaaccctgtgaagtagatgctttttattatccccttttacagatgaggaaactgaggcatgtaatgattaggtgacttgctcaaggtcacaaaactaagtgctgaaaacttgggattcacatggttgcatcaaaactttattgaaaggattggtcaatccaagtgaacaacacatctggactgtgccccatagaaacaagcattttagtttcactagaatcaccgggataaacagaggcaagctaacccctttactacaggacatctatggtctttaacttgtaaatacgaggaaaccatcaagagggagatagagtatgcagcctttcctgagctttgaggggcaacagtgtgctctgacatacgattcgagatgtaccaagtctgagtcatttaccctaaatagaacagccttccattggctgttggaaacacaaagtaaaacccaaagaagagagaaagcaaaagtgaagaggccattgtcctcgatcctttatcttttgttctctgattcagatcaggagaggtgtgtatgcctgcagacctggacacccgcaagccacatgctgaatgaaggcccacagaagtcccaaaaaaagatggaaccagggaaaggaggtcagcctggaacagtcctgggaagctgagacccagcccagaacctgctggaatcaatagtctttaacacaactgtgacattagcttgggctgctgggatccgtcttgaaagaagaagctttgtatatttctgctcttattccccacaggatccagaaatatatttctgtaattcttttagctgataagtatgaaaaacagaattttaaatattccagtagggacctgacagaacagggccatcttcattagctgctgaatttcccaatgactcctagaaattgacacaattagacaaaattaagtgcttctgtcctgaggataggccgccactgttctttagggcatatctttgcaaaggaaggtgctggaattcctcacaaaagccacatccctctctctctcacactctttctctgagcaaatctaaaatctagtgccaaattccttggagctaattctaaaaccaggaaagctttttgtaagattataaagattgtattggactttgaagatgagtccctttgctcagcaacttactttcttaatgcaatccctgaattctccttgctatgctctgaatgtttatgcctgcccacccccaattcatacgttgaaacctcatcaccaatgtaattatattaagagatgaagcctttgggaggtgataacgtcatggagacagagctctcatgaatgagattcatgcccttataaaagagcctccagagagctgccttgccccttccaccatgtgaggacacagcaagaaagtgccatctatgaaccagacagcgggccctcaccagacaccaaatctgctggtgtcttgaccttgaactttccagcctccagaactgtgagaaataaatgtgcttatcagccccccaagtttatggtatcttgttacagcaggccaaacagactaagacattcctccatcctcccatcgactgggcaaaaggataatattacttccatttctatggtgattatggaaactcagacccagcaagtggctcccaacccactgggtgagtaagcagggaaactgaggttaggaaatgaactcagttccttttctccccatcatcttttctcccctataagaaacttatcagcagttcttttgcatgtagagtcaatcagaaaatcattagccaaggtcagacaagaaaccacagctttggtttctttgatttcaaggttagaataagagcaatggaactttaaagagcatggatggtagtaactgtctctgagaagccagccactcaaactttccaggcccagaatcaacatttatttggaaaaactttttgttgtccatttttttaaagagctctaaacttccagtgagtcttatgtagatctatttatatgcccatttcttcttttattttttgagacagagtctcgctctgtcacccagcctggagtatagtggtacgatctcggcttggctcaccgcaacctctgcctcccaggctcaagcgattctcctgcttcagcctcccgagtagctgggactacaggcgcctgccaccacacccggctaatttttgtatttttaatagagatggggtttcaccatgttggccaggccagtcacaaactcctcacctcaggtgatccaccagccacggcctcccaaagtgctgggattataagcatgatccactgtgcccagcctacatgcccatttcataggcaagaatactgatgcatagggcacaccacactttacaggcacaagaatgaacaagtctttagagggtaactatttcttgtgcaagaatcaaatgcaactgctgacacttacagttttatcactggtgacagcatgagtggctgagtgagcaggatgaatcttgagcctggggtgtagaccagagcaggggcttccaggtgctcacacctctggaaagcaagaggaactggaacagttggagttcagaataggctaaaaaatctcctgccagtcttcacagcagaatctctgagtggagcacacagccattttgaagttggcctacttggatgccagggctcaaaaattctaatgtggccaaagaaaccttcagagaactacagcaaattcaactgataaatttgttctactctagaaaagacactgccaaaattccagtccctatctatcagggaccttggataagtcccttcccctgcatgcatatcatcacagaccatcctcatatgggggtggggagggtgtctctctcccctcttcagctgccttcctacctccaggggtgcaccaattcactgtgatgacctcacaatcatgcctggtgattatgaggacttagtgggatgatgctctgggcaaccacagggattgctcaccggtgactcagtggttgactcaaaggctagagggtggtttgggggtggaggcagaggtccagtgagctgggctccaccctttctctccctgcagtcccaactccatttttatctgtgctatatgttggagtctagccaagatgtcatttgaacaaagattctgaaagatcaaagaaaaaagtttgaaaaccaccaggacaatgctttcaggggactttatccaaaagactgcaacaatgtaaagagatacgattgcttttattactgtgatatgtttaaagtattataaattttttaagagctttgtaagtgacagaagtgaagacatgctcattttaatgttaccagtcaactctgagaagactaaaggtcaagggacaatgaaaatgtgacccttaccaacgacagaaactcccaggaagccacaattaactcaagaccaccaggatatttggggaagtttatccttctggaaaccagaatttctgatttgtggaaaattctatagatattctctgccagactccagcctatttggtaagctggccacagatgatttagaacacaatgaccctgatactcactagagctctgagtgtggctggataagcccatttcagcagcatgtcagcccctccctgaactaggctctgtcactcagatctcagatcttagggcagctgtagtctgccccttgctttcttattaccccagataaccaatgttatcctctgtttttccttcctcccagggggaaaagaattcagaaccctagtctgagtatatgaattagactctgcaaattgtttatatgagtcattctcaaaactaggtctggagggtccccaagagatccacaaatttcttgcaatattcatgtaacaatgttcatctctttagatctattaccattgagtaacccattgatatttaacaacaaaacaacagcaaacaccatcctgatagctttaaaagcaaccctgttcttctaattgtttctagtgcatgctttttgaagctaaactagtagactggattgtcctcaagtagactggctcaccaaaggtgtccacaacaagaacatttcaagttcagattggacaggaatatttatgagggtttgaccagtgctagacttgccagacaatgtgcctgaatagtctccctgaacttctctcttaaacacaaacaagatcctatgctggctttctggccacacctgtgccagccacaaatgggctaaaacacgtgaaatgtgctgtccgcgtgcagggttcaaatcagataacaaaatacacattgacggttctctatagaatgaaaaatatcctactttcattgcatgctggtgttgggtcagaaaacaacagtttcttatttctcctggttagtggtcctttggaaatcacagaggaaatacatgcagagagttaagaggactacttcacatctgttgtcccgtgatgctacttaactgaacactacactcatgtgcccattcccgttccctttcccctttatggtaaatgttgtcccatatgactttgtgattgatggaaatgttctctatctgtgctgcccaatatggtagccactaaccacacatggctattgagtactcaaaaggtggctaatgcaaagagaaactgaacctgtaatttcatttaaacttaaacaaccactcgtgtctagtggctaccatataaaacagtgaactaagtctaaaatttaggatcttgcagtacagggtgtgtgtgtgtgtgtgtgtgtgtgtgtttgtgtgtgtgtgttaacaaaacaaacactgctccttctgtagtgagcactggcctatggccagggtctaaggaatatgcaaaagaaagtgactggaagttttaagcttttaaggttttatcaaaagacatttcttaccactccctctgggcagtactgtagaacatctactagggagaggatgatatgaagatagagaagcaacaaaagtacagacacattagaggcaaaatatagatgccaccttgtaaactggttgataattcagaaaatgacagctctccccgacttagttggaaaggcaaaggccaaatgggaaacatcagtctcttcacgtccatggaagacaatcccctgaatgcaaaattagaacttggtggctatttcctgatccagccccttgtatttttcatgaagcttaaaggagattaatgggacaatcaggatattacagatgagaagcacaggcatttcaaatgaggctgtgacaaatggctgggaggcctttagaatgggggaagagaggatgtggaacaagccctggactgggaagctcctcactatgattcacaccctggtcctgctaatgaccacctggccaggagaccctggagaggcatccaacccttccctgagagccactggacagaggaataggagccccatcactgagtggttgtagggctcaagaaggatcatattggcagcaagaactccagaaactataaagctctatttagatgaatcacattattattaaacagttcaatcaacataataattattaataatagctaagatttattcagtgtctgctattgccagacaatatatatgcaaagtctctagggcttacagcaaccctataagatatgtctatctatccacatcattcgtgcttactagatgctgttacaagtgttttccatatatatgaaggtatatataatatatacatatataatgcataaaatttgtaaatgagttaaatgaggattaatccttacaacaacctataatgtggacattacttgtatcaatattttacagatgaaacaattgaggccaaagagataaagtgacagccaccatcatcccaactaagttggaaggccaaatgacaaaaggaaacataagaacgcaattacctgaatgacagattagaactcagggattatttcttgatccaggcttagtcaatggaagagctgggacatgaacgcaggcacagttggtgaacagtagagccaggattcagactcaggcagcctggctacagggcctgttttcttcaaccccatggcatcctgcctctttttttgggggggggggtggtgggggtggaggggtggggatggagtcttgttctgtcacccaggctggagttcagtgagtggtgcaatctcggctaactgcaacctccgcctcctgggttcaagcgattctcctgcctcagcctcccaagtagctgggactacagatgcgtgccaccacacccagctaatttttgtatttttagtagagacagggtttcaccatgttggccatgatggcacgatggtctcgatctcttgacctcgtgatctgcctgcctcagcatcccaaagtgctgaaagtgacagggtaaggatttgaaactcaggcctgcctgcctgtctccaaccactcagtcttttcttcagccaccctgcgtccgttacaattcacacactgtttgtcaccactggctaatggctttggatatttcttcctcttatcagtgtgagacatctggggaggctcccctttttttcaccatttgaggactgaaagtaaatttagcttcctcagcagaaagaaaagaagctgttttggaggttgggaagagctttagaaaatgcggcatcacgtctgttgccccatttgaagaaagcagctctggaaaaggcctaggacattagttgctacaaagttctagatcattctgtgtggtaagtatgccatcatgcccatagcactcttctctgtccacaaaattcgtcatatactaataaagaatgggtgtctttggacaaagtcaaagcaagtttgtccagagtactaactaagaagagactacagagggaagcaaaaggtagttcagtggctgaattatccaaggaaaggcctagaatttgagttgtcatagactgagcatcaaagattatgtcttggagctatatagaacctttactgcccaaaaaagagagactatggaaacttcagtgctctggtaaacatttctttgatgccttaccaaaacatatgccttctgagcatttgatatggtttggctctgtgtccccacccaaatctcatcttgaattgtattcccataattcccacgtattgtgggagggattccgtgggagataatctgaatcacggggtggtttcccccatactgttctcgtggtagcgaataaatctcatgagatctgatggttttatcaggggtttccacttttgcatcctcctcatttttatcttgctgctgtcaggtaaagaagtgcctttcacctcccactgtgattctgaggcctccccagccatgtggaactgtaagtccaatttaacctctttttcttcacagtctcaggtatgtctttatcagcagtgtgaaaacggactaatatagcatccgttgtccacttcctccttccatcagtctgcaaaattccatttggggatccatgtggcttcagggaaatcaactttatcaatgttctctgttccgtggcagcagtgatgggttcagggatgggcatgtgacctaagccagtccaatcagagtgactctcaggtcttgctgaaagtgcctggaaacgatgccatttccttcctgttgggcatgatgaaggaagcatctagccccaggagctccttcagtcatattagggcctaaaaggtgccagcctttgataaagacaccaaaggatatgaaagatagcataagacagaacggagagatggaaagaagccagatccttggtgatattgttgagccaacagatcaagtttggccttaagtcagccctaattctgtgcttttcaattagataagacaatacatgccctttattatttaagcctatttgtgttaggagttctagtctttgcaaatgaaagcacctaactaatactaatgtagatctctgtggccatccttctggtaaaaggagaaggcagagtcaagggtgacattacatttcctgaaactggcagctccatctcatagaaaactcacgcattactcagtgaaaaaacgaccccctgtacacaatatccacgtgggaaactcctactcactcatcaagacccatctctaatgtcccttctgtctcctagactacatttacgtaaaattaatcacttccttctgttttacttccatagaggcatattactcattcttttatgtaactataaacacagagcaattacatacagctcaagggcagagaatgtcttattcatccctaaatgcatcaaacccagcacaagcacatagatgctggattctccaggttgcatggcctttaacaagttctctaccattctgaccctgttttctctcctgtaaaatagggctaattgtatatgtcagaggattgttgtgaaaaatatcaataacggaagctacaggaatttcactaaaatgtgtttaattatagtaaaattaaattgatacataattttgtaaatcttcaatagtctttagctcaatattgatagccaaaaattaagcctggaggatagaaataacttcttaactctacagttggaaaagtgtgggcatagaacttgtctttgccttctagatcaggtctgtgttggtaaattagacaccgtgtggcctttcaacatccaggagcaagatggcaggagaatcatgccaacaactgaggtaccttgcaggaaatcaaacaggaagaaatcacccaatgggatcagctgggcaaacatgggtcaccccaggtctggtccctcaagtctacccaaccaaaccatatcatagtggatagctattatctttacctgactagcattcattgccccttctggtatgccctattccccactctcaatccctctgttttaagaatgcgcccacctccaccttccatctccaggagtgatatccacccaggtttgctcagtaagactatgagacctatcttcctggctgtggtgattggttcagaagcaacatgccaaccaacctgatccaatgagagtgagttctaggacttttgctggaactactgtatgtctatatataaaagagaatctatctttctattgaaagccaaaggtaagaagccaatatgatatgcatttgattctgttacggaaatccacataaaagaaggctgcccaagtataaaaccaacacagaagaaagcagaggtaagagatggaaaaagaaatgagtgaaccagtgacagcaagagactgaagaacatcatttgattgcctggaatcagctaagcctgaagagaagcctaaccctaagcttttcagttacccaagccatcaaattcccatccccatttttttggttcttaagcagcttgaaccatagttgtctcacttgcatgcaagagatccctgaagatacatgcagttcctcaggtgaagattgccatcagttaacagatcctggcacccatggaccctgggacagtcattctggtagcatcctctggtagagaataacatagtcaaatctgacagtcagagagtatctgccagcctctgcttagatatagcccactgaaagggagagatgattaatttagccttgatttcaaaaccttgtcttgtatattccattcagcactttttatcttcctgtattcccctggttcctctctagctgaataaagaacaatttttaaagcaaacatcttcactgtgtatctagcaaagctttctgcttcattggaatatgtgatttatttaaaaaattaaatttcccatgagacgcaataatttaaattaagagaaaagcttgtctttcttaaacttcagtttctacatacaaattgatgttttatagattccagaaactttcactgttatgaagatggctctcagttttcctgctggattcagattctcttcatgacttaaaacaacatgaggaggatgagtcacaactgtaagctggtgaaatgcagaaagaaccacctaggaattcaaatgtcagcttaagaaagacagaatggcttaaaaatcaaagatgagatgaagtggactgggggtctcgggaacaccaagtcacaaaatcagcttacagtcagagggaacttgcaaatgatctgattcaagatacaaagaaaggttttagttcttgaggactttttccagataaatatttgagccaaagcacaatataagaaaaagatgcaagtggaacagctccttcaagcagtgggggatgttaaggaaaagcagggaaaatcagctgagaatcctccgtcccacccccaagactcctgcaacctagctgagagccacagaactggtcctctctctccggctgttctccaacatcccagagccttaggtggggctacactaagaggaagtcctccaaggaaactctcaggattagaccagtctttttctgctagtggtctttgataagcctacatggtaaagagtgggattcactgacttatctgtagtagatattattaaatatgtctcaaagcatctcccccaccttctcacacccacccattagaacaggatgttatctacaggctgatacctccccactccctccacctcccttctaatacatggcaccaagacactgcctaggacctaacaagtgattggcccctccttctccaagacattcccctcttcctttttctcttttaagcccagagggcctgaccctctaacgcctgtcccagaccactctctccctccaggagcctgccaagttgaacacaaagtcctaccacccctgccctcaacacagacttctccaaaacaagtccacaaacaccattcaggatgattcctgctaagacccacagggtgggagtgataaaatttccagtaacatctaccatgatattacttacaatcctaaaagaggaaatgttctgtattacataaaacatgtccaaggtcctcctacaagtacgagtgaatccgtgcctggttcttctttgtcttcggatcctgccacctcatccctgtcgtcatctgtctaagttttgctttagaagccaccctcggtcaaaccttcactctcttacacaatgagctgggcatcctcagtttccccttcatgctaaaagtaagccccatgttttgtgcatgtgcccacaccatttcctcaagttcttgctcctaaaggtaacagggcctgggtaaggcacttcctgcagagatcaaaggagactcgttcacacccaggaggaggaatattcttcctgttctaccccatttaaccctgtcccctcaacccagaggtgtcctcactgtccagcaagtgcttcaggcctgcagttctgctgttaccctattttgaatctcataggtgtggaagcatgtgttggcggggaggggcaggaaggtttgtccgccaggaagaagaaacgagtgtgtcggtatgtgtgtgtgagcgccgcaatgacagtgctgccaccgctgctgctgcatgtgctgggtctttgaatgtggcatctgtcgggctcagtgaggatgacagatgtctctctgctttatgaacaaacaacacaggcctgtggggtgacaaaaacagcctcagcccaaccagagcggagaggtgcagttctctgggaataatcagaagacagcagcgtaggagtccagagtctaccacacacctgctcccctaaaaaagcatgttctcattatgaaaccttagaaggcagctcccacgccagggacaagtataagggagcctgtgtggcctcattcattaccagatgaaccactcattcagggaagtcttgaggcatgtccaggaaatggcgccccaaagacccagttaacccacagggtgagtgcccacggagatgggagctctgggggtgacactgttgagccagtggatcaagcttcaccctgagtcaaccctaattctgtgtttttcaaataaataagccaatcaattttcctgttcatttctgtatccccagcacctagaacagtgcctggcacacagtaggtgcccagtggacattcgctgaaagaacaaacgaatgccaaggcagaaaatgggggtgagaggcaaagatgtataaaaaaagaactaagcagagcaaagcgataagaagaatattaataatatgaaccacaaagacaggaaagtcatctgatttcaatacacaagagtataaactcattatggatgctgaattacactagtgatagtttaaatatttcttggaactgaatatgcacataagaagagcccatcccaggcttgaatgagtgcacattcttgtcttggagaaaaggaagaaaaatatataaagcaataggtacaatacaatgcaacagatgttctagaacaaaggcctggagctatgattccagggcagcctgcaaagatctcccagtggagctgatgattagcaggccttgaagcaaggatggaagcctggcaagaggcaggtcagtcatcacaggcagggatgacagcttccaagaactatgtcgtctgtgagcccaggggccagagagctgctgggtttcccagtctttccaggctatggccaaactgatgaagccatccttgtttcagtctctgattccttcagagaagaagaaagagttgagtctagcagagtctcactctgcctggacgcctgctgtaccaggagagcactccctccacatgccactctaaacagaaatactccccggagcacctgggacgaccggcatcctctgcacttccaaggccttcactcttcccagttttgcttacttcttctcatcttcccattcacttcccagatgtgtttctcgggtctccaaagggaaactcaggggagaaactgagtcaagctactttaaatctcctttcctacctggccctttccacagcactcagcccagaagaggtgctctgggtgaaacaaagcagcagtcggaatctctgcaggccacagggagggagggacgggtagaatcaaggagtggggcactagcacggaggcctgagcctcctcactgccaggatgagggagccgcaatgatctggggtactggcagctctgggagcctctgaatagtgaccctggggctctcagaagtactaggtcaaggtgtcccggtgggcacagctgggcttagtcatcaagacatgggtacaaacctcagctcagtcaccatccagctgtttgagtctgaaagttacttaatctctctaagcacagatgttctcatctatgaaaggactataatgcttgtcttgcggggatgttgttagaattacatgtgatgaggtctaaattgctcctagtacagaataggcaattggtaactcttaactactattagtgtagtattatcatgatcgtcatcgtcatcatcatcatcattggggcagacaaatctcagaccaggcctgagaattcccaactctgaattcagagccttttgctccagcaacagaaatgagaaggtaaggcctaaagtagaacaagactagaggaggccctgaacagtgctgggcgcccaaacagggacttcctcccaggaggcctctgtgccactggcctggggtctcatcatcaccgccagcaacagggtgactggctgccccctggattttctgcaagcaaagaacaggagggcagagcagaaaagcccgggaactaatgagattcagagagctcgaaaattagaggtgcacgaaaggagtttccgcctaattgctctgacacctcccactcccactgccgagtcactgcaaggagcaggcgagtgcaggagcaagaggggatccataggtctgctggtccaggtcactgctctctccaggagcactggctccagttgggagtggcccagggcctttctgcggcctggcaggacagggtggccactgcccgtggctggcccagaagagtccaccttgtgggtcaagagctgcccaggctgatatgtgccttaaaaagcgggaacgaaagcaaggcagcacacagcaagcccaggcacctcctcagccttgcaaatgggagctggtgatatgggctcaggaactgccatttctgacccagcccagacaaatgtggcccaattctctgttcccttggagctgagcccatttgtagccatgccaggcccagggtctccctcagtggctgctggcagttgatagcagctgtccttagagcctcagctgcctctcctgcgctgtgtcctccctaaggggcttccagatcggttgtctcacgcgaggctcccagcaggctggaggagggcaggctggcaaggcagccacactgcccctgcatcacagaggagaggagggtggcccactgacaggccagaggcaaactgagacccttccgatccattgtcccttccctgcacccccaagaacaatgacttagccccaggacacatccttaagaagagggcatccctaaataccaccagcccccaccccctatccccccccaccccccccaccccacacacacacacacacgatgctgggataggctgtgagacaatatggaaacagccagaaagatttgcattcaaatccaggttgtgtcacttcctgcccatatgtctttgggtgctttatgtaacccctctgagcctcaactgctccatccataaagcggagcatgactgggagggataaatggaatggcaagaggaaaacacagtgcccagaggacagcaggctttcaataaatgtgaaatgctctcagcatggccctgcctgacgtcctgcctcagaccccgccgtccagctcacaggacaagccacagccttgtaggacactagaattgctgccagtctgccttcagttccctttgttgtttaggagtctcccctggactatcagcttataagaagacatgtatccatcacaagggcctctgataaatctcttcacggaccgcttgcttatatcaagaggcagaacatttagaaaagacatagtgcctgctgctgtctgggccaagccatcccacaagcaggctgaagtgtgagagaggcagatacattccctttcaaaatgtctatggtcccctggtccatgatataataggagagatgcacagctggcttagcttgcgccgtctcccaatgcggacaggcacctgggagagccaagatcgttagccctccaggcaaaccattcaagtcctcgtgctgtcaaggtgacttacaatattgagagtagtttgagattgttaagaattattattattttttttttctgaaaaatacacagtgagtttctcaactccagtttactccagctaacaccacagctttactgttcctcttccaatcaatagtggaatgaaatgatccagttggaattccagttcaggccacagagctgacatcttctggattcccactcctggggattctcagacccaaaggcaaaatgggccctggtcatgggaaagtccatggctttagatgggcagaatctgcagccactgaggctgcagcacacagcagggaccaaagccaggaacagccaaggacactcaatgccactcctgccttatgccagccctcagggtgagtgcataagctcttcccataaaaatggcatttgcacccttagtaaccttttattcaattcaacttcatctagtcctagtaaatagaattacattacttccttgcttaaaacacttccatggtgcctatgcaaaaatgtaaaatactttctctggcacacaaagcccacatgctcttgccctcctctccagcctccttcatgccagtcactggcttggccatccaattcagactccctggcttcacttctccttccttgactgtgcgtagctctttcttgctttgtagtgagacatacactcctccccgtctttgtccagttaattcctgctcccttttctggtctcagctcaaatgttgcctcctcaagaaaaactcccctgactgcttcccagtacaatttattcccactcctgcccccttctctcctatagttccctgttctttttaaaatggacttgtcaatatgcatgacgatatgtttttgtgtttattgtcctcgctctctgaccatgtaaactctatgaagccagagagaatatcttattctctcgaccagtttgcacaatgcctgacacctagcagatcctcaacaacctttgttgaataaatgtgtccatttattcagttctccaatgtctgacttcattcaatcacttataattaaaatgccaatttttataatctccatgaaccataaattaagaaatcactgtgcggccgggcgcagtggctcacacctgtaatcccagcactttgggaggtcaaggtgggcggactacctgagatcaggagttcaagaccagcctggccaacatagcaaaaccctgtctctactaaaaatacaaaaattagccaggtatggtggtgtgtgcctgtagtctcagctacttgggaggctgaggcaggacaatctcttgaaccccagaggcagaggctgcagtgagccaagatcgtgccactgcactccagcttgggtaacagagcaaagctccatctcaaaaaaaagaaagaaaaaagaaaagaaaaaaagagaaagaaaacactgtcttccaagctgtgactggaggcttacattaactcatttatatttgtagttagtaacatcaccatttttaaatgagtgaaccctgaccccaagaagctaagtaaccttataagtcatagaatcagtaagtggcaaaaccataattgaaacctctggctcataacttctcacttttcctaccaaatgacacaagtggctacaacctgagtggccaggcctgaatgggtagccagtctagaactgccttggtccccagccccacagcacctgggacaagacccagagtggcatcctcctcctccacagcagaggagactacttaggcaatgagatgaaattggcacgtttacctgcctctgattaaacagagtttttactggacagcagttgttgaaataatttgggctataaataaataggaaccgggctagaatctgaacctgcttacaaagctagtccttttccatttgagtcataacaaatccaatccactcggggaaaaattaggaaacaagggggaaaagctttcagtttctgtagcattttaatgaaggattgattgaggttttatgcagcaagaagggcacagctggggagtaattgccaagaaaattgaggtgcaagagccatttacatagaagaatcaactaaggttcctcaccagtgctcaactgaaagcagtagcaattggaccaaatgacaagcatcacaatctcactctctagcaccccaccctaggaaacaaagccaccttgtcactgtctccttcaaaagtaccacaacccaacccaagacaggcaatggcaattcatgtgcatcctccactcccaagccttcagcaacctagatactttgtctggggaccttctgaagaggaggctttagttgacttcttcaagatcacttactaccatagacgatggctaaagcaggactgaattccagatgttatgatcctagagagtctctcaatcaatggtagaactctcatgcacaatcttctttggttgggggcagaggaggggtaacttggagcaggtgatagtgtggctcccgacaggctagccactttacaaggattcaccttctgtcccttcactatgtatcagaagctacactttatggccacgttttgtttcctcttttcttcctcttcctctttactgtacctccatccatccttttatagtgccgctttcaccttggtgtgtgaacttgccgctgacttcccaaatgagttctgagaaccgatttcctgtgctttgtgctctgtgatggttcagcccactcatcacacctctcatggagatctctggcactttggtgggccctacttagaaaccatcttcctccttgatccttcactaacaagttctataatcttaacctcccagggtctcagttatactacctgcaagatgggcagaagaattccagcctagatccccacacaaatgtaggaaatccaaagacaataatatataagggcttggagaaaagaataaaactcagactgcagtgaggtgaataattcagtgcatcctccttatgcagctggagttaattccaaggaagcactttgcaaattctcaggtactatgcatgttctttctttctttctttttcttttcttctctctctctctctttctctttctttctttcttccttcctttctttctatttttgagatcacgtttctgtcttgtcacccatgctggagtgcaatggcacgatctcagctcactgccacctccgcctcccaggttcaagtaattctcctgtctcagcccctggagtagttgagattacaggtgcctgccaccatgcccagctaatttttgtatctttattagagacagggtttcaccttgttgaccaggctggtctcaaactcctgaccttaggtgatccgcccacctcagcctcccaaagtgctgggattacaggcatgagccaccacgcccggccacatgtgctttttaacatttttattatttcatttttggagtcattattatttttgttacaccacacaaattgcaataacattaagagattgagatgatgatggtatgagggtggtgttggtgatgacagtgatgatgacagcaatgttgctgatgttccatagtggtaatggtgaagatgatggtgatactggggagatatgatggtggtggtgatggaagtgatgcttacattacaagtccactctacacacacatgttctttacaaatgtggatgaaccctatctcctgcatggagtgggcagcacagattgtggaggaagctgttttccttccctggcatcttctgttcttggaaatcaatgaatgtccttcattattttccccatagttcctaagaggatactttcctgcttctgaaacattcactatttctataaagtcagtttgtcttcattctgtaagctcctcagcaaccctcactatttgccatgatgctggtcaccgggcctacaagacatagatcttgtctttgaaaagcctgtgttcctagggagagaaacatctgaaaagtgaaagaacatgagagcaaaatagcatgcatactgcattagaaggtgcaccctcattccgcacgggtgtgtcagggactggcagggtcggggatggcttccctgggaaggtgcctttcaagctggccagtgactaaggggtcactcatcctccagggaatgggtggatagagagcactctaggccacaaacaaagcagagaatatacactgctgtagggtatgatctgagggatatgggagatttcaggggaaagagcttactttaagttttttgaagtgataaaatatttgaattttatcttggaagaactatggatccgttaaaggtctctcagcgtaggaatgaaatgagctgaatctgcatgttacgatgtttcctctgtagagcctaaccccctccacttgtgttcccaagagccccagcatcactcaggagcttataagaaatgcagagtcccaggccccattgctaaacctcttgaataagaatctgcacttttcaaaagtttcattttctaaattactatacagtaaatttaattttttatttttggtgtaaagttctacgaatgttagtatatgtgtcaatttgtatagccaccaccataatcaagatacagaacaactctgccccaaaaactatcttgcattatcctttatgatcacacctatcacccctacccactaataaccactaatctgtcctctgtcactacagttttacctatccaaggaagtaacataaatgaaattgatataatatgtaacctattaacgctggcttttttaattgagcaaaatgttgttgagattcatccaagttgttgcttttatcaatagttcattcttttttgctactgcatgtattcatggtaaggatgtatcacagttgttttagccattcacccactgagattcttcctagttttgggtaattatgaatagagatgctacaaacatgtatatgaatgttttttctgtaaacttaagttttcatttccctagggtaaatatctagacattgaatttctggtaatatgctaagtatatgcttaattttataagaaaacttctaaactgttttcctgaatagcaacattgttttgcattcccattagtaatgtctgagagttccagttgccccccatcctcatcactacttggtattgttggtatttttatttcagccattataataggtgtgttcacatctcatcattgcttacacttgcatttccctaatggctaaagatgctgatgttctttttctgagcttatttgccatccaaatatcctctttgatcatgtgtctattcaagtcttttgcccattttccagttgggtagcttgttctcttcctgttgaattttgagagttctttatatatcctggctataaagccttctgtaatatatgtgatttttaagtattctctcccattatgtagcttatcttttcattctcataatagtatctttcacagaataatagtttctaattttgacgtgtctaagtgatccatttttcttttgtgaatcatctttttggggtcatgtctaacttacctaagttcagatcagaaagattttctcctatgtgtttttatcaaagctttatagttttacacttatatctgtgatccactttgagtcaatttttgtataagacatgaagtttaggttgagctttttgttttgttttgtttcatttgcccttggatgtccaattgttccaagaccattgtagaaaagactccttctccattgaattgtctttgtacctctatcaaagcaattgaccatatttgttgtaggtctatttttggactctagtctactccattgatctatgtgtctatccctttgccaatatgacactgtcttgattactatagctttatagcaagtgttaaaatcaggtagggcgattggtgatttcttcaaatatacacttctttttcaaaattattttacctattctagttgctttgccttttcacataaattttagaaattggtttgtttatatctgcaaacagtcctgcttagattttggttggagttacattaaatctgtagagaaatctgggggtgagctggcaccattactaggatgagtcttccagtccatgaacatggtatgtcttgccatttctctaggtcctcagaatctgcatcttaacaagaatcccaggtaatttccctgtacattagagtctgggaagcacagctctagagtggaaatgacagtgaagtcatctgggaggatttacaaaatatggaagcctagacctcactcagaccaactgaataagaatctctgaagggggacctaggtgctggaattttttctatgtcttgtaggtgattctaactggcagccatgtgtgaacctctactctaaacccagtctgggctcttgtggctctggccctatgctcattaaatcaatctgattaaggccatcagttcattccttttcaaccctagatgtatattggaatcctttgaggatagaggttacttcaatgagaattttcaagaaaaaattctagttgacagattcaccaaacttcctctgaggccccacctatatttgaggattacctttccctgcccaaccccaggagctagaacaacattccagaagttttaactctcaactctaaaaacctgctctctttttggaagtctctctacaagttactgaggcaggaggagacagaggagagagggaacatgtgtgcacacaagagaaatgtccaattgaatgagtctgatcaataagatctatgactcaaaaatacttgcttcatggcaagggaacatcttttgctttcatatccatctcacatacctgctgagtcaaggaaacagctccatatttaggagaaaaatcctcttctaatctctaaatgcaatcgaaggttttctatgtctttttctgtggctccttggaaatgttaaaggcatgtctcagctacagcaaggtggggcatgacatattgccccccaaaatatgaaccaattgaatgtcgtctgaagtcagctctgtttctgttatcttttaatggattttaggtaaagaagtgttgatgtagataaaatagatataaaaccaaattcttctgctttggatgtgcaccaaccccagcaggctaaaaatagattcaactgcatcaataatatttctctttaaagttgcaggtcctttgggggtttggaaacattcagagaggataaaaggggagaaagatatgaaaacagcagaagctgcagtctaagcctccaggtgggggccttggggacagccatgctggaatgcctgatttttacatgtccaagtacctatttcctaccaaaaaaaaagcccttccacatatgataagaacacatcttttcttgcagggctgtcaagttcattctaaacacccctgccgctgcctgtttgagattgatgcctctccaatctctagctctttgtttgaaattaaacatccaaagacctttagaataaaaaaagtcaacatacaaatgaaatgcatttcaacatgcatctcaactgcagaaccacagcatgttgagactggaccaagcaaaccctgaagaagtttcccctcttgctcctctgtggtagatgacctatccaagttcacacaacaggtaacatggagcatgtggagagactcagcataggccagtgcagtagcggggtctactggaaaagacttggcctttgaagtctcattccaatcccagccttgcattgaccaactctgtgaccttgaccttgaaaaagtagagtcacagtgccctctacttcacagggttgtttggagaattactgaaaatgtgcacaaaatacctgatacacagtggggcactcagctaacaccagtcattcctgtaatccaggtctcccaacttctagtccagtgctctttgcacaacaacaccatatgaagactctgagctatccaaataagtgcacttgaaccacaggttaaatccccttcctctcatcagaaatacaggctagcaccgcccagcgttctttaaagacagccaggaaaacaaaccaaattcatactacttacccaacactgaacgagacacgctggctccctttcctttattttgtttcccttctatttgtcctgggtttgtggttctcgggcaaggtgaactctgctcagtatgatatgtgacccctggccacagttgcatatggccctgcctcagttgctgcctgctccttacttgattctccaggtccacactcctttcctgtgccatcttcccctgtggcacctgtgtgtaggaatcttcaacagctgcaccgccaacagagaagccacaagctggagccccacaagtttccccccaggccccatgcatgggtcagcagtcttgacccctgggctgattttaatattttaattaaattgacaacatgtaaaaaatctggagatttcacaacaatgcagatttctgacttcttttgacaaattacaaactggccaaatgtccacagctggccagagctgtgaggcagctgctcccttcatctggaaagactcttgctccactggtcaaagtccccaccggtcccctcattgcaacctcaccattccctatcaacctctgagttttccacccctgttatgatatgcacttccagttctccagctggacactcaagatgtgtcaccacatggcccactgcacttattcaatctcttctcctgggaaccctggaaaatctctctgcttctaggctctgctgggagcaattcccctcctacaatgtcctccttgctcttttatttatccaacccaatcaagagtatctctgcttaaaaaattcttgctgaccacccaagccacaaagagctctcctttccttaaagcatggagtcaacagttatcttacctaccttcacatagttggttcttcctgtttgcacatcctgtttccctagctaaattgtaaacttcttgagttcacatttgtttgccttccccagaaggcagccacagactttccaaagggaaagttctgaacaaagattaattgtttggtcaggagctatcaaccatatcatcactcagtgcaagaccagtctctccagcctcttttgcctccactccacttcccttgttcccctctcaaatccacccaaacccccatcctcctggaatcactccaaaaggactagaatttgtttcctgttttgcccacgattgttcccatcgctgccactccccagggctaaacacagaacctgccacataacaaaagctcagcatatgcacattaaatggaaagtgccttactttttagtccctatatcttaacatctgcagttcaccaggctgaccatgcccttctcccttttcaccaacagatctacgggtcttggaaatcccagttcagtgttcctctctcaatctttttctcttcctttactcagccaagtcactcctctctctaggcgccgcagtcctttgctcttgcctgccacagccattgccaaatgttggtgcaattgtttgcccacacctgtttttcccttggatgccaaggtcttccggatccaggattgtgtgatcttcttccatgcgcttgcctggttccccaagtcataactggacataattagtctggtggagaaggcaagtattatggccctcatttttccaatgagaaaatggaagcaaggcaccaggctccctgcatgcagcagagagatggaagaggaagagaggagcagcttgggtgagaagacttggttctattagcaggggtcaagcaatggaatggaaatgtgtcatgtcctttcaaggtcatctgtggagcaatgtttaacagcctgcccaagaaatatttaattacctagaggaaagtaagtacctttgttgacttgatatttgctaccaactaaatagccagattatgtgaagttacacattaatgtgtaggattttgcctagtagaaatacaaatgttttctgttcaggagaaaagataatctcaaagtttattaattgactcccgtgtaggacattaaccagttttgtttctaatttagcaatctcattccaacactcttcctccagtgcctatgtaaactcatgctgccatcttgttggtttcctcattaatgagctaaatgcatttttgacatgtccacattctagatttgtatgagtcacaattttaactttttgaaaattatactttgccacccaggtgccaccaactctgggagtgtgagcaagtccctccctcccctcttctggactcagtttcttcaacagtaacatgagggcgtaggtctgcatgggaaattacaagccccaggaatatttgattttaagcctgaatcttaaaaagaataatttcctcatagggttgaacatcttacggagttattttccaaaataacaacaataatgggacagtgcttcatacctggggctaagtattttaattctcacataatgagatggggctattgttcctagctctattacaggtgaggttaggaaagctgaaacagtattttttttaacgaggagacactatgtttgtccttccactcatgtttccttccattcttcttttcacctgtctggtcatccatgtttccagtcatccatcccactgatgcaaaaagaaggtggtttccattttcactctggatctatctaattgactatttaattgatgtggactttagtagaggcagtgattgcttccagttggtgggcccaggaagactgtgaaaaaggtaccactttcagcttgaccctgaaggttcaagcagaattatttagggataggttgaagaagcatctttgcctgaaggaaccatggcagggacaccagaagacaaaggagggagacatgcacagtgaccagtgggtggttatggctgtgggaagggtggataatgggagatgagatgaaaaagattgattggtcttggcatatgtcaatggctgattgagaatcttaagtttccttgatctgaagccctgtccacaatcacccagactctgagtacttcatgtggtagtaagaggcagagacaaacccttccccaggtgccctgatctggccaagcctgggcgctctgactaccagagtcctgaactcttagaagggagagctgcaaacaaccatggcgggaatctactccagcctcccttcccgaacatgtgggcctgagctaatttaagctagtctgagctcactttgcaagcagttgtcacaaggtgctacatcaaaagactcccaaggcccaaatatttaacaaccagaacactccctccatccatcagtttggtaattctatccacacaaaaaaactattggggtttcatttctggcctgctcatttcttataaacatgccagggccatttacagctcacaactcactgctctctaaacatttacacatttctccctcttaacacatccttggctatttgattaagtagtagatcacaggggatggaaggcaaggccttggcatctttgggttttctccaaacctatcttgacatgggttcaatgccagcctccccttccagtaaacacaaggattattgcactcctgggcacagacttgctgatgccttggtcttttctatcccttctcttgcagtttctttaggtaggagggaatacaaaccccaaaaacaaacagacatgagtccattttaccagctgggtttaatgggaaagctggtagggttccccatgacccctaggactgaatgagtgcccacatttcacaacaccctgattccagacaggaagcttggagaagtatctatatttgggggaaggaagctgccccagacacagcttcctggactgttagcaaaggaatctcacacaaggcctaaaccagtttccatacaacttccttgccttttgggaaggtgcaatctcacaggactggtgggacttacccaatgcagtcatccaaaaacagttatggccaacacctaagtgctgagaaaagtcaagaggaagaggaagccccaagggcagagaaagtggtgaaggtcacagaaaaggcatggagctgtggcaccattggcgggggacagctagagtccaggcacagagctaaaactgggtatgagcaagggtaggagaggggacactgctgaacacccacaatggtcctgctcctgttggctctgccttcaatctcaaaggcaattatgaataaaggaaagcacactgccttcagagtccgacctaagtttgaatcctggcatctttcccagctggccgtattacccctaggagctactcaacacttcagaacctcactttcttcttcagcaaaacagaggtgcaggtatatatctcctaggagtgacaagggaattcacgcggctgttaatgacctggtgcctgcctggggctaccaagcagccaccacaagagtcctccataatagcatccaccgcactgcagtcagggcaacagcactgcaagcacttcatggacagagaccaagcctttccaacttgatctgccatgtttcaacacagtgcctcagccattgagaaaatcctgtgacaggcacagacccccttcaagaaggacttgctgctcagctcgtgagagggttgtcagcagcttcttcagggcttgctcagttgcagagagctacctggccagaggtcatgcccttcaggggcagcccacctcctctgagtgatgggagtgatggaataaaggcccatgtcagcccatcccagcactcattccagcacaatgctggcaggccatcttggtgctcttggggctggctgtggctgcatccagcctgcatcacgactcaacctctgcacagtcctgctgccttcccctcctcccgtgggtatgagcctccagcacactcaacttcgtgtcagagcttaccttccaagaaccctacctgcaatgaacttggtatttgttgatgagtaaatgtctgaaacaagatccccaatcttctaaatccagagttaaaactcagacaggccacggtccttggtcattctaggtccaagaggctcttgctgctggcatggccaagagatacaggtaagtaaaacagtatactgtggtgctatgaccacccagggggctgccgtgtcccactcaggaaaatcaggtacctagttggcttccaaaagaggctggggaaattttaagttgaggttgggctctgtagaccttctccaccactaaagcccccaggtttatcatttcccgggagaataggtcctgggggagagggggagataacaatggaacacaccaaaagggaaccctgtaatggaacagtgcccactaatgtttattttatcccaggagtcacagaaggcctggaatggctgcgatggagataaaggatgaagggtagtcccctcagggtgttatccaaaaagtcaccttggaagaggaagaaactcctaccaatatcagaagagcaacaaacatttttttttctagaagataagtggctaatttcaaaataattattttatcaactgccacataagtttttttttttttaattcattaaaaaaaaaaaatgaggccgggcacagtggctcatgcctgtaatcccagcactttgggaggccaaggtgggtggatcacctgaggtcaggtattcaagaccagcttggtcaacatggtgaaaccccatctctactaaaaatacaaaaattagccaggagtcgtggcgcatgcctgtaatcccagctactcaggaggctgaggtgggagaatcacttgaacccaagaggcagaggttgtagtgagccgagatcgtgccactgcactccagcctgggtgacagagcaagattccctctcaaaataaataaatacatacatacatacatacatacatacatacatacataaaaatgaaatgcttcccttttcaaatgaggagtgggaacacttagattacagtgctaagttctttttgtctgtgaggtaaggagaagagcctgcgcctaggtgaccttggcctggtcagagatgctgggacagcctggacgtgggaaagaagggatctacgcaggtctgtccacagcacattccagggcagcttcctcccgggctgcttctgtgccagaacctgctggcctcaggagccccagctcacctttcactgaccttcagcccacaggagaacagcatttcctacctcccccacctgctgacaaggcctctctctttcccacgccaaggacaaagatgacctctgggggattccttttagctggctcataaaaggaagagagatgggccaaagagaaagagctgctgggtccttccccaactagaacatgggaaatgatgattttccagtagggaagtggtggccaggcaggcaggcgtcgactagatgggtccctctggggtgtggtggaaatgacctcaacttcaaagagacagacttccagagaaggctggcattagcatcctgatctgctctactgagaatcccaagggttttgcggaactcttgctgggccatgaggatacagtctcctcctgaccccaatcctctaaccaaagcagctaggtttcagttagtgtacacagagctccaggcctctaagagtgtgaaagccactgcctcaggagatatcccttgctggagatcctgggaagtagaggctatggaggcagaccacttaatagctgtgcaaccctcagcaagtcattcatccactctgagcccgagttccctcctgtgtaaaacagcagttatcacagtgcctagctcctagtctgggtgtgagagttcaaggtgaggccaaccagttgcttcactccgtgcctggctcatagtgagacctcagtaaatgtgagctattttctttcaatgaatatttgccctttccagcatcacaaatacatgagcttccaattctagggatacaaagacagaggggctttatttctttcaatgagttcagagaagtccctagcacttaaactgctatacactgagagagtaagccatagttctgaaaatgctctgtgtgctcattcacctgaagcagcactgggggtcactgcagcctcaggtgccaccgagccgacaggccatgaaaagaacacccactgactcactcatctgggtggaatggtttcatggggacccaggtgaggtggtgaggttgctgcttttttatgtattggctttttctgcctccccaatgccccacttccgtcgcaaaagtgtctgagttctggagcaaaggctcagctaggaaaagtttcagatattttctttgtcttaacccttcagggagaggaaggaaaatctgtctcttgccagggtgagggccaccaagcgggttagctcactctgccacattctgcattttctaccttcaacacaatggacagtgggatgtctctctcttgccatatgcattcaagagaaaagccctggtttgggtggggctctggtttgggtggggtttgcattgggtctacagccactagcaacttgctgtagtcaaggcaaatgacataagctctctgatcctcagcttcctcattgtaaagagagctcttagctccaggtctcattactttcagggtatttaggatgtttagatgccaaataagacagcagaaggcagagcaccttgacaagcataaagcactgtatgcaaacataaagcatggtgcaatctcacaggactggtgggacttacccaattataaacaaatttataatcacatggcaggaagggtggaatttcaagatagaattattattcattgtaagatgacttgtgtaatattgtaaatgactgctcttcaccccatcctctgattcaaattaaaatcctcattccatggcccctacatgtacgctcattttcactgttcagttacaagcaacaagatgagacattttgacgcccttggtaattgtctggtttctagaagttcttggttcacaggcctaagcatgtttcatttgatgtttggcaccatagaaaacagtgtatgtttaatgatttctgtgttaaactgaataatgaataaccaggaaagacaacagaccaaatagcaacttcttgatacacctgcttgacggaattctgagcctttttcccactctatcaaggacaactgcctaatggagagtcagaatatttttctaatacaaataaagtaaaaaagcaatgtaatgttattatcttttaaagacagaaatactattaaatcctcaaccatttttaaattaaagcataaaaccctcttctacccaataagcaataagaactcacttgaattccttttcacaggcatttaagggatactaatgggtacagacagaagagggaaaagtacagaaaggaaaacagcagataaatatatagaagcagaaaacaagagtaacagaagagaagcagaagagactaaggaaggcatctaggatgcagttgtgaagagaaaatcagacatatgtaggcagaaaagaaaacaatcaaacaaacaacaataataaaattagaactaaagagaaactttcttaaaggaacccataattttggaagcttatcagtagattttaaaagtagactacagatttatgactacaggagtaaagggtgtgttactcttagtaattgtttccttaatgacataaaatcacatcaagactatatccagctcatgggccagcagctccccatccctgccccataatgctgcactgtattatgtttcaatacaaaacatttggtgtccacttgggtcagcacctccatcagactgccatcactaagggaactgagccagcctcccacgtcagtttcctcccctatgggctccactgaatggggatgaatgcggtacctactctcatagtagggatatgaggattaatgaggtgatgtagaaaaatcacctggtattgtaggtggcatttagtaaatccttcataaacactagtgttcattattagttggggttacaaatagttactctcagagggggaaaaatgaatgaaagtgtgtgaacaggttaaacaaaatattttggaaattttatgttgtcgtctgaaagttctttcatgtgcatctaaaggcatcacactcactgtcaccctcttcacatggtgggtatcaatataaagaacattcttcaatttctgcttgactgctacatctcatttctgtctctaggtttccactgagccctccagctcaaggggcctccctccgcatgagtcgtctttaggaagcccagcctggtctctaattttgagaagcatttcccttatttcaggtcttcattcagccagtggttcaaccactgaaccacttcagtttccttccttcattttattcacaaaggaatcctttcatctacagcccctagctgggctcctttgaagagactttctcttcttgcattattttcttggtcagccttccttaggaaggaattaagacacatttcaggaaacgggcagaaaatgttaatccttctctccctcattgtcctactcataaacgcttactccctcaaatgcacccataaataagctgtagatccacatctggttctgagcccagcacatagtaggagctcagatgaatgatcacgcctgacttctcagccttgcttctgccatcccttcccctgaaaaatctgctcctctctacttaacctagtagaaccctcatgaaagctgttgtccctgttgaaggaatgatgccccaagcatccagcgtgtctgctgtttacttcatgcaccttagtggatgtggtgaaatgaaatgacttttccatttccaaagagaaagtgcaaagtctccaaacttatgacctctttctcagaatgccaatatttacagcttagccctgggcaaccctgtgcttttctgaccttagattcccatttggagtggaaatggcttttctatttctccccaaggttctctgaattagatgaccaaaggagaacttacttctaccaagatgggtctatgagacccattcaggctctcatccattcgttcaacagattcattcattcagcccctactgtgttccaggaaataagtgtcaaccatacaggagtgacccagacaaaaagccctgcttttatggagttagtttggattttagtggagacaggggaagatagatgataagtaaaataaataaagtatatatagtatattagagaattataaggtttataaagaaaaaatgaaagatacaattagtagggaatggggataatttaaaatagggggaaatttataaacataatggaaaatatgcatgtaagtaaaattccttccaaaaaatggaatatttaacactaacttgcggtgtaaacatgaacacatcatgggctccctccaggcctcggtttccttctcggcagtataaggtggaactacaaggtatctctatggtagcttctggcactgaaattctctttctctacccaatagatagcaatttgaattaacactagagcctgttgggacccagtgattgtggtctaagtttcaatgactttttttttaaatccctacattccttggggttcccagcaatgtctccagtgggctgctggtccaaattaattgtgagagcaaccacaaattcccttgtttatatttttgaattgttgacttagaatcagttttaaatctgagcccttcttccccacagatactctcaaaacagcctcctgataggcactaacccctaagaaggtcatcaagtggggctctgagagcaaggatgctgggcaacccggcttccaatgccacttatcctagccacatgagtactcataacaggcttgacgtcaattaaatcatactggccctgagaggcgccacccaacaaactgtttcttcttcgtggactttttgttccctctttatttattttccactgagctacaacaaggctcaggaggaggcccttcatctaggaagagtcatcttgggaccatctagggaggaaaaggcatccatcaggcactcatcagccacctctgatgaaaagcttcctttggggtaatttctctgcaccaccgagtaagccttctgcctgctggaggagctgtggtgagcatgtgaagggaggttctgaaggcttcagcagcagccaccagtccccctgcagcccctaatgagaggtgatccttgttcaactcctgctatgtgctagacacattctaagcactttacatgtattaactaacaagtctatgaaacaggtgttatcattattcccattttacagatgaagcaagtgagacacagtgaagcagcttgtccaagatgacagtttgtaattggaggagaagagcccctatcagcatcgctgtccagaagaaacataagacaaaccacacaggtcattctaaattttctagaaggcacatttctttgacacttattttatttacaactctatgcaaatttaaagacaaataatattccaagtggggccgggcatggtggctcatacctgtaatcccagcactttgggaggccaaggcgggtggatcacctgaggtcaggagtttgagaacagcttggccaacatggtaaaaccctgtctctactaaaaatacaaaaattagctcggtgtggtggtgggtgcctgtaatcccagctactcaggagcctgaggcaggagaatcacttgaacccagaaggtggaggttgcagtaagccgagatcacaccattgcattccagcctgggagacaagagcaaagctccgtctcaaaaaaaaaaaaaaaaaaaaatatatatatatatatatacacacacacacacacatacatatatatacatatatacacatatacatatatatacgtgtgtgtgtgtgtgtgtgtgtgtgtgtgtgtgtgtatatatatatatatatatatatatatatatatattccaagtggaggaaagaagttttcagattgctctcacttgtaactcccatacattaattttcttgtacatttttctttaagattataatgttgattgcctcctaacagtcatttccatccccctccctcattcagagaaccctgattttgttcaggggtgcaggtacctcaccaaaactgatgctggccccactcctgggcagacctcgattagtctgagcaagccctggtgctctcattcttatgccaacaattggcttaggaccgacctgtgactggttcttgacctgtgaaataaatgtgcaggtgtgctgggggcttctagaaatgtgggccagactgctgaagaagaggcctggagagatggttgcttaacctcgagatttttttttttttttgctttctttttagtatgataaaatatacataagataaaatttaccatttaagtaatttttaagtatacagctcagtggtattaagtacattcacatggtcgctcagccatcaccattatccatctagaaagcatattttttaaaagtaaaaagaaaaaagtgaaattaattttaataatggagtttaatctatacaaaatattatcaataagtaatcaatataaacattataataaggtttttttacagtctttttttgtactaaatttccacttacagcattgttgcttttttagagacagggtctctctggagtgcactggcatgatcatagctcactgcacagtccttgaactcctggcctcaagcgattctcctgcctcacctccaaagtagttgggactacaggtgtgcactactactcccagctttacagcacacagcaattcatatttcagatgctcactgaccaccggtgttggactgcccaggtttaaagtttctcaggcttgtgcgtgctcagccagctcatgggcatctccaagggacagcagcatgctgtatgtttatgaaagatttgtgcgtcaccatcagctctctggggcagtttgcgattcaccgcaggaccctagatggtgtctgactctaatggttctagatcagcctctctaacccccgcggagatcactggcatcacgctgatggacaatacaagatctgaagcctaaatgagagcttttcctggtggagcaaataccgtgcctccatcacccagctgtgatttcatctcccagttgagaacatgacctcaatggcagaggtagggacaacacctatgcagctgcacaggcactcccaggttggaccaataataaataaacacattcctacttggaaagagggcagcatgtgtgcagggttgaggcaagccgtggttgccatggaaaccagccagcatcactccagactttttccctggtgctcggatcattggtggctgacgaagcccagtggagaggcattgttcctgtacttatggaaaccttccaaataggcccattatgatgaaagcacatcaaagagggaatgatgacgtacctttaccatccatcgtcacatccactgtttgtcctgggtaatacccaaaagagaagaaaataaagccactcttgccacagagggaaataactggagagcactgaggtatgacactaggggtagcaaggtggtccccaaaggggaggcaatgaaactgccccatctcaccaccatagtgaatgctcgactggacaaatggttatggcttcagggatttgctacctgcccaagctgacttacaactcactttctatggcaagcctctggtttgctctctttctggagccacgtatgtttgagatcttcccattcattcattctttcctatgcccattcattccttcactcattcttgaatgagaagcaccatggtaacatgaaaacagcctgggtcatcgagtcatgagatcccagatttaaatctcagttcagatgcttattggatgtgtgatctcacctaagctattaaagattctctgagccttggttttctcacctgtaacatggggacaagagaagaataatgtttgccacttgtcttctacacagtcatactcaatgtgtttatacatgatttatatctcattccattttgatcaacaattacccaacagagagcctggtctctccagatactcaataagattattgaattattgattattgaataaaaatatgacaatgtgctttcacatatatttcttctctctctctctcttcaaatttcattttcacagcaatctggttcaaggttgtttcagcccagcacaggacaaagaggattataaaattaaaccacatgtttctgactctcagtgaacttacagtttactatgttttattaacaatgtatacaacacttagtctgccccagctactgtactaagtactttataaatattaggtcatgtaatctgcataataaccctatgaggtaagtactacgattgtcttctgtcactggctcagggtcacactagtacatggcagaacaaaggtcaaactcagccagtctggctctatagcctgtgctcttaaccactcagcctcattgcctttagagtggataagtcacattcacaagtgtatgcgaatactctccaagactgatggattcagaggaggaaacactatgcactgcatcttaaagatgaggtaggatttgaacacatggagtgcatggaggagagcagaagaaggacaggttggaaagaggataggggccctgaccatttgcttgaagtgtttgggctttagaccttggaaagccactgaaggtctctgagccatggggaaacctaagcaaagctggctttggggaaaattcatctggcaatagcatgaaagatggactgaagcggggagatgggacaaatgaggagagtgacatgtagctgctataatgagtgaaggaaggggtcacagggcttaagccaggacaatggaaaaagaagcatcaagggcaaatccataggacgtgcctcctaccaggatgtaatatgtctccccgagtttcccaccaaaactttcacatcagaaacaagttccaaggagcactcactgggcactttcgtggccatccagagtggcacatgggtgctctatagcactgctttcctcaaaggaaacatggggtcatcttgagcagctggaaacactggctgagcctttcctagttgcatgcagccatttactgaggccaagggggcaaaatctaatcctgacaaagaatcctggccacctcaaatgcaaaagatagccaagtacaacgaaccatagtcccgtttgttataatgtcctataaatcacagcctaggccttacagttaatagggctttctattccaattcccattatgctggaaggggaagaggaagaattgaggaacgaatgaggagtctgagagtgagttacggcccaagaatatgacttgtcagccgtcttccaagctctaccaattgcctgaaattctctatccagtcgtaggtttgcataaattcctggagaaggctttgtctgataccacagtgaaacagatgccagggtgcaggcacaacaggtagactcataaaactggtaaagagaactttgctttgacaaaagctggagttttccttgttatttatctttcctatttgaagccttgaaatcccattttcatcttgatggagatgataaactcttagaaaacttttatggctcccaggatgaaactgaggactctgcctctgctccccactgcaattctggcaggcttttaaattcaagtcagggcagaaactgtttttggtcagaggcaaaatgtatttatctctgtaagcacagccattaagatgtgagcatgaatagctaagagaaagaacattaagggagaaacaggaagaaatagaaggtgaggctatgatggaaggaaatgatgacgcatcaacccccaccaaaagctttttacagtgccgggggagtggggcacagggaaaggcatctgcagcgattgggagaaagaacccgggagtgggctgaggggaaggctttgcagtgggagggctgtgatcagcgtgtgcttcatgcaaagagaattttgagagtggacataacaaacaggaaaattgtgcttgcatttctgtttgtctgtagaatcactgtggctctgaaatccaccccctctgctctccaaacactaaagaaagtctccagatggaaaaatctgaagtcaggctgcaatatgaaaaaagaaaagaaaaagaaggctgctacaggaagctgacaaatttgctgtttctctgaggtctaacctatgcagctggggtatcaaatactagacagggtcaggagacatgtctgaaactgaccaaatgaccttggacaagccccactttaatcacacataatgtaaactttagggaatgtgacctagaacaggtagctaaggcacaaataacactagtactaccaccctccaagctggcactcatggcaggcatcattagtcagtcatggaattgttcttttcttttcttttcttttcttttctttttcttttcttttcttttttttcttttctcttttcttttcttttcttttctttcttttcttttcttttcttttctttttagatggaatcttgctctgtcacccaggttggagtccagtagcgtgatctcggctcactgcaacctctcactcccaggttcaagtgattctcctgcctcagcctcccaagtagctgagactacaggtgcctgccagcatgctcagctaatttttacatttttagttgagacagggttttagcatgttggccaggctggtcttaaactcctgacctcaagtgatccacctgccttggcctcccaaagtgctgggattacagacgtgagccactgcacccagccctcggaattctttagagcagagccattatgactgtttgctgctgaaccttaaatctttggccaaatattctctgtagctgctactgatcaatcagaatgaacccagaagatgaaagctgatgaaagatgatgaaagttcaccattgctagacttgatctcttctaatccttaaacactagagccagataagattgcatgtcatgtgtaatctcattatagacatccttaactaagtcctaccttggttttcttttctctttggccttctttccaagtcttagcagccaaggctgtgaaataagaactggtatgaaggctcttcattcaactccacatctgaagctctgaaagtgaccttgtgcacttttcttgagcctctttactttacgttcccccattctgccacaaagctcctggtggggctggtgtctcctctactctcctgctgatttcatcaaggtaaagaattctattccttttcaaatgctttgagatcatgggatagaagacagcctggggaagttcaaagacgtttaatcattagcctcagttcttttgaaaattattaaagagcccagaattagaaattcagatttcctccaaatccctgagaacaaacaactctcttgtaaatggcttaatgtgtctgtttaatgtacacaaaattatctttcaggaaagtggattgttttttatatcattttgcatctctaaaatataccacctatggcaaaaggattgggattcaaagtctgacaaaatctacagcagaaataattagcaccagaggctgtttctgagagttaaatgaaagagaaactggttatttatttatttcttttctctctatctgtatctctccatctcagccccgggaagaggaattgtatctcttggtgctagaagggtggcttgctgaattgcctttacaaggtttttttctgtaagacaacaactgagcccccaacacacaactccctgtgggccgcagtgctatggaaacagctgcagtgctccaactctggggaaaacaaccagataaacccactggtttgcaaactaggcacaagggcagaggaatagtgatgttttctaatttagcatccagggaggcaagggggagtctttgcttaaatcatgttaatgaaattggaaacacttgaaatagcccattgagggtctgttgcccctgttttttaaagttcatctaaaagttaacctacaaggaattttcatttggggaatttctgcaatgtcaactccactgatcacccacagtgtttaacacccttgctataaatttgggggctagcttggcagctcctgccacccccctgagtctgctaccttgctccagaaataaaaaatgactttggccacagtaatgtttcctcgatcctcagcccctcctgggggcctccggcagtcattattttaaataaacatgccttttattgttttcaggtacacagagatggaggcgcttctacctctggaggagggatggactttcaggggccccatgatttgcagcagttcagtcaaaagcaatacaaagagcaaaggataggggctgttatctcacccaagagctcctcaagcagaggatactcaattggaaaggaggctcttccagtcaaatttggggctagtggggtcaccacgtttgataccaactaggaacaacatccccttagaggcttccaactgaggaaggttccaaaagagagctccatggctgaaatgattcaaaagaagccaactccttctcattgagctggccctttggaatatggccccctcctcccacggcatccttccccctgcccagtgcctcaggcccatctacatgcttctacctataggctttgcttcttctctagaaaggagcaaagaaggaaaagaatcattggaggtgagtcaaaagcaggcaccgtaactcacggggccttgtaagccagggacacagtttcagattttacttcaaatggaggcaaaaccatgggagagccatgcagagacaccccttgatgaactctgcttcacgccaatcactctggcagctaagaaaagtgcattctctctccttttgcagttctcctggtgcctagcacagggccaagggcacagtagatgtgagcctaacacttgtggcctttgctgatgaaggacagtgaaggggataagaaaacataaagatattttgggctgcaagggaacgaactactgaaaaactactgcggccccctctatttatggagatgctgaggccttggagagggaattgacttgtccaaggtcaaccagaaaagtgatagcaaagccagggttagtatccaggtttctgctgattgcagctcctcagataaaagtaagtgacttgcctctcttctcccatatccagaattgatctcaaacactgtcatgaatccccaagggccagagagacacacagcatagaccaaggtgagtaaactgttttctctctttctgatgatctgagctttttcctggagagatctcaggtggccaagaaaccaagttgcccacctcatggttcagaggaaacaataacctcctggcagcttccctgggagcccatgcaggtgcctcagggattaaggagctcctgaaaacaactcctttcctttgcaggaagtgattttccacccctgaggcataacaccaggcagaggctctatcagtgcctgctgatataattagctctggacagactctccaaccaaggcagacacaaccaggcccttgctctagaaacaaaaagaatgttctggacctatcccagtacacttccaaaccccacgccttcctgggcaagtcggggctcagagaccaacaaacccaacagacttcagcagcagccagggagctggcagcctctgtcccctgaaatgccacttttttttttgtgattcagcctctgtttcaagctatttttagtgtaagcaaaggctgcatctgagggaaggtggtgtgggaaaggggtctttactttctctctccttttcaatgaactgtcctgtttcccttaggacagccatttcaccaaaagccacaaaacatgtggggagggaggattaaaaagaaaaatgggaaaaaggtcaaaattcagcctgtttgctaaaagtctgggaacagttctaggaaggtgatagtttctcgatcctttgcgttaacctgctgaatcctgggctgctcctgccagtggggaaccaatatgcccagtccatctaccttccgaattaaccaacctccagtaaacaaggaaggcccagaagtttgctctcccagggacgtggtgcaaacaggtttaatggtcccccttgatgccccagggaaggatgtgtgcccttggaggcttgtgaacagagaagcaagcttccgctcacagaggaccctggcttcccaccctcaccccgtctccatcatgtcagcacaaggccaattttacaaactgaaattaactggatgagcaaaaagatagccttggtgcttaagaggcttgggtacatttaattgagtttccaagtgccctgattccttaagaaagccagagaagccactgttatgtcctagatccctcactactcaaacaggagagaatagtttttacaataaaaattttagggcaaatggtggctttctgttgttgtcatttccctgaagtaggttttttgtttgtttgtttgtttgtttgtttgtttgtttttttctggaaaaagcctcactctggacccagagtctaaaaatgaggcttttagtgcaccaaattgggctgtttggggcccgtaggcacgagtcagtctgcctcctcctaaacatagcctcgtaaactaaacttggaagcatcagcttgcgtgtggtcccgagtgtgactttccaagcatgcactcccctgcaacgacaaaggctgatgactttgtcatcatcatctctatttttgagtctccctgctaaacaaactttctcgcagctgaaatggaggctctaaggatatttttctgacaaaaacggagtgctaagccatcagcaccctctgaaggccttgggggaaaacctgggtaagaaaagtctcccagcccaactcagtagccgcaaatacagacatttcatttcctgaaatgcctccagggggcgccagctttcatgggttgggaaggagggagggaaggacggaggaatggaatgaggcgaggaaggaagggagggagggaggaagggagggagggaggagggaggagtgggggaggtgggagggggcagtggggaggaaggaaggaagggagagagggaaagaaggaagggagagagggaagggaagggagggaaaggaagggagggaagggaaggaaggtaagggaggcaagggagggaagggagggaggcagggagggaaaccaactactcacatatttgcccaggcccctgggattcagctgcagaactgcacaggatgtgcaatcaggactagaatgtctgagctcccaggcctgtccaagggactgagagatgggtcacaggttctgacttatcactaaaccctacttcagaaaccttgccaccccaaatcattctagaaaatgcaagcataacatttccaccttcaacactttggatgactgcactttgcagcttttgctgaatgaaccaacatatgtccagcacattgaacagtatctgaccccgagcaggtgctccagaatgtttgaaggaatggatgaagggatggaggaatagctcagaggagctgcctcgcatgtgcagtagaatctgggtctttatcttctggtgacctcacacgctttcccatctcctttcaatgaatgtgtggtcactacctgtcaaaatgtacatcaaacccacctccccaaatactggtgcagatgtgccctccgaaaccagcctgtccctgccctgtcagcctcgccccacctccagggagaagtggatacggagaccacagtaagtgcacttgaccctttttccttaagactcatctgttgtcctgccaaggcatttcctgtgacacatgcgcccacaacgtacagctccagggagagcccagcccgttctccagtccccagccagctcagggaggctatatgaagtgagaatttcctggccaatttgacaatggtgagtcaggctggcatgagccagctgcaaagaggacgcagcctggacaagcctgaattaagtgtgtgcacagagcaaacatcatcatctggatggatccaaaccagggcttgcctggggcattcagagcctttcagatggccctgcccagagctgctcagcactcttggaagatgtctgggtttggggaggctcaagggctgttcttctacccctgccccagaaaaggatttgttcttcaccccctgacccgtctgtctccataccagcccatttcctccatgacatggtgaccgggctcacacacacaataacaaaaataataataaccatgcttatcaagcactaaccatgtcagaggcactgttctaaatattttacatgcattaactcattaagaggcagggactattattgtccccattttgtagatgaggaaactgaggtatgagacaatgaagccactcgcccagggtaaaagccaagcccctgagacagatggagctgggagtcaggagtctgcagaggctgggcttccaactgcccagccgcaccacacacagcagctccttcccaagatgggtgtcccagggagagaggcaatgcaagagctgaagtgagttttgaggctgctatgggctccacccatcctccttgtttgttccaatcaagtgagaacgagacacaaggagcaagatggagatcaaaaaagagtaggagctctagttcagatcatgatgcactgacaaaggggcagggtttctcactcccaggccccaacagagactgaagcaaagcggacagagacaagacaggaccggcagaagcaggccggactggctgctgactgcacagaggctgcaagtgctctgcttgcttaccaggcccccactgacctgtgctacgctcagttctgtatactagggaacaccaatcaatgtcggtggatcacacaggtggatgaatggacatagatggatgggcagacagacaatgggatggaaggccaaagcaggcacccacatgcacctggaaacttcagaggagagggaaaacagccatgccagcacttgccatcagagccctgagggcctgggagccagagatgagtggccaggatcaagtgggctgtccctggaccaggaggctcttcctcactctggagccaactgagggttgatttctgaaactctccttcattttcacagcagccctggggagggcagaggagccaacacaccagctagtaaaattaacagctgctctttacagggcgtgccggagagcccagcacatggctcgaggcctgcagaccagaagctgctgcgagctgaggtgcctggcctgcaggccctgatcaggggtcctcttgggggtaaggcttagactctgagctgccagcagggcctggggtgtgggggctgccgaagcagtgggcaggtggatggagaaactcaaggaatgatgctgctacaaaattctcagacatattctcctgaccttgcgaagtggaaatccatatgttcaccccagctgggaatctgctatggaacttggggacccacctggctctggcctctccatctctaatgcagtacttagttgagcttggggaagtgaatgtagacacgtccccatgagaaggggacagatgttatatcttatctattacctatgccataggtaacttatggagcaagtcctgtaggccacttgaagaggaatattgacaggcatacagggagtggcaattgtttctttacagggacagatggtaattattttaggctggtgggtgttttggactccggatactactcaactctgcctttgtagcttcttacagaagcagccacagacgatacgtaaatgagtgagcatggctgtattccaatgcaactttgtttatggacgctgaaatttgaatttcatatagctttcacatgtcacaaaatacacttattttgatttttaaaaaataaccatttaggccaggtatggtggctcacatctgtaatcccagcactttgggaggtcaaggtgagaggattgcctgggcccaggggttcaagaccaacctgggcaacacagtagaaccccatcagtacaaaaaatttaagaaaacatagcatgtcatggtggcctgcacctgtaatcccagctatcagggaggctgaggcagaaggatcgcttgaacccaggagtttgaggttgcagggagctatgattgcaccaatgcactccagcctgagcaatagagtgaaaccttgtctctgaaaaaaaaataaaaaaatgtaaaaaccatccttagcttatgaaccacacaaaagaggcaatgagccagactgtcccacaggctataactaactgatccctgggctaattaaatgtttcccaaagtgagtgctatgtgatgcccacaggtattacatggggaaaggattccacagggaaatgaaaatggaaaatgctgggcaaaacagagcctttccgctttctgactgcaggacttctgtaagtatttatatgctgatatgcattggcaatctcgaggagggggatgagaaatgaagtctatccaagttcccagggaaccatttttatccgggaacaattcgtgggtctagtgttctatggaacctaattaaagccatgaggataaagtctaaccaactgtcagcaacagcactatgaaatgcgatcctgctgctctttgaatatttctagtaacaggcagctcactacctgtcgggggagactgctcaattcaattatttctctgactcatgttttctcatctgggtaaatgatgttgagtcaaaaataacaaatctagtgcaaatctagtgtatctttcattagataaagacaaaatttcatgtttaatagtaaaaaaagaatgtatcttctttgactttttgactgatacccataatgtgatttcagtatctatgcatgggatgaaatacagaaccactattaagtcctggaaggaaattatcatatggttcctttaaacagaagcctcccttaggagtgttaaaacaatgccaataaaactccaactgattcccaatagcagagagcaggacatacctattcactatgggacattcttactaaaagtacagtcctgtgaaacctctagtctttctgctacacaaggcattggccaatgatgtaagaattttacatagatttgcctaaaatataataaaagctggggcatagatgaggggggtgagagacagagacagagacagagagagagagaagtgtgtgtgaatttgccaccaggcaccactgagaaagaaaagtagaggatactgatgggaaatgtcacaacctccatagggcacctaacagaagtgaatgcaatgaatgtgatatatttgattatgtgtgtgcccatgtgtactcccactgggttcaaccagtctaatttcatgcgcaaacagcacatcagtgaatgtacatctatttaactctgttaaaccaataggattattcctatttgaaaggcatatttgacacatattttcttttgggcccttggagataaagatgaaatggtccaggctatgtatataacgttaatgtaaaatgccacacatgcaacatatttagggggataaagagagaggctgatatttttctttcttcttacatcgataaatcatccctatacattcaagcaagtagcatatgctttcagttcatagaattagctgtgtaagcttcctggagcaatacacagatgtaacagcataggaatatggggaaagtaactacaaagagtgattctaagggctctctctagctttgctcaggagctggtagctattttggcaagaccagtctttgaagagacacacaaaacattgaatctgtcagggggttgaggtaaagtctaggcagtgtagatgtcgctcccaagttgaggtgaggctgtccttcaccacaggacatagtttccctagggagacagttgctgtgagatcaacatggaaatgaatatgaacatgcagaaactaagtgacaatgtggatagtgagagtatgtgtgtgtgcctgtatttatctttgtgtgtgtatcactgagtctgtaacgctcctttacaaagagtgtgacactcttgctactcgaccttagagaatctcttcgcctccagccccagactttcaatttctttatatataaaacaaggggataaattagactgagtcagcaaactatggtgtgtgaaacaaatctggcccaccacctgtttctttttttaaaacgttgtattgacatataatagtgtacatattttgggggatgcatgtgatattttggtacatgtataatgattagatcagggtaacagaaaaccatcacctcaaacatttatctttgtgttgggaacattctaattcttttctagctattttgagatgtacaataaattactgttaactataatctccctattgtactatcacatgctggaacttattccttccagtcaactgttttctctaccccctatttctataaatacagtttatttgtataaatgtaaggagtatgagtgcagttttgtcacatggatattttgcacagtggtgaagtctgggcttttagtgtaaccgtcatccaaatagcgtgcattgcaaccattaagtaatttctcatcactcatcgccacctcccacccttccaccattctgagtctccattgactactattccactctctgtccatgtgtacacactatttagctcccacttattcatgagaacatgtggtatttgacttcgtttctgagttgttccacttaagataatggtgtctagttccatccatgttgctgcaaaagacatgatttcattcttttttatggctgaatagtatcttattgtgtgtgtttgtatatatataaatgtaatatatatacatatataatgtgatatatatgcatgtgtgtgtatatatgtgtgtatgtgtgtgtgtgtgtgtgtattttttttttctttatttaatcatccactgatggacccttgggttgattccatagctttgctattgtgagtagtgttgtgataaacataggagttcaggtatctttcttatataatgatttcttttcctatgggtagccaccaattagtagaaatgctggatcaaatggaagttctgttttcacttctttgagaaatttctgtgctgtttttcatagaggttgtactaatttacatctccatataagtgatccttttctccacatcctcaccaacatctgttattttttgtctttttaataatagccattctggctgctgtgagatgatatctaattgtggttttaatttgcatgtctctgaagactagagatgttgagtattttttcatatgcttgttggccattcgtatgtcttcttttgaaaaatgactattcatatcttttgcccacttttaaatgttatttggtgatttttgttgttgagttttttaagttcctcatgaattctggacatcaggccattgttgaatgcattgtttgcaaatattttctcccattctataaagaaagtttactggaacaaagtcacaccaaggctgtttgtggctgctttcaaactactgtggcagagttgagtcgtggagcccacatggtctgcaagcctagaatatttactatctggccttttatggaaaaacttaccaaccctgaatttgactaccactgttgactttggcttatgattctatacagcacaaccaaactatactaaaacctacaccatacgtttcttgccctctttatttagaaaccaccttattcttagggggatttaatttacctgacaaaaatgtatggaacacataactgcatacatgtaaattccaaataggagtaagaaaagtagggcaaagggaaaatgagaggagagatgatgaagacaagccagagcaggggtgcaaagacacagagcgcaaacctgagccactctgtattttccataagccaccgacttggctctgagcagccaccactgagagacatgatccctttctcgatttagcatgctcactggatgttcaccaggaaaaccacaacaatctctggtgcaaaacactacttatcccatgagtctgtgcataaagcaggtaacatgagatgcagtgaacaaagtcctcaatgacacccaaacagttaagagaaatcctgacgacattgactgctatatccaaatttccctccgcatgagccgactccaaatcccacagtggaatttatcagcacgtcttccagcacatttcaatttttttaaaaaaagcaaacatatattacttttataatcagaaaataaacatttgtttagttaagaaaaaaataaaaggaagcagtactcttgacagcctggtgttcactttaatgtagaatccctcagccacgtgctccaagagaaggctctgtccagtcctgctgtttttggccagttgagcctgagtgccagggtgagagaggaggcaaagacaggctattctgagatctggagccggggggtcaaggaatttttatcatgtggataatcaggctccaggcgttgactataaaaagcactggtgaatggcaattatcatttgtcatttcttaaattgagctctgcatccttatatctagtttatcaatataaataattcacacctggatctctgttgctcactgctttatgcccagtgccttgaacagtgccaggtacagatgagcagtaaacacttagtgaataacggatgtgctcgtctgggagatcctacagatattctgaggttgtattggcaaattcttccccagctggaccttactcatgatgtcccagcttcgagattcacacctgtgacaattagacaggtgagatagaggcccagatgaggaggccaagctcctgagcgtgcatcaaggaaaacaaattaaaaattgaaacgggaaactgaatagccagctgtctggtcttgctttggtcccattgttgcagggataaacatttggacggctcaagacaaacacagctttgggttctgaacaggcagtgctgctttctcttgcccgccattacttaattgtgaaatctcttctttgttcagtgcagggacctgcctgctcctaaagggcaggcctattctcaggataccgcctggagctctgagatgcctgctttctgtgcagcaggtcccacttgctctgcatggccccaacagcctgggcaggattttctccaaggagaccttcagagagcagctggcaccttgggcaggctcaggcaaagaggcctgagtggaccatgcttctacatgcaaatgtttaacaagcaggccaagcatcctcaggaccaaattggctaaaagatggtaatgtcaaaatgtcacagccaaagtgacagctgtcagtggcttagaaaagaaaaggcattatcttcgactgggaagtaatgacacaaaaggagcaccagactgggagacagggagctggcaggtactagcctggctctgtcactcaaagctgaatgtttttagacaaataattgcccttgctatatcttgattttctcaactgtaaaacagagatgaattcactgataagattggcctgttttcttgtaatgaacccctacaacacaacagcaataaggagatacggaagaaatacgacattgtccttccccttcaaactgatcataacatataaggttagcacagtgcctggatcacaagaggcgttcaacagtgtgattgccaggagagtctcaaggtggccgctgggtgtgctgggcccaatgagttccatttccatgatatcacccacatgggctacctgcatcttctgcttggtgtcagtgcagaccgtgccccaccaggaccacatcaggaatctgctcccatgccatcactaaagcagtagcttactgccctaacttgtcctatagcctccaagctctagcctcacccattcagtctccacttgtcccccagctctctctgtacaacaccccctgcctcaaaatctccttgttctacaaacttcaaaaattcatttttttttttttgagacggagtcttgctctgtcacccaggctggaatgcagtggggcgatctcagcagagccgctcactgcaagttccgcctcctgggtccgtgccattatcctgcctcagcctctcgagtagctgggactacaggcacccgccaccacactggctaattttttgtatttttagtagagatggggtttcactgtgttagccaggatggtctcgatctccggacctcgtgatccacccacctgagcctcccaaagtgctgggattacaggtgtaagccaccacgcctggccccaaaattctttagcatggcctttaaagccccaccaggctgtctccaggacacttccccagactttggggtctgcaccccccatttcccagagcgccaggctccttctctgtttttcctgctcctcactttgaaggctttcttctcctttaactctcaagatcctaactcacacttaaaagctcactgcaaatgcattctgtcttattaagtattcttcacaaattccagcccacctagtggtcattttcttgtgtttaagcctggatatgtttttattttttatatcttcccgccataaagcagctcatcttgaaatgggagttttagttcaaagactttcctccctatgaaagcttttctgatcagccctactttcccctacagcccctccccacactccacaagtgcacaccgtgtttgtactcatagcacttatcctccatgcattccttcaataacttccgcatatggtgcaatagaatcaggatccttccttgttttctccagagctgaaacaaatacacttggcccagaattagtgttcagtaactcttgcaatgctgatgaagaaaattagaactgtctataatggccacatggaaggaacaagtgtcacatttgtgcagctaaactgtctgctgctccccattcactatcaccaccatacatatagaatacactacctccattttgtccccatgaatacccagactcagaattcaacctctcttaagtttccaatgcagaatccactcctcttcaagcatgaaagagcaatggagacttcagtcaagaggcaggaggagagatagaggtgctgttacacagctcagccaacagcaagtcacctccaagtccccactagacactgtccctcctgggtcacaccagactgaattgtctccctctctgccttcctccaagcagccactgacctcaccagtttctctctcctcctccaaaactccaactttaaatgtcccctctttccattttgccatcaattgacatcagccatggtttcataaccagacccttcagcacacagctcacggcagatccctcggtgaacagaacctgtctttcttgaaggctgtgtggccagcacctttgattactcaagcaccacgttcattctctcactccttcccacaaaagtgtgtgtgatattgatcccagacataacattgagttctccccaagaaggattctgagaagtgaaattctcaccacctccctccatctacagtcacctcttcactgagtttttgctgtgagactcagagataatgactgttttccagtgtccctgcctggtctttgagcctcgcaggcctcaggatgtccctactccttccatctatgagccaaatgactcttgactgagccctagcttcatgccaggacaggtggcccaaacaaaacagcttccagaatcacaatgagaaatcactccgaatgcaatatccttctcagggaaactcctgacccagagcagacccaagaaagcaagctagggctttcctagagcatgggcctggctatggcgaccaattcatccctgtttgcccaggactttcccagtttttgcactgaaagactcatgtctcatgtacccctcagtctcaggcaaactgggatggttgatcactataagcctgtcccagtaatgatccttgacaaaaaccaagggctcatgaggccagccagtgaagccaagcttcatataagcagatcagagagatgttggaaacatacagagaaggggcagaatcagccctggttgcaggtgggcttaggagacaatctcatcagaaaagggcacacaagcgagctctaggtacacgggccaggcagcctcaggtgggctactgatgcatccaccatcagcatgactgatttctaccgtgcacagggcccagctcacacactgcagaaaattaggaaactgctgcaagagggggtccctatgggctaccacaggacaagaagaacatcccccgaagaccaccaaacacacactcactcagcactccccaggatccccgcatttgtagcccttccatgagtttctggtatatttccttaaccctcttctcctctccaagatgatggagggtgtgtgtgtgtgcgcgcatgtgtgctttagcagaggaaatgtgctacatcttcccaacaacccttctccactgcaaatcccactccttgaaaatccctccacaaaccactgtacacaaggaaccgagcctctcctccatgaccacgcgggagcacttgctgctcacccccacctcccaatagccagcctcctgcagaagaccctggggaatatcacgtctcataagcaaagccaccttggcccagacagcaaggcctcctggtgtgagaagtgggtggagactcaccaggactctgccagtcagtgtctgggcggatatcatcacccccgcccagtccttcacggaggtcatccagccgacctcggcggccactgcctcctctttttcatccactggtttgagagtgccatccgcctggcttgagccattgttaatcttctgggcctcctggcaacagagagagcaagagttaagacatagggaacaatggatttaaataacatgctctacccataaagaaccagagccagaaggggtccccagctgagatggaaactagcttaaaggtataggagtaaagcagaaggggtaaattatgcctttgatttttttaaagcctttatttaaaaaagaatattttctttatttcctcttaaaatatcttagtgaaacaaagaaggatggtattattctattctattttattttattttattttttgagatgaagtctcactctgtcacccaggctggagtgcagtggcgcaatctcggctctctgcaacctccacccaccaggtgcaagcaattctcacgcctcagcctccctagtagctagaattacaggcgcgcggccaccatgctcggctaatttttgtatttttagtagagagggtttcaccatgttggccaggctggtctcaaactcctgacctcaagtgatccgcccacctcagcctcccaaagttctggtctcctcccattttaaagaaaaagaaaataccaaagcaagaggaaacgcaatctgtctaagattagggcatgctgaggagggaggaggaaagtgtgggagatgtcctgtggtctttgcctacccagcctctatgccccttttcacagcagcacccccactttcctttaggaaaattatctcttcctctcagtctatgtagttcaaaggggacagatggcctcacattggctccaacattggagtcctttctaccccctgccaacagcaattgggccattaataatcacatgatccatgccaagccaataagactcaagcgtggaacatttgcaggaaagaataggaaaagtcatccttccctgagaatgaagccactgcagagaaaagtaaaagtaatagactactgatgtcatcatttgaacacccggatccagctgtgcctgaaatctacaccagacctttccagttacaggagacaatacattccccttctggcttaaaatgtgcttgaggaaacaaggctgatttcatcagataactgagccccacacaggggccgaaactgtaaacctttgcatacagtgagtgttctgcctggaatactcttctcccacagagacttatggcctgctcccttaagtctttgctcaaatatctccttttcaatgaagtcttccctggccacctgtttaaatttgcaacactttctttccaatagcacttttctgctttatttttctccatagcacttaaaaccgctaatatacttaataattcatttacttctttcacttactgtctgccttccccactgctgcagccttggtgcctaatagagtgtctgggacagagttggctcaataaccatgaatgaatgactagaaagggctatgagtatcagcccctcgttagctacaaaggctgggtttagtgttgccagataaaatacaggatacccagtaaaatttaaatttcagataaacaacaaataactttttagtataagtatattccaaataccacatgggacatgcttatactaaaaccttattatttatctaacaatgtacatttaactggaccccaacacaaatacccactgcaactatgactgcagatgaagatgtttaaaaagatgccagcaaattatgttcatcatttaaaactctggaattaattcccaaggcaaagccacactggggatcattgtgatttggagtaaggggaagaaccaaagacagtggtgaaaagctttgtctgcagtgacaaagggggcggggcagagggaggccaggcacgtgggaggcaggtggggagggtgcactggtgagtcatcctcttggggacttggccacggcaggcaggaagctggtcccgattcctgcttctctccctctggctgcctgtggctcagggaagctggggaagagaaaagtgggacctgcagccctggacgctaatattttctttccaaatgtgttaagccccacagagctacaatgatccaagaggaggcccaggagggggaggccactgggcagatgtatctgggggctgcctgctgacatgtgtgggacctgctgcccaagcctcccaggccagcctcagataggacctgttaggtcttgccctggtccctgagcctctgccctgtgagactctgaacaggagggtatttaggaggatggggaggccctgatacagggtcaaccatggtaactgaaggtgtagattcgggggaaaatccagctctgccaccgctgtgggacctcaataagatggggacagtactgccagcccctcaggcattgtcaggattaaacagtgtccaatagcacaaaacacaggttcaagcaattatcccagcaccccttgcttcttctcgtgcccctgacaccataaagcaatggttatcacaatgagcgggcatcataagcacaccagagggcttgttgaaacacagtgtgctgggcccatcccagaacctacattcgaaccaagatgtcaggcacttctgatgctgctgggcttggaagcctactttggggaccacagctcctgactaccctagtatggctcggtgactgctgaaatgagacatggatcttcacccccagctctctcctggcctctcccttcacccaaggacagaaccacctgcttgtttcaatattggacattggtggaggggtgaggaaaagaggagggcagggagatcgtcccacatctgaggctctagtgtttccttttgagtcaagcctcccaggatgtttctgaactggtccctggccaccacgtggggacctggaagatagctccctgctcctcagtcctgggggcccaagttccacagccccttggtagaccctggagaggagaaatcaacgtgaaaaaggctgggaggcaggggggccctccagtcacagtggttaactgcatcagtaattcatagcacaagaggtatgtggcagataatgctatttcgccagccctcttacctattgttttacaaggcattcattattttaattactttatgataggcaaggaaaaacacagactaaagggagataatgcccttgttattatttgcttacactagatgttgtgagcttaattaccatgtgtgggaagcaggactgggaggagtgatgggggagctatttaaagcctgatgccagccggccagactagccaccaggctagccacagatcttgtgcctggaggaagaggcccctctctccaccactgacttcactctggccaaagcacctcttatggggagcaggcattataactccatgctccaaagaaaaagcagagaaggttcagtagccttgctgggaacatgcaggggcagagtccattataagagtgttggccaccattgaacaagccagaactaggtgccagcaactaagaattaagtgttttctatgcattgtcttgcttaaaccttataatacatccaacaggcaagtgaaattatttccattttacagacagggtaactaagagcaggtatctctcagaaaaaggcacagagcctgagagctcaggctggaagcagagagcccacctgggcttgtacctgctccagaacttccaagctgatggctgtggcccatcaacccttgagtctcagcctcttccatgtaagatggggacaaacatgccgcctcattaaggtggtggggaagctgaagcttggcacagtcccgggcacacagtggttacagctgccctgatgaagcacccgctgatggggctggggcctctaagagtaatccactgaagctgcaccactttcatcaaccagtggccctgggaggcacactggccagagtgaacctttaataaataatcacagaatggaggataaggaggtgcaggttctaacactgttatcctccaatgagcaagaagtccctataaggcaaggtgctgtgactcctgcagggcttctagtaggcgctgtgtgaccaccacccaggacagctggggcagggattcccgcacagggtggaccccagacccagtgacatctcagaccccttctgactcgccccattagatcaacctcccatttttaagatgagaacgctgaggaccagggagaggctgcctcctgagtcccagcattccgttcttgctcctggccccacaggatactgcctcacaggggaacaaatggtttgttccaaatagcaaaggggatatgcagccacgcccaaaccttccacctcccactgcagaggaccctgtccttacacaggaagcacttcccagtaggggcagcccgatgtcagtcaggaaatcactgagtgcgtgtgctcacacatgtgtgtgtgcatgtgtgagagtgtgtgcatgtgtgtgcacgtgtgagagtgtgtgcatgtgtgtgtgcgtttgtgtgcacgtgtgagtgtgtacgtgtgtgtgcatgtctgagaatgtgtgcatgtgtgtgtgcatctgtgtgtgtgctcacacatgcgtgtgtgtgtctgtgtgtgtaagggagagaaaccccactggctgcagcctccagctaccccagcttcaggaggacaggccaccagatcttctgaaatgcaagaaaagatgtcttgggaaaagaaaggaacatggagggaagaatagggagaaaaatgagaggtgaggccatcgcgtggggaggccatctcagaaagaggaggtcctgcaggagccctccccctgcccttggcagctccctgagaaagggattcggccttgcactggaggccactctggatctgcctccaaccctgccctctctccccactagagccttgtgtaaagcaggccacagctgcctctcagtggcaacagtgacatctaatttcagtgcccacatcagaaggtggggaggaattcagggcaagggtgcaggcacaggaggcagggaacaccagagagaagagtggccacagtcccctcccgacacccaccctaccaggcaacctctcacggggctgtgcccagccttacaccctcacccctttctatgccttctccccattccctttagtggtgttccccacgatgactttttgttgacatggccgcagaggggctcacccttcctatgtcacctggggccaagggcctgactgcaccccatcacctggtgctcaagatacaaacctcatctgatgcgtttgggcatttcccgctgaatcacaagatcaaagaccaaagcttgagaagggaccttagcaattcctgaggatccccaccaccacccaactaccacacacacagtgtacagatgagaaaactgaggcccagagggaaagccacaagctcagggccacccagcccagccaggtgaccaccgggccaggaagcaagccccagttgctctgtttcccttatctcttgttgcctccccgataagacaattgctccaaatctagcccaagtgacagtcactctgctgccccagcctggaacctggagttcagggtgttcctaggactggcagaaggctccacctagcctggtactgggttcaggtgtgagggtcacgacaagggctaatcctgcttgtcttcaaagggcccagccttccccagccacgacagctgctctggtctagcacaggagagcaagcttgtgctaatcctaggaccccacagccccatccctcagatttggctgtctccgtctctcatccttgctgaattagacccagtatactgggactctcaggtctgtggtgtggcaggaagaactatgaaaatcaaaagatactctggaccaagtccaacttttctgggtggcctccagcaagtcatgtcattcctcaaaccctccatattctcttctatgaacagggatgagtcctgccttgtcaccctgcctgattcttgcaggagccctaatctggtaacagagcattgcctttctgaaagcaactgctttacaaacggcaggcaagtggagtcactgtcctctggttctgggcaggaagcagggctgctctggagaaagaagtcctgtgccacaaagccagagccctcacagaacgcagggctcaacactcagattcctacccagctgcaacttgcagggcaggtcccccgttgtcaccctgcaccctaacaggatgtcaaattgccaagtctcagcaggtgacctgtcatgctgggcacaccctccctgacagggtgagctgctgccacacctgctctcacccggttggactctctcacccccaggcacactcctgacacctgtcaagctgaaccaggcaccaaggtcactgcaggcaccacacctgctggatgactgcctcaggcatgagaagctggctgggcccgccttgaggggatcccagggcccctccctgctgcctgcctagagccaagccttgaagctccaagtctgcctcgggtttaactacgtgtcagttctttggacactggttcctcatccaggatctgggaagttgtttaggcaaaggccatctgggaagaaaaatacttttcaaaaatgtaactgaaatcatgtcactgttgtacccaacaccctcctatggcttcttggcccattcagaggacaagtgaagtcttcacacccaatcagccccactcgtgcctgtcatcctgcgagtctgccgctcactagctccacttcagatgcaatggcctcctcatgctgccaggacattccagacccagtcccgtctcggggctgtctgcactggcctctgcctctgctccagagatccccgtggctgcaccctcatttctctcgagctttggttcacatcctcactttgtccatgagctctccacctcatcccgacctctccctgtctgtgctgtcttctccggagtgtgtctgccacctgcttcctttacttcatcattgtgtgctgtctgcaagctgcatgagggaaagagtttttgtctgtttctttttgttttgtttgttttgttttagacagagtctttctctgtcacccaggctggagtgcagtggcgtgatctcggctcactgcaacctctgcctcctgggttcaagcgattctcctgtctcagcctcctgagtgctaggagtataggcatgtgccaccacacctgtttagtttttgcatttttagtagagatgggggtttcaccatgtctgtttcatttatggctgtatcttcaatattgaatccctgtgagctcagagtaagcacctgacaaatcttggtgggtgggagggaaggaaggagtgggggaaggaggagaggagggaggagagctacagcaaatggaaagtcagttcttaccatgcacaatctagaatagatattactagtaaatagtactactaacaataattatactatcgactactgttttttagcatgatcatagtaactctatgacgttggtactaatgtcctccattgacagatgagaggttaagtagctggcccaggaagacacagtgtgaatttaaatccagctgtctgatgccaaaaagggacacgtacccatcctgctgtcctcccgggaacagtgtgagcagcagacgggagaatgcatgtgcaaggattattggctgctgcaaagtgcccacgaaaggtttattaacatgaagagcactcaattcatgccacttctgggtactgcttgtaccatcacgacccttcttccagggccctgtgcctatggagggcagttccatcaaggacagagaaacacagttcctttctctgccaagaacctgcccggaaccataaattcacccttcgtggagcagagtatcacattggaaatgagcgtggccaagctgacgggctgtgaagccctcctgctaagaaccacggttctctatgcagatgctgctaaaggaagatttggcttcctccctcgccatgcgtatccttggagtccttagcacgctctgcccagcggtctccagcactaagaggctgagctctgccgggcctgacgcacctgagtgggaggtagggttctgacagggaacaggagagatcaggttagcacaaaaccatctccgctagcccttttgggaccagagtaggggctgggaagcccctctcatccctggaagctggatgttctgcccagcaccctggaaccatgggatagtcccaggatgcttgacccccagagggctgtgagagaaggaagggcctcatgcctcacagcccctttgtcctcaaattttcctggtcaacatcagaaggccatttcccctgagccttcattgatggactgcgctctgagttactcattccatctgccaggagccccaccccaccctctccctggccactccattgccccatctcctctcgtctgttgaaactgacccagcagccccacatgctgctgtcctcaactgggcacaatgcagaagggctccttctctcctaccaaagggtgggggcagggggaagccttctggaccagaagctatgaagccaggcacaggctgtgtgccctgggccagtcacctaacctctctgagaagagtccctatctgggagacgagagggggtggtgagttaaatccacagttttctgtaccttgaggcccagcattgtgaggtgccccaggggggctggttaccaagggagggcagaggaggcagggccccggaccccgcggaaataaaagcgcctctgcattgagcaatttcacctattatggttctgtgctagactgcatctgagtgaagggattttctggggaaaaacattagaaatcccctgagtaaaagtccataggcccatgttagcttttttttgttttgttttgttttgttttgttttttgagaaagagtctcactctgttgcccaggctggagtacagtggcgtgatctcagctcactgcaatttctgcctcccaggttcaagtgattcttgtgcctcagcctccctagtagctgggattacaggcgtgtgtcatcatacccggctaatttttgtatttttagtacagacagggtttcaccatgttggccaggctggtctcaaacttctgacctcaagtgatccacctgcctcagcctcccaaagtgctaggatttacaggagtgagccacctcgcccggccccatgttagctttttaaaaaatgctttgtttcatgacaataactatgacatcctgtggcacagtttggcctaagatccagaagtgtctgaacctcaataccttaggaagccctggggctgctggtccctccccgcgggctgctctcctctccttcgcctcaggttttcaccagccccgaatgctggggctgggtcttccgtgtcccccctcccatgccaaagaggacatccacccagcaacctctttcacctcctgggcgggtttcccagccacgggcattctcccaggtaccaataatcctgcatattagggtattaggcagattacccaaagcagctcaagcaaatcaagcatagcatgggcaccaccagctggggttttcatggcaagagttctgcaaagggaatggatggaggaggtggttactctgagactcaaggaccagagaaatagggcaacaggggacccaggtctttcctagagctggtgtcaggagtggcagagttcacttctgcccctgggaagttgcatagtccaacctctccctggctgccatcacttctcctgctctgcaccccggagactctgcaccagcagggcttaagacatttgcactgattaattcacctagcagttactgtgtttgctaactgtgggctgtacctttagggaagggacacactgtccacagattcaggcaacaggaacttataaagaagctgggacctaaccgattaccccgagctgtcagaaagccctgtgagtttactgggtgtctcggctggacctacagtgctccaccattgaggcatttttagccattgctttctgggtgccctgtccagattctcactcttagaagcacccctgcgctgggtgtgaacaactactctttggaagtcttcatggtagaaaaaggccaggtgacctttaacaagtccttaccatcttgtgcctcaggtttctttgtctcaaatgcagggagccatgtaaacactccccaaggtctgtccagctctaaactgtctgacccggaggcctggattgttaagtcccttactttgcacgcactgtctcagctctgtaaccctgggcaagtcaatcaagcatcatttccctcccccgggaaatgctgcaggacagattccttttcagctcttctcagagccaggttcaaagctgctctcccattccctgaggaccaagggggtcaactggtgctcaggagatcactgatcccctcttacatctactgtgttctgtccttggtgattttacaccaacttaatcttcacaagaagcctgcaagataggaatgttttttctttttttcttttttctttttcttttgagacagagtctcactctgtcgcccaggatggagtgcagtgatgcaatctcagctcactgcagcctccgcctcccaggttcaaacgattctcctcctcagcctcccaggtagctgggattacaggcacccaccaccatgctccagtaattttttttttcctagtaagatggggtttcaacatgttggataggctggtctggaactcctgacctcaagtgatctgcccgcctcagcctcccaaagtgctgggattacaggcgtgagccaccacgcctggctgcaaggtaggaatgtcatgaggctcagagagattgggtaattttccaagattacccatcttgtaagtggcagagctgaaatttcaatctagtccattctaactctgaaggccatattttttctctctattccacactgtcttgggataggtccaatgtgcaagaacagagatggaatctccatataaaattctgtttactactactactgaaacaaccatctcacaacctatggcttctaagtaacaaaatcctgtagtacagacatctaaattcagttataatccactatgtacggacagagagttggagaaatgggctaggggacggggatccaacctgggaatacaatgctcattagacattagatatgttctcaaatggccacatatgctgcctaaaattagtaaggcaacctccaaactttcagggctaatacatacatcctggccaatgtgccgtatttgtaaaataacaatctccttctctttcaattagcttaataaaattggaaaatataagtgacagtccagagtccactatcagagccatagagactttgaattggattagtagagtcctcagccaggatgaccctggcagggtccaagacagcctgctgtccatcagagactcggagactcagctgccagtctgcagggcagcccatcctgccccagaagctcagctcaagacctgcccagacaagaaaactgtggcaggggcccagcaggaaggcaaaaattacatttgtttctcatcagggcagactgggatatggataaccaaacacacaggaaatcccaaaccctcatgttcataaaagaatgcagaaatcttcgtgccaagttaacttttaccggagggagcccattgccatcctgtagaccaggaggaggatccagcccccaaggagcctcactctcctcagcaaaggctcctgcaggtagctcacaggtgctctgttcccatgggtcctgcatggccacagggcagtgctgcccctgatgtggtacggaatgaaaagcctcagtacagcgcactgtgtgtgtcagtggaagacaactgatgaagggcctctcccaggaagaactgtccttttctttgacattatatcgttactcctttgttgggtattaacatgtccttttaatgaaatgacaatggtggcagagctggcatttgacagtttctttttttatgtttttgcttgtcaaaataaaaagctggtggccttgtgatattctgttttataaaaattcattgattatcccacaaaaagtctaggaaccactcccctagcccaaatgcctcattctacaggcaggaaatttaaggccccaatattccacactcatagtggccaggttcccctcgaaaaatgtggctttcagacttcaggggcccagggtgtgtctgtcacactagccagaggcagccttggggccaggaaaggtagggtctgagggatggaggcatggtctctcagggctggaggagctctgcaagctgctggcccacacaataggggaaaggggaaggcaagcattttcagagctcagggccataccaaccgcctgagttcctggcatctaatgccttcactaccactactgcaggaaatgcacagaactataacaacctcccgggaaatactacaagtgttaccgtggccccaagccaccacccaaggggcaactgggaagaaagaattcaaccacagatagcagataggatgaattgtttatggttgaatattcccttcagagtcaacagaggactccaagcaatttggagtaaaaagatgagtaacccgagagcaatgtaagtcacagcccagtgccccacacggaagggaacacggtcatccccttcgctgctgttctttgcttcccaccactaccaccttcatcacacacgtgtgcttattctctagcagtcagggcagagtctgcctgatttgcccactccacatcctcaaagcctgaacagcacctagcacacggtgagcatttcacagtgcactgaaataataaatgaagaaattctgttttttgttctgtcctgctttgttttcactcttcgctcatatcttctggaatctcaaaaatcctgccaagtccacaatgccctaagcatagaagtcaaactcctcaaggcctgatcttcaaggcctggagctgaggctgccggctgccctccccactcgtcactgacctgctcttccacctgacttctcggctatgacttggtcctcctgactgccacacctccgtgctggctgttcccactcctgggatgctctccccattgctccccaaccatcttcatcctccctgatcaaatcccagaggtgcagtgaagttctccttcctggctagatctccccaaagctctccctgtcctgtctccagggcccacatctgctcccccaattccacatgggacaggtacttagctgtcttttggtccatgcatgttgcattgccccagttagcctggacaatccttgaaggcaaggcctatataccttttatgcccaaagtgtttggcatacagcaatgtgcttaacagacacgtaccgattgagtaaattaaatctctgctcagtgggcactggaaaagcaagagctttcccaggcatcactgacgtctgggtaaaccaggccagtttccatgacttgaagcttaaactgggggttggctcctaactgctgttcctcagggcagctacattttcaaataaaaacactaaatcccaaatgagatcagatgacatggagcttctgagaggcacatgccctaccaggcatgtcagtcaaaagaaagatgaatgttcttgtttacaaaaggatttgtcccgtgccaggaaaatttccaccatgatttaggacctaatccagtctgtgcctatagacctcaccaactgaacatgttcccgcttcttccatttgctgaacttggatggggcttggcttcgggtcaaaagagctgtcccaattaggtcgtcagacagcctttccccacacttaagatgatccccattcaggaaaccaagggctagcaagacagacagactttgggaggcagaaagatggccaggttaccaggcatacagcggcagtcaggatctaccgctccgagcacagcccagcctgaggaaccaggctcccagagctgccctgctccctggactctgcctctgacctcaccccttggaagaactggctgggttccaaaacttcagcctctatgtccctgggttcccacacaccctagtttggatctaggtctccaacacagcagccaaacacaagagagtccagagcagttgctaatgtgaaataaaaacaattcaacagcccagggaaaggagacaggacttctttttccattggattcagagaactccttctccttttccttctcgatccctaatgggagttaaggatggcaagcgcctggccctgcaaagcctcaactctctacttggctccgctagacccatcaatcttctctccatggcctgggacccctccaaccctggacgtcgagagagactcggcagctgtgagaaccttctttctcaagtaaggtttttttccaaaattatatcaggtttccttctaccccagcttgtcagtgggggactcttttgcctaacatggttgaggaatgtcttagaaactggtgtgattcaatctggcttctgatgaggttttccacccagacagagctcaccgagtgtctggaagtgtcggttccctacacccaggggcatccacaccctgtccccatctccagacctcagtgaggaggatacccttgacaaagtggctggtccagccctacgatgaagttggatccagaaaaagagccaagaggaagccaaaaggacttgcccacacacttgcatccacgggggcctccctcctaccatgtcccctctttcccccaactttctaaattggtgaatctacttgcaacacacccagtataaataattgaagagctcccgatggaagtggctcaataattgaaatctcaaaaggcacacacctttcttttagaagagagggccacctcattcagacttctccaggggaagtcgttcttcccctcattccttttcagactggcctccttctacaaatacagattttaaccagagggtaattgttagaaagtgcagtttgcaaaaatgtcagtaacctgaatgccaagtttactaatgaattgtgactaggctgttgttagtgccgccacactctcacctgaagacccacaatctcccctggacagagggaaactggctgtccctctgttactgctcagctactgcactgaggtggggtggcaccagggggactggcatgaaggtcacatgaggggagagttccttttacatctcagaagtctcttattataaggatctgccaactgcaaggagagaagagccctgcagagcagagggacctgccagagcgctgcaggcatcaactttgctggcgtcttggaaagacgccccacgtctccataacaactaaccatccagcccttagcactgacagggatggagaccttttttggaggagcagatccggaagaaaggtcaggtggttacctgaatcccaagtctctttgttttgttttgttttgtttttctccttttgcagctgtttttcttactagaagctaggcagaaagagttgttactcagatttcttgaacttgagacgtcaaaggtgagacgccagccaaggagaagggatggtcagggaagcttctggggataccgacagtattttattttttgaactcagtggtagtgacacaaattttctataataatttgctattttgtaatttttcattttatagacttttctgtctatactatttttttaaagtctttaaaaaataaattgggcaaactgctcttcagggacccatcgtcattgccagcatttattaagtatcttctggcacaggacagaaatcagtctgcaaatcaccctgtgtcacagccctggaaagcaggactgagaaccagaaaacttcagtggaagtcattggtcccagtggccaaagcaccaaactgaagaagaaagtgaagaggtcaggggcaatcacaacaagtcataggatcaatgggctagaggccccagagaacttgttgatgcagtttgctgttatcccagctttagagctctgcctataaacaaagtcatagagaggggaatgtgattcatgatttgtacctgccttggaagggcctgaagtgaattggggtacgcagggccctggccatcagtgaaagagtgggtcttctgctgccctgctgatccactgctgagggtaactcatggtcccagcacagccttcactgaactgtcaggcacatgaagcaatcaggagtctagattgagtttccaaaacaggagcacctctttgctctctgtaagcctccactgatggctcatgccagccacatggctcccctagcctcccctgcacccaccggaggctgttaatagacctgtcattgtgctcatgttggattaatgaccactgttctccttcccaaatcctacacattgtttaagagaaagcctaaacgctgcctctgccatgaagcctctccagacctcttcagtagagctaacgtctccagggctgtttgctcaatacttcctttcaggtatcagtcccctcagatatcacttgtttctctgcttatcagtcctcattacattctagtccagtggctacatccatcagtctcccggctaagaacctgaggtcaggagccagggcttattaattcttatatttcatagcatctagcactgggcctggtggatttgtagcaggtgtgcaacaaacaatcaatatttattaatatatcagggtccaagagcacagacccagtaaccaggaaggaaggttctttaggttgtcagagaacacaaagggcctggcaggagggaggccaagcatcacagagaaccttcacctttcaaatctacccacttctctccatctcagcttctctcccctggttgactcctaagcttcataatcatttacattgtatcatgcaatggtacaattcccacttagttctgcccctcattctccacactgaagccagagagataccacaaggtttctatcagtcacatcatgcctgtgcttaaactcttctcagggactcccccttgctcttaggcaaaagttaaggccctcagcatggccgtcgaagatgctctggcacatctggcctttgccaggcatctggccacatactgaaatactcttggcctcacctcccttaatccacagcaatactggacattcttgcattccttcaatgagcactcctcttttctaattcagggatctgcatgtcctaggtttccttttcctgtaacaaccttcttcacacagtcatattccagatgtcctactcatatttaagatctctccccaggaagcctttcctaactcaccctccacctccactccaccaccaccattgctatcagtcaataaaaccttccaatcatgtggtctttgcactgctccttcataacactcaaggcatttgcaagtacttgttcagggcctctttgcttcactagactagaggtgggcaaattgtttctgtaaagggccagataggaaatattttaggctttagcatatggtctctgttgcaactattcagctctgttgctggggggcaaaagtggccttagacaatatataaacaaaggagtgtggttgtattccagcggaattttatttagagacattgaaatcagaatttcataccatttcatgtttcatgaaatattcttcatttaaaatttttgttcaactatttaaaaatgtgaaaaccattcttagctaatgggccatacaaaaacagatggcaggccagacttggcccacagcctgtggtgtgccagctcctgcactagactatcagtttcctagagacggaagccacgtcttgttcacagatgtatctctccagcacagtgtcttgttctcacaaggcggttcataaaaattcactgaatgccttgatatgtggactagagccatgtttcccagtgtaaattcacggaacaccagtctgatgggaaactccatacaaaagggacacttctctttgcagtgaaatctggaaatgccatcattcctcttctaacaaatgttcaatgctcactgcatacagcatagcaaaagctcagagatagccttcagtcaaggaacctgttcaacatagaccaatacaatgctgcccacactcattttgaccaaataactttcttctttaacccaaaatatctgccagtgtccaagggcagccccactgaaaagtgatgcagtgaggagagacggcagaatttagaggaatgggtctcaaactttagtgtgcatcagagtcaccaggaaggcttattaaaataagaaactaccccagcccagagtttccaattcagtaggcttaggttggagcataagaatttacatgccttacatgtttctcagctgacgctaatgctgatggctaggggaaccccgttttgagaaacactgatctgcagaataaatgatttcaaggcttcggtcctctagctggagtttgctcctccatccaaggatcttattcccaggtgaactccaacttgtccactttctcacactggcagtagcagctctgacccatctttctagtcttaggcacctgtaatgggttgcagtgtttttttccaaaagatttgtttcaatagtaatccccagttcctgtgaaggtaagccttatttggaaagaaggtctttgcagatgtaatcaagttaaaatgaggtcatactggagtagggtgagctcctaatccaatatgactggtgtccctaggagaggaggaaagagacacacatagggagaacgccccatgaccaaagaagcagagactggagtggtggctgcaagtcaaagactgccagccaccagcagaaacacggaagatgcaaggaaggagaaaccctacaggcttcagagggaggctggccctgctgacatcttgatttaagccttccagccttctgaactgtgagacaataaattaacattgttttaagtcaaccccgttgttatggcatcactaagaaacattctagtccaaggacagataaagctctggccaaggccttattcttggtaggtgtccacatgaactctgaaggaggaagccacgatgtcagctgtctgttccctttgtcatcactgctagacagtgggtgtctgcgctggggtctgtttttggaaattagattatctaattaatgtgatgttttgttggatccatgccttagggctggatttggcaaaaagcatgtgattattttttactcttaaaaaaatgtcactaaataagataaggagacttggctttgccctatcttgggctccacatgtcctgtttctcactgagagaccctggcaaggagtttctcagtgacaaagaaatggtttcttctcctctagttctgagctataaacaccttctctaatcgacatagaaacggctaagcagtagatattttcagtcagagtaccccagttttagtcataaattatatgcctctccttttggaaatataaggggtataatttttattcttgggcagacatagtcctgtgcccgataccttaggaaagagccaaaaagagaatgtggacacagcttgtcatggtggatggagaggaaggagacaccaggggtagggactctgtattctgaagctctgaggccacaggatgaaaaatcagagccaagtgaatgccttctctgcctctccaatccatgccaacccagggctggctgctcacatggggtctgcacaaacttgaaaatctccagatgttttataggggggacaaagccacgctttctgctgcaacagactgtgagacttttaggatgctcaccccaaggcccttgaaaaatgagagaggggtctgattctttgagatgggtaaggcagaggcaccccgtggaagtcaagcattccttctctcttccctcccaaggccagcatgtaatttcaaatgtccagtccatccatgaacaatatgttagcctttggccaggcggtgagcttccaaaatgcaaacatctcagcctctgtctgcagaggtgagaattcagcttggcagaggaatgggacactgtcaaggaagacaagcttttggagtcagacaatcccaggtttgcatattggccttgttttgttggtttgttttgctttgtgttaaaatctaatttattctgcaaactacagcaggttagttaatcctttgaaacctcaggtttctgagctataatacaggaataattataagtgctttgcagcagatttgtgaggattctgagagttgttggatgtgtctagcacattccttctaacttataaagcattatatgccaagtatgaatctaagtaatgcacatgccctaatcttttccatccttacaactatttatagcactgcccccatatggcaaatgaaggctcagagaggtcaaggcacctgcccacagtcacaaagtcagtaagcagctgattctggagctggtgctctcaccacagggactgctatatacccatagtggaagcctggggctaggaatgaagatctgtgttcattcattcattcattcattcattcaacaattcacctgggcatctctgagagaggattactcacaacaggttctcagacaaaaaaaaaaatacaatctctccttccaggagttgaagatctctcaggggaaacagacaagtacccaaaactaaatcaaggtagaatatgacaccagggaggaagagagtatggcagaggacctgttaaatggcaggaacagactgatttaatgaaggtggtggtatttctgctgagcctcaaaggataggcatgattttgacagatgcactcagcctggttcagtccaaattagggcccccttgttctttctcatcacaacccattcatttcctttgttggactcactgtgattttaatttcacagctatttgctgatttatttgttcaatgctggtctcccacactagaccatgagcaggaaggagaggcagcatgcaactgtgctcgttgtctacacagggcctagcactgggcctgggccagggcaggcacctgggaggtatgtgctgaataaatgaatggatggatgggtggatggatgggtggatggatgagtggatggatggatggatggatgagtggatggatggatggatggatggatggatggatggatggatggatgaggatataagtattggcaggctggtggcagcttgcagaaggagagcacattatctataaacacattgccccgatttatttaacattgtagtcactccaaatcttggttaccctcacctgaattttctcttttgggggaagttttacacaaccaccccagtttccctaaatgccccctccctggattcctgcagcacttgaatttaggcttctgagcactggtatctccccaaatagatgagactccccatgtgggcagcagccctgccttctccttcatgtttgtccacagtgcttgggtgagatctggacatgtagcccacactctgttgaaacctgcccatggcatgcagctgaggggccctgccttctccttgtcctcatttattgccatcagtcaaccaccaatcatcccacatcgaccccagaggcattggtcttggggtctccctggtgcggcaatgtgggctgccttcccagccttgtccaggtggcaggacttctgctgctgacaacagggctgtgatactcagctccccaaggctgaactggatgactaagagtcctaatgattctggtattttttcaggacctgtctccaaaggcaggaggacatttaaaaatgcatgggtctctgctaggtgacacatcctgcttaggagtctgctggcctccagtctgggacaacagagcacttcaaataggcacctgtgttcatcgcggtgctttctgtccacacagggccttggtttctgaggctgagagaggataagctaagcaaggggcagaacaggacaccaaccatctccagaccccagtacaacacagatggcaggccaaagagggactgtgtcgtctgattcaagagtacagactacacagccagaataatcggggcctggcttggactctctttaaatattcattcctcatctgtaaaatgagcatatgagtcccacttcaccagactgtaggacatacgtgaaggactctgcagtgtctggaacatatttatggcccctgaaataaacagttattgatgacagagatgaaaagaagaagatccaatggagtaatcttcaaggcctgcttcaagtcttgccttggtaaagctttctattgggcactcatataaagcttatatgacttttttttgtatataacagacatgtatatatgatgactgtctactgggtatggttctgagcactccctaaatagtaactcattgaatcctcacaacaagtttatgtagtatgtactattattatgcccattttacggatgaggaaaataggcatgaggggttaggtgaacgactcgaggtcacacagttataagaggttgagctgggatataaatccagacagtctgcgctagagttcgtgttagttaaagatggatacagtgtgctgctgttattattcttgtagatgttgactattatagtctcttgtcttgcggagcagagctagtctctctcccactttcttgacaaatggtaggggcctcccctataacatctctgaagcccctgcagcacttcatagagccagtcagagtgagtttgctgacccacttgccaggacttgctgtgccctctgccttcttcaaggcatccccagcagagccttaaagggcaaagcctgcacacctccctctgcagcactgctgcatgccccacctccttccagggccacgctttccaacttgtgacctggacccaaagtaagaaatacattttacatcgtgacccacacatacctactatacaagtaattgcaacacaggattcatgaaacaatacctacactattacatggaatgtactttgatatcctgtattttttaacattgattacaactcactaaattgatttcataatccacttagaaaattcctcttaggggagttcagctccaacatctagcacatgcaatttctgagtgcagtgcacagcaattcttcccaaaggcagcccttcctggtgcacatcagcatcatggtgctgtcccagcccagatggtcacttatatattccccagagccctgagcctggctggagcacccaggcagtggaaagtcaatacaggctgggaatcaaggacccattcaaaacaatgctcacagcagacacagagtgaagaggcttgctttagagtatgatagaactgagctcaaatctcacctctgctagttactaactcagatgttattggacgggttcttaacctctgtgagcttcagtgccctcccctggaagggggcactatcaatatgcaccacagagggtgttagctgagatgtggagatgacttggcacagcacccagatacagatactgaatcagtgccagtcagtggtggtgggaggtctttgctaacacctcacaagggccttccctcccctctctttttgtctctatatttagagattctacaaccttcagaagaaatagcagtacttcctagcacataggtaacactcaacaaatgtctgaaccaattaagcaagggcccaggcttttgcccaataagtcatccaatcctgagcatccatccattcatttatttatttatttatttatttatttatttatttatttatttattgagatggagtctcgctctgtcacccaggctggagtgcagtggcatgatctcggctcactgctgcaacctccacctcccacgttcaagcaattctcctgcctcagcttcccgagtagctgggactacaggtgcatgccaccacgcctggctaatttttgtatttttagtagagacagggtttcaccatgttggccaggatggtcttgatctcctgaccttgtaatccacctgcctcggcctcccaaagtgctgggattacaggtgtgagccaccatgcccagctctaagcatccttttgaaggaagatgtgttttataatcccttctaaattcagtggccaataaagtctgctccgtgaattacactcattcaatcacagctgatatctctagatcaaggacaatgcccctctctacaggtgggaagacaaaaccaggaggtcccaatgtggcttctccaaggttcccccaaagttactgtcagtgcagagctggggtgacagagcccctgctcatcactgcctatgttgccttccaagagagaagcaagttgctcaataaatagctcatcaccctaaaaataacgaggtctctgatgagacttagtctctaatgaaactaagcacaggactgagggggtgaagagcaagcagaaaatggatttccaccatgggctagactgttcacgtggcccagtggtggagagaatccttagggaaagcctaactccgaagcccagagaaggaaggaaaactaataaggagtgtgttttgcaggctgatttttctgaagttatccataggaaaattcatttatgtgagaggctaattagtcatgacagtgctttgctccagacataattgcattggtcccatgcagtctctgtgggtcagcctgtaatggaatttccattacctattgtgttttggttactggagaaaaatgtgtgattggggaagaaagagggatgaagagaaaacatgaaaggctggaataccttgaatatccataaaaaccatctgtgattttaaaacttcataaagatgatggatctctaagagccagatagtcttcttggaatctgagctctgtctgcgggaactgctcctggcaggcagtgggttttgaaatccaagtttgtcagaccacagagcaaagcgagctgccccagcttggccactaggggtggaaacaagacccaggaaagggagactaaatgttcttctcaactagccaccagctctcaggctgccaggaatgctgggctgtggtaaatgaatatatagatatatagatatatgggtctggtgccagaaatgtgcaggtctgcagggatgagtatgaaaggcctcacctctcctgccttctagagaataatatacagttcaagagccaaagatgcctgagggtgaactggtatgccaagttcggaagggtcaccaaaccacctaatcccccaagtgttagagccaggaacagaagggggttttaagttcagggtttctcaacctcagcacaattgtcactttggctagatggataaactttttgttgtgggaggctgtcctgtatattgcaggaggtttggcagcatccctggcatctatccagtagctattctcctccattccacccccatccttaattgtgacaactaaaatgtctcccaacatggccaaacgtcccctcgagggcaaaatcgccaccatttgaacatcgctggtctacccttacaattcccaaagtagaattccaaggaatattaatttcataagcttctccccaacacaagtattctatggtcaactaagtttgagaatcactgcatattgtaccctcttttggaaattccccatagtagtctattaaaggccctaaaaagttctgcaataagaagaacactatttaattgttttgtttgacctaacatcttgcaagctttctcaaacaaaacccctttattcctatatttgcatctttcagagttcctgttccaaagaatattgtgatttatatatatgttaatatgtatctatcatatatgtatatatatgatatatcaggcaacccaacctttccattgaacaagaggaactgaagcaataagcaagtcagggttcaaaatcctactaagagatgagtgtcagagccatgcatagaagctgaagtcctgattcccagtctacctccttctcttacacaaatgatttagattaatcctcaagaagatacaagatacaagaaaccatcctctcacagccatgtcacaatttggtttgtgaaaggaaagtaaaatcttgggaccctcaactcactatgccaaaagaaagagtgaactttgtcatgcaaaagctgctttctctttgttcctaaacagattgctgcaagagagaaggtcacctatctccccaggtagcctctctcaccctgacaatgtatcttcacaggtaagggacaaagacaagactagaaatcatccctctgcccacctcaagacaaatgcagatctgacttcttcttcctctactctatgtttactttatcttatgtaaaatacaagatttactgagcaggagccgaatgcactattgagtgtccctctttttgctccttcccactctcctgcctttaaatactgaagttctcaaaaccctctttggaaaaagcacaggccacagagtctactgtagcctttatctctttttcctgggctcatcctcaaccttggcaaaatgaacctctaaattgattgagaactctttcagacatgttttggtttataggctccaccaccaccatccagaatactcacctaggaacaacgcctagtgaaacatcagcatttctgttccccaggagaacagacaaagcaggcactttttgcagacatagttgagaaggacctcacagtggtcataacaagggagggtgcaaggaggcgccatccacttacatcatgtccatgcacctgctaatctactataagtacaactcccatgagaatcactaaagctgattcgtctttgtatcaatgcaatacatctttgtattgtggcgagcacagagtgggcctccattaagttaggtggaaggaataaactgttaggcaacacatgctaaggacttgtccatcaacatgccttgattataattcacagatcgtcaccaacacaataaagcctccccaatcctctctgtcctcttcatgattttcttgggaaatattctaccctggcctctccaggctgcagggaactactccttttaggatggcagctccccgcttccctgacacatctactgtcatctcttcacttgcgccagttcagaaagataaaagatcaatttccagctcagatcagccagcccaatgtccctcctgaagacagtacatcaagggaccagtttcctatcattctaggtagaaaacatgcagtgactggtcattcagtctcttgatggtctctcttgccaaaagcaggcactggagaggccatagattggctcccattctcagattgcaaacaatagaactaatattgacagagaaactggatggtatgacattctacaattttgcatggggattgaaatgtaatcataccttgaggcctctggtattccaggaatcctctttcagccctgggaacagaacagtgtcctagggatttctctaatccttttatgacattctaagcagagtgtatggatgcaggaacagccaagagtctcagccagagggcagacctggggccccctcttggtttaccttggctccagccagtccaaagaatacacaggcagcttgcagaccactgagttgagactaagggctcagccctagggcagctgcaacacaaatgcagcagcaactgctagatatttgcagcatgcccctgaagtctggtctgttgtaaaaaaaaaaaaaaaaaaaaaaaaaaaaaaaaaaggccgggagcggtggctcacgcctgtaatcccaaaactttgggaagccgatgcggatggatcacgaggttaggagattgagactatcctggccaacatggtgaaaccccatctctaaaatataaaaaattagccgggtgtggtggtgcacacctgtagtcccagctactcgggaggttgaggcacgggaatcacttggacccgggaggcagaggttgcagtgagccaagatcgtgccactgcactccagcctggcgacagagcaagactctatctctgaaaaaaaaaaaggctcacagcaaagggtgtggaggttgggatgctcagcttcggggcaggagaagcatacagcaagcctctcacacctgcaggactccaggctcccagagccacagctgcactctacctctctcctttcctttccccttctgagcaccttcgggttactgggataaagtagtgcttaatgagaggccaaagggactttgcctccttgaggctttttgattgctttgcacaaaactcatagaatcaccttatgttccttcacttaatcagtcacttatgagcactattctaggcactgcgtgaggctgggaaggccctgctcacctgttactcttactctgttatgctcttcgtaaaatccatcaaaaacaagcagtcatcctgcttctcttatttccccatttcacaactgtggaacccaagtacagccatccagtgtcagactcatgaacttcagaagcagaagcctgaagatgagctttggagtcactgtcacagcaacaagccaactggcatgcagaaatgaagagactcactcaaatgagggacctaaatcccttctatggtcaatgagaaacagaggcccatgaaagggaaaggccagatacaccctcacacaaggaagtggtggcagagccaggcccagacagcagagatctcaaaggtccccattttcaatgttgtgtttcttccatactgtcatttcaaaagagccatttaaggctgggacactctggtcccactcaaaaaaaacaacaacaaatcattaaactttcaacttttaaaaaactaccaaacaggttgcaaaacactttcttatcctacacctgggcgagagagacttacagagggggaaggggcagggagggaagaaggagagggtcatgaatggtgagggggaagggactgagtgagggtggaagtgttcatgattgggatggagtagagattagggagccttgaacctccctgaaggtgagaaaagatcacggatatctgttcatgaatttaaaaagactccgcaacttcatattcagagaggagcaggactcaggaatcaggcaatggtcatgaggtaagtttcaatttttcaaaacaaaggtgatttcatttttaaaaatttgttgtttatttgtcaagagaaactatttatttttatttttattttgagacagagtctcactctgttacccaggctggagtgcaatgctatgatctccgctcactgcaacatccacctcccgggttcaagcaattctcacgcctcagcctcccgagtagctgggactacaggtgcacaccaccacatctggctaatttttgtatttttagtagagacagggtttcaccatgttggtcaggctggtcttgaacttctggcctcaagtgatctgcccaccttggcctcccaaaattctgggattacaggcatgagccactgtgcccagccttaagaaaaactatttcttaagccacatattcatgttttatagttcaagaacacaggtcagtgacaaatctctaggtaattcttcccaaaggaatactttatattccaaaatcactttgcactctgaaagatacctcatctcctcaaaatctttcatagaatcataatttctgtagaatccgtgtatgccttcttttttagttcagccacagcaaagttacagagggttgcaacccccagggaaataacaaatgcgccaacaatatgaaatcacagatgctcagccagaaggccatgtatctgaggttttgtcaaagcaccggaagccacagtagttattatgctcaaaaggtatgtcagcctcaacaccagcatccttcctggctgatcgatttcattttttgacagatgagtttgacaccgccaatcagtggcaccaagggactgtatcataatatcctaatggtcccgaggctgattcccacgccacaagggtaactgcaattccatcaagccacagccaaatacagaatgcctcccatttaggaagctcagttaaactttttatgtcaccaacacgccccaacctcagagttgtcccttcctcactcaacacacgggacatttatcttcaacgtcaccacctagcttcaagcttccttcggcttccccaaccacagtccccactaactacaagctcaggccagcgctacagcctgctgaccactggcaaggggccttggcacatctagacatctgcagccaggcctgcctctcaccttctaggctattttctctgtagaagaacaaactgcttgaaaatcagactgcaccagaacaggcattcttcctgctgctgtggaagtgtgtctcgttcctgtggaaaggaggtatcttgttctggacagtgtgggctggagctgctggcggtcagaacagggaagatcgtgttcaggaagaacaccatccctgagagaaccagtctcccgacacacatctcaaggccagcctgcaccagctcaaccctctcctaagcgagaggctcccctattagcgtgatgcatgtcttggaccattatggattgacatacattcttttgtatgaagatattcaatgctgcacatggcatctctcacgacaggacccccgaacccagaacacagctgctgaggaacaggtgctccatcaatacgggtgaaatagatgaatacgtccaagtgccggtgtcgagcactggaaatacaaggacgataaagacaccacccctgcctccaaggagttttttggctagtgggagattcccccttgttatttgtcactggtggggtcagaaatggagtcaaggtcagcgggttttggactaatctagaagaaggactggatcagtgcttcttaaatgtgttattcacatactcccatcacaacttctgccctagctgcatgactcctatgctattcactaaacatttttctttcaatggagtcaaattttttaactaaacaaagatatcttttttggggagagagtctcactctgcctcctaggatggagggcagtggtgtgatcataactcactgcaggctcaacctcccacttcagcctcctgaaaagctgggactacaggcatgtgctaccacacctggctattttttttttaattttttgtagagatggtgtctccctctgttgcctaggctggcctcaaactcctaggctcaagcgatcttcccgcctcagcctcccaaagtgctgagattacagcaatgagccactgcacccagcttaaataaatatatcttaaggatactccgtaacattaccacatgtgaaaaactggtatcaccagtgaagaaatagaagataaccttcaaaataaacaaaatagaagaaaactttcaaaataaatgcaaaacaaaaccagggtatgaaattctaggtagatgcctccgtttgcatgcagtctcaatgggggctgttctgtgcctttgttcaaaagggagacaggcaagggttaagagatgttcaaacagtaaaccgagactttctccctgagataactagaaagactggaagaaaactggaaatgaactaaatccctccttggtgactcagggtcctgtccatatatcactagaaggtatctgctacaccacctgtggtgtggggaaaccataaagctgaaatgagctttaacatttctttcaacatccaggtcctataacaccataagcagattatttaatgtcaaagaaatcaagcgcatggaagaaagacagcacctaaacaacacaggtctgttgactgaattagatttccaaagtttctggccctcccagattcattatatcctatggtcttcgggttacaaatgaggacagaaaagcagagagagaggagggaatgtacccaacccatccacctggcagtgacagagctcagaggtcttcattttggatgaaccatgggacccagatgcctatgaaaggggaggacttgtaatctttttattcccgatcttagactacctgtgtgtgcaatatgtgtttccaccactttgtgaagttcagccaaatggcccttaagaaatgaaggcaatgacttggtggaggccctgcacgtagagaacgtcagaaaaggctgaattggatccccagatgttcctaagacctgctgggggaagcttgcacaagtctggtccaaaatccgtttgtaaggaaattggtgaaaatcacagcaaagctggccttcacaggccacatacccaggccctgctctcaagcaacatcaggcttggatagatttttccagaaccccagatagagctgggctaacttaacaggttgaattcaaggcgtaccaaactttaaaactggaattggagttgactatttatattacaagaagattcttcactctccaaaagcaaccctttgtcgtctgagcacccctaaagacttaagtgtttgttaacagattactaaccatttggcaggagtgcaagcactaaagaaaacttgcagagaaaggaaggggagggaactggaatctctgcaccattggttcgccaagctttgtgctacatgcttcacttacagtatctcatttaactaatcctcccagcagggttaagaatctccattatacagaaaaggaaacagcacagagaagtgaagtaatttggccaaggtcacacaggtactacagcactagaagcaggggctgtttccagcagcacatgacatggaacttcctaaggaagtgccatttgcattttgttatcaccatctactaaaacatacccctctggcacacagtgcaataactatttattgacatgaatatacataaatgctaagaatgccatacacagtaaagatgaccatatggagcttaaaatttattacaggtcagaggtatcaaaagaaaattatctgaatatgccaggctagcaagggaggggattcttggtgcctaaagtcctactattccagtcttctttctttacacacacacacacacacacacacacacacacacacacactccttcagccaaaatgttccactttagtggagggaaaagagagcctggagccataagtctagcttattgctgatgcctggtgttccccactctgcctcccaggatctggaatttatcttgaccaccagacagagcacagaactccattacctagggtgggccagggctgccacggagcagcattgtgtggctgtaccctccagaaactctggatgtaagatggaaggattgtagtacctggtggacaataggtgggaaaggatggagggtaaagaaaagcacaagacagggagaaaaaggaaggggagagtgggaggatgggaggcaggaagttcggttaaaatatactgtcagtggcaccggataaaaataatagccttttctgtgattgaaagcatttctaaaaatcaaagataggaacagctgctgtgctatggtggtgggattatgactgcttttgtaaatgtcttttaatgttcttatatagttttacagcaggtaaaattttggagcagaaagatataaaaacattcatggatagaaaattcagaacaagtcaccaaggggaacttggtttgtgataattttataaaacagtgttacatacattcctaacctatccccaggccccctgagagccacaaccaagacccattggaccaagcttctgaatttcacagagcttaatgggcttctgatggcaggggctagtcacccacaaagagaggccacaacatacagaggcaggaggcctgcaccggggccaggaccatgctctgtggacaaaatagatgatttcaggcaaatcccttacctggctgactcgggtcgtcttccttaaagtaagaggctgcatgcgatcaggagtgacaaactcaaatgctttaaagagttaggctgggatcacagaactgaatgggccatcagagcctatggtggcctggaaatcacacacccggaggccaagggtgcagctgctacccagacctaggtgaatgctgggccccatgctgccagtgtagagaagttgggaatctatacttttttaaatgtttggtttaattttaattttttttgtttttagagatgggatcccactgtgttgcctagagtgaagtggtgcaatcatagctcactacagctttagactcctgggctcaaagtgatcctcccgcctcagcctcccaagttgctaggactagaagcatgggccgccacaccagaagaaaactagactttcatgtgggctctaatttttctgttggcatccagtttctaaaaaacgtagtaccaagcacagtgcctgaatctgtaattccaacactttgggaggccaaggcgggcagatcacctgaggtcaggagttcgagaccagcctcaattaggagaaaccccgtctctactaaaaatacaaaattagccgggcgtggtggtgcatgcctataatcccagctacttgggaagctgaggcaggagaattgcttgaacctgggaggcagaggctgcagtgagccgagattgtgtcattgcactccagcctgggcaacaagagcgaaactctgtctcaaaaaaaaaaaaaaacaaagaagtacttcaaatgtattatctcactactctatgatatgttgtaagattggccccatttttacaaatgaggaaactgaggctcagagacattaagtaatttgcccaaggtaacacagctaaaaaggggcagagccaggattggctactacaaagtccttattccttctctccacaacattttattaagaaaatttcaaacaaggccgagtgtagtggcccaggtggctcatgcctgtaatcccagcactttgggaggccaagacgggtggatcacctgaggtcaggagttcaagaccagcctgaccaacatggtgaaaccccatctccactaaaaatacaaaaattagccggggtgatggtgcatgcctgtggtcccagctactcgggaggctgaaacaggagaatgacttgaacccgggaggccgaggccgagcccagatcatgccactgcactccagcctgggcgacagagcgagactctctcaaaaaaagaaagaaaagaaaagagaagagaagagaagagaagagaagagaagagaagagaagagaagagaagagaagagaaaagagaagagaagaaaagaaaagagaagagaagattccaaacatacaacaggttgaaaggatttcacagacaatacctgtatcccatcacctagattataccataaacattaaattttactgtattgctctatcacaaatctatccaaagattgtctcctttggttccatctgaaaagcaacctagaaagtacgttagaggtggagcccagatgttgccatttctgaattagaaataatttggcctcttctgaaacccactcatcccattccctttgtggctggggagtatgggggtgggaagggggcaggcaggaaggagagtgttgatccaggaacatctgcacacatcatcacaacacacatcccaaccagctctgatttctcccctggctcaaagcagggagagatgggtatttgggaaaagctcaccaccccaaaatatctccctaaaccctgaaggctaagtcaacccatgggctctctgaaagtggccaggggacagcaggagaggcagtactcggaaaagggcagcggtacctatcttcggagccctttcacctgctccagtgggattttattctcactctgtggccctgatacctcctgtgtcttttagctgcattcgtgggatgggagggttgtcagggaggtttcccacctggggcctcttcgtacacctcaaggggataccatgcccacagaatgcaatgtgaatggtcctcctggagtcctgcagagtggtggcaatcttcaagtccatctgattcatgcaaaagttgttcgagcataaacagcagctttctccagtgtcccacgcacagtaaagaccctgcaagagggctgcctatgaaaggccttggggccagggcgggggctgggagtgctggactctcaattctgacaccatagcttctccaccacttcttgctatgtgaccttaagaaaccttcctatcctctctgggtcagagctttacaaatgacgccacaccaaaggaaaaaaaacaagcaaattctggccatctcctatgttcaagacagtgggccagatgctgggtggaggggaaagaggcatactaaggagctcagcagatacctcagagccctggtctaagcgctttgcacgtttttaatactgacatcaactctacaaggtgggtgtgacttttatccacattctataggtgagaaaactcaggaggagagaaattaaaactttcctaaggccacagggttaagtaagaggcagagcaagggtgaaacatgggcaacagtttcagaagcctgcacaggtgaccaccacaaaacgctgcttgctagagaagcccaagaccccctctctgacctccaggaagactcggtccaggggagggagcaagacaaaagtgaagatttaaatgctgataaaatatttaaataattctttgagataatagtgggaaagatgctgccagggagaacatgattaattgtcaaatgaaagtgttcagacaaaattgctctaacggtccagaaaaggggaggaaaaaaacccctctaccgtgagctcattctgagttggaggaagcctgggaggttaaatgtcactggcttttgcagagtgagcaggacttgaacaggagagagtagggcagaaagcattccagcaagaatcaaaattctttttttgtttttgtttttgtttttgagacagagtctcattctgtcgcccaggctggagtgcagtggcacgatcttggctcactgcaagctccgcctcccgggttcacgccattctcctgcctcagccctccgagtggctgggactgcaggcgccagccaccatgcctggctaattttttctgtttttttttcagtagagacggggtttcaccgtgttggccagggtggtctcgatctcctgacctcgtgatccaccttccttgacctcccaaagtgctgggattacaggcgtgagccaccgcgcccggccaagaatcaaaattcaaagggccagctctcatgtttggaaaggtgaagggccctgaacgactgaagatggctcaggggtgcaggaagggtgagctgaggctgggtctgaactttgccttataagtaatagggagtcatagaggaatttcagtagagtagaggagcatcatgacccaaatgtctgctgatgacacactggatacactaggggtgcagggagaaaattaataaattccccaaagtgttggccaaggagtccttgggtcttgacagaggaaagcaagaagttaaggtcatgatactcctcagagactgaccaaagaaggaagaagggggatacttcagctggaagtcttcagctgggttccatcctaaggactttagaatttggcactctgcgtcatcagggaagcaagtaaatatgatccaaagtccccccaccccctcgcagggttatatccagagaacagaattttttaatgctatttttaatctttctgttgaccaaaaacacactgagaagaaatgaagcatgaacatcaacaagaggctctacaaactctctcccctctcttccctcctgttaaccactctgcgaccctgcagactcaccatatggtccaccagctagatggccccttctgatcctggaagggctgatccgcttaattatttggcagctataaatagaagcattggacaatagcctgagatcttttttttttcttctttttttggtcttgcaaacaaagagagggtccctagttggcaggattggagagtaggatttcactccctccctccaggccattgtcttccacctgagccaccacagcctcagggcggcttcagaactgtcctggatgagctagggacagccctgtctcaactgcgccagcaaggagatgtgctggggtcactcacagttcttagagtcagggtgggttttaggaaagagatcacccaggagactcgaaaggtccgtttgctttaggcatgtccttgcctatggggccaagacctcactctagccacccacagcttttcctaccttaccactcactgcacccacattcagccttcactctcacccccaccccattcccaggcgagagcagccacctggaggaatggactcctctggatccagagccaggaggtgagcagagcaaatgttcccagtgcctgcaggaggaagccaggcacccagggttccccttgccacctagacccccgccacctccccatctaggatgggctttctctactccacacataagcactctcctgccccagctcctaagctgttctccctacccctaatcttagcagggacctggcatggaagtcagatgagcctggcttggcctcttgggtctgctactttactagttgtaagatcatgggcaagaggtttcattgctcagtgcctcagcttccccacctgtacaatgggcacaataacgatactgacctctagggactgcttatgaggacctatcgagagagcaggtaaaggttgtcatctagagcctggcacacagcaagtgcttgctaaggggtgttactggcagcttttctctgagtccaactcccatcacctatatgcatgggactcagcacacatttgctaagttgttggtttctccacgctcccctcctcctccttcacacccaagaggaatgaccaggtggccacaggagtcagcatgtttgactttggtacctggggctcctgaccatccagtgtgaatccaaacgcatttccctgactgtctgacacctgctgtttaatctccatcaccttccctcctcctacctggctcagggtccctcactccgcataggtggccaaggtgtgggggagagccctccttcctaatgcttgtttgttttttcgctcatgtgtttgctcagagacaggataccatggtgacacccacgatccagggtggctgggtacacacacatagacagggaaatcaagtgaaagaaaaagcccatgggggccaccatcatcccacgaggggccagactggctcccaaaagagggggaaaggctgtccctcccaggggcctacatatgttttcccaatggaaagcttttctcagtggtcccggcaggcttccaggacactcctgcaggccagggactggtttctgtttgtctagaagccctgcattcatggtctagcatagccaccaacctccttgagatccatcactatccccccatcatgggcatctgcagagcattcatgggttgtggtcatgacttggaaaattattcttaggctgggagtatggctggactaggcttcacagagaacacggagggcagggtgagacgctgccagttggagagaatggcagcccctcatgaagttcagagaccccagcacacgaggaatctaccctgcctggcactgcattggctctcgtggaacatggagggagtgggctttggaatcagaggccagggatcaattcctagctgtgccacttcctagctaggtcaactgtgctgtttcctttaacctttctgagccaaattatttctaattcagaaatggcaacatctgagctccacctctaaagtgctttctaggttgcttttcaaatggaaccaaaggagacaatctttggatagatttgtgataaagaaatactgaatgctaaaatgaaaataaaaatatcttctgcagaaataagacctagagtttgatagatcagtagggtgactatagtttagaaaatattatatatttcaaagtagctagaagagaataattcaaaggtttctagcataaagacaaatatttaatatgatagatatcccaataaccctgatttgacctttacaaattatatgactatattaaatatcacatgtacatatgtacatttattatttatcagtaaaaataaaattaaaattataaaagggagagagacttcctgcatatgaaatagagattacaaatcctttctaagtacacatgggatactgacctgtatgctaagtcattaaaaaaagaaatccttctgcaaaggaccgttttgagactatgaggctctaatttagaaaggtgacaagcacattgcaggaccttacttaatagggctggggcttgccagcatacaaaattactgcagtgacttgttcagactcctgcactgggaaaagacttagtccagagacttacccaatgttttgccatagtaaattctccaaggatgaagaaaggaggaggagagaaagagaacttttctctgtcttcttcaaaagctgtagcagccagatgaagtacggtgtaggtggccaagcagccagatccctaaatagcaactaatgactttgattgaaattaataatgaaacgacacctgttagctcacttgtagccactttagtttgtcacatggcaattatattcactatcctatcagctggtccatgagctgtaaaatgctataatgccatgccatatgcctctcttgtctcccatgttgagacgggggctgtcctcagggtggttatcaattccaggcctcctaaccactctggagattgtcctgggaacttccccggcattcaaaaagacttgaggaccaccagccccagtgaacctgctgagtcccagggagcagctgggcagcctctttgaaggtggattcccccaccgagcaagaggaaaaacacacccaagagttaccgagtcccttctgtggttgggtccttgaaaagccttgttgggtgatagagggaattctccacttgagcagtgaacaacagtgtcaccatccacattatctccccagacagaggcaggacataaagaactaaacaggcccccagcaggccatgagatttggtttctatagcaacccaactgaggttgcatgagtgcctatgagatagatgcccaaggctcaccccagacagggccagaattccagaatcccaacggcaaggaccacccagcagcgtttagagatggaaagcaaggtttgttcatgttcagaaaaacccagggaagccacaggaaaaaaatggggctaggatccccactttctataaggcaagctccaagactatctggcagcccaaagctggcatgcagagctgaggcaggccccacaggtgagctgagccacgctggggattttaacagaaaataatcctccatccacctctgcatcgtccatattctctctctctctctctcacacgcacatacacagacacacacacacacacacacacacacacacatatgaaaaataaaaaaaatcttgcaattattcaaaagaaactatggttgatttgttgatcagaaaaatatcaatgaatgaccaattgcaacaaggtccaaggtcctttaatgaaagtttctaattaaccctacctttgaacacttctattactctatctgtagagtaattgttattttagcgatgcaatgtttcctaataagaccaagcattgggagaaagggaggaagggagggacctgaaacccaaacccagccccaggtacaagctagcacaattagcagccagtgtactggcttctcgaatgctgatatggaatagctcaggaaactcaatcccaccagggacctgcttactgtccacagatgtcatcacagtcatcggtcaagctgagagaggctagcgcaaacaggcgatggggccgctctatctctcctcctccatcaaatcacaaaatgccatgacaacacccaagccagggcctctgaggacacatgaaaggaaatccaacttcatgcaacagggactcaaggtatggcccttttcggccaaaaggcagtgtgggctggagagagagataaacacaagaggctggaaacacagacagggtgagtgggaaagcttagaaggcacttagcaggtaaggctggcatcgggagggagctggctggaccctaatccctgaaacctctctccctgaaacctctcttcaaagagatctacactttctaaatcctgcctccatgagatgaaacttctgttcggtgtcccactcttacagcccctgattcccccagggcctagctaaggaggcccttggaccaccagtgaaactaaacagagtcactgcctatgaagtcccttcagtctggagctgtctgaggaaacagataagccatccaggccaaagaccagcctttcaccatctgaggggctattagatgcccagcaaatatgggttgcctagctggtagcttctggcccagatgccagtccaagagctagagtggcctctccaagcttgggagttagggaagctgtacccagatccttggcacccaccccaaaagagcccatgaagagaaatgaatgaaagggcccagggagattctcaaggccccggtcagccgccctagaagtcacctcaatcttagtcaaggatgagctgagccttgaaaatccatactctgtgcaagaagatgcagataatctgcccagttgcccaaggcaataacttggaggacaaccaacaaaggccaatgggggtcacttgggaagacacatccctaagttgacctgacttccttagagtgggcaggaaagacaggcttcagaagatagctagaaagtaacaccagagaaggtcaccctagaggtggcccctggccatttctcaaggtgacagcctctctgcccaggcgtccacactgcaatgttttccatattggcacttccttacaaagtcctctctttctacctccatacctttgttcacactgttttgcttagctggcaagttcttcctgctcctctctgcctaccaaagccccacttgcccttcagggtcaggtcaaactcaagctcctcatcaagctctgcatgccatggagatgtgctgcccccaacctcacctcgaagaaggacttgaggcccagcttcagggagacggctttgcaaacagcccccagctgtcggttccttcaggctcagcctcagctacagcttcagccaaggtcacccttcctgggacagcctgcatctggtgacagagtgaggtggggtacagaagcacagcaatttgggcccaaagggatcatctctgttggataaatccactccagagttgtctgctgggttggccgaggttttgtggaagctgcatcagctctcgacttgtccctcttgtcactctggcctctgcctctcccttctcagaggtggattcctaataaacatcatgagctcaaactggtctccaccagtacccatctcccaccagaaattcaatcaatggtcattattattatagcccatgtttctgccacaaaaggtgctcaataaacctttgataaacacatgagataatttagcatttctacttgctgacggagctcttgcagagcctgccactctttcaggcacactcacagcagctgctgatcaggtagaccaaatgacatgaggccaatgaaataaatatgccatcacaagagcatggcttcctctggctccctaggaatcacacagcatgctggctcctgaagaacacacaaggagatgcctcacctgagaggttttggatcctgggatcaagaacaggggctcattggtacctctgtgtccatcctaaatgatggctcacttaagaagtgatggaaggtcagctttagtgacaccttctcatcagcaatgctgctactaggtgccaacagcatctctcaccacggcactttaatcaggatggcatgacaccactgtaaatattaaaaaggttataattagagacgcagttaaaacaaccgagggcttagtgttactaaagatatttgcagaatctggtgcaatataaatagcagggtttacggtgtcatgcctaaaattttgagcaggctgatgttccaaggggatgttcagtgaatgcccatccaagctgggatttctctcaactgattgttttctctccagtgtcagagttctcagaaatagatatccagagtgtgcccattctcataaaggggtgaaaagaccttgctactcaaaaagtaggacaaccttgcaccaggacacccgttgaagctcggtggggcagctgcagcccctcaagctgctagaaacactgtctcctgcatggagaggtcacagccttgtgattccatcggctccaaatttaaagcaatcttgcagaaaagggccaacatttatcagaatgaggaaattgttttctagggtgatatcaactggagtctgctgggtacacatgacacagagaacaggcaatcaacctaccaacaaagacgataattgtcacagtgcctgccaccggccaggcctctgcacacattcactttttcctcaccacaatcttacaaggctattgttgacatagtcactttacatatgagacaatcaagactcgcaacatcataaaactgatcagcagcgacatctaaatttgaattcaggtctgtccaattccagggttctttcagatgtgagaagggaggttcagaaagggcccctttttcttctccctccgtgtacttctgtattatttgaaatttttatcaatagtatattttcttgtattactttttaaatcttcaaatcatcaaaaagaatttatgggcaagagaaatggtcctatttctgttgaaaatgtatcttaatttgatgtaacaaaatactactaacaggccgggtgcagtgctcatgcctgtaatcccagcactttgggaggccaaggcgggcagattacgaggtcaggagatcgagaccagccagactaacatggtgaaaccccgtctctactaaaaatacaaaaattagccaggcgtagtggtgcatgcctgtaatcccagctactcatgaggctgatgcaggagaatcgcttgaatccaggaggtggaggttgcagtgagccgagatcgcatcactgcactccagcctgggcaacagagcaagactccgaaaaaaaaaaaaaattacaaacagccattgaaataaaaaaaaatctgttctttgctacaataatttcatttctggaaacctatcctgaaaaaaataagcagagacaccaaattatattaaataaaaaagctgcctttattttgaagtgttacctttaataagaaataaactggcaagaaactcgacacccaacaacagaaaataaagactggatatcctcatgataaactagggtgatgctattaaaaatagttttgaaatgtcagcaaccacaaggggaaatgctcattacatgtttctaggtttaagaatcaataaataaactaagtattcacacatgtaaatgctggtatatgcatccctcccaggacccacaggcatacaaaggaatttagaaagagtagacatctttggagagaggtttccaggattagggtgggtggggtagggtgggcagaaaacttttacttttcattttatatttttataagttatttcaatgtttaccatatgtgttacttttatttcatttcactttttcaattttttttttaatttttaattttttttttttttttgagacggagtctcactttgtcgcccaggctggagtgcagtggcgggatgtcagcccactgcaagctccacctcccgggttcacaccattctcctgcctcagcctcccgagtagctgggactacaggcacccaccaccatgcccagctaattttttgtatttttagtagagacggggtttcactgtgttagccaggatggtcttgatctcctgacctcatgatccacctgcctcggcctcccaaagtgctgggattacaggtgtgagccaccacgcctggcctatttatttatttttaatttaaaatagagaatgtgtctcactctgtcacccaggctagagtgcagtggtgcaatcacagcccactgcagcctccaactcctgggctcaagtggtcctccaccatgcctggctttattattcatttatttatttatttgagacacagtgcagtggcacgatcttggctcacttcaacctttgtctcccaggttcaagtgattctcctaattcagtctcccgagtagctgggattacaggtgcccgctaccatgcctggctaacttttgcatttttagtagagatggggttttgccatgttggccaggttggtctcgaactcctgccctgaggtgatccacctgcctcggcctcccaaagtgctgggagtacaggcgtgagccgctgtacccagatttattttttaaactaagtatattttaaagctttacatatattatgtatattaaccaatatacatattaacatttatatatattaaccaatctaagttttcagaataacatttcattatataataataaaatacacccaaatgtgatttctgcattgcagaattacagacattgctttctctttataatttttctgtatttgccaagttttctcccataaaagcataattttattatcataaaaagcctccttttcaaaactttaaggtatctcactagtaagaggatatactttctctaataagagtttgggtttcaccaccagtcatgtccagcctcagacccacccaaagagtcatactatcatgagtacaggggatagaagggccccatgagactcattccaggaggttaccaaagtagtagacctgaaatggtttggctctgtgtccccactcaaatctcctcttgaattgtaataattcccatgtgttgtaggagggacccagtcaggggtaacagaatgatgggggcatgtttttcccatactgttctcattatagtgaataggtctcatgagatctgatggttttattaaggggagttcccctgcacatgccttcttacctgctgccatgtaagatgtgactttgctcctcatttaccttctgccatgattgtgaggcttccccagccatgtggaactgtgagtccattaaacctctttcctttggaaactacccagtctcaggtatgtctttactagcagcatgagaacagaataatacaagacacaagccctactggcttagcctagagcctcagctgaagccacagccctcagccctggacccctgagatacaagaggagcctgaccagtgacatcccggaattaaacagggggagaatcttcctcttattgtcatcctgagcaatacactagacaaaggccatcgggcagataaaaagaggaaccctgtgcccctgaagttgatctgaccaccagcgagaggtcacatctgctatgtgcaatgccctgcaggggtcacaaagatgacttcaacctcgaccctgtcttcaaaggagagtccagtccaggcgagtaggtgagaaggcatgtaccaactcaaatcccaggtagaaagtgagcagagcccgaactacagaggtatgaatacagggcaattgaagttcagaggacgaaagctcgcttccagcctagggtgcaaggacagcttccaaaggaggtgattcacaaactgagtttgaagtctaggtgtattcaaatacaggccaagtgtgcccctgcccaggagtaggcagtctatgcaacatgtgaatcacatgttcaagcacctgcctcacctgttttatgggcaagtctgccagctacagtcctatcagggcacctatatttctaaggacctggatgcctggatgttttttctccccagggcatatatctcaattacaaacctgcaggaaacaaaaagtttgtggagagtcacaaaacatatttgaaatgtataagactttcaccacaggaaactaggcctaacaagtattttcctgtggaacacccctggctttgatgaaactccccattcaatgtctctttcctcctgcaaactttgctaatagcagtgaaaataaaagcacagatcctatatttacttaatgatcttggctgctttagacatgagatagcattccaagagagcaaagtgctttttaacaaaattcaacaagaccctgccctttcccccgccctcccacctggcctctggaaggaggaaggaatttctcattctctgatcttttcgcctgccatgacccccagggcaatccagacagtaagactggccatgcctcctggtcatgtcccatacctcatgtcctcatgtgagaccccagatgggggagatgatcacatttgagttacatttgaggcggagattcaggtgggggcccaaaacatggctgacatccagccagcattctttgctagatggagctgggaatggggggttaacttttgtgaaagtttattagagaataaagtaagtgagttaattaaattggagtgtgaaagacatttgggtggtgatgaggaggcgaggtgatgatttatttataattgacaaggttgcatctagctactgggatagtaattatacactttataaatgcgcaaaaaaagtcctttcatgcgatggaggtttaagggaaaatcctgtcagggaagtttctgtctgcccatgagtatgacaccacctcaagagctgttggccacttggcttctgccaaccacagctgtaagttggggactgaataatctctaaatacccttctaaaaatgaggccttttctgggaatcagtacttagcctccatctgcttctgatgatgttttcttatctcaattcagggacaaagagggatcctttatcttgtgtctgattctttgtttttgttttactgattcatattcaagttccagctcttggatcctccctaatcaagatgataagaaagatgctgcccaatgcggcatctcatttaagggtgagcagatgtgaattcagaccctaaatttgggaaagttccttaatctcatctggaaaacagggatgggggtacctagctgacggggttgctataaggacagaacctggtgtaaaggcaagcctggtacccagttaacactcattatcatgcaccttaggttaagtcatggtaaaggaaacgtttcaggttaacttcagtcccttgataactggggattccagcctgacctgtttgcatagagtctagcttggcccctgtgaccagcatttgcctctctaagggctcctaagcactcagttttaaaatccaatcaagagtatttccagagataagccacgacatcattagaatacagattacagcatccatcttctgacacccactgagaaattctaacaagcacaagaagttccagaatgctagaggtaaaaaataaataaatataaataaataaataaataaataaataatcttatctcaccattcaaagattctccaaagaagtagcatggactagatctctcctcccacctgaaacaactaaaaattcagacaagacaatgattttcagacactggagctcagtcaggggaagacagcaatccctgagagaggagaaacgaagtgagccctacagttgcctcaacttcctgtctggagagagcgtccaagtcacagcagaaagaaggaggaccccagcagggcccagatgtctccctgagttgaggagatgaaggctggattccagcaaggccaaggaggctggaattcacaggccagggcagcaaaaagaactgcccagtgaatacttgaggtcagcagagggacccccttgagtctttagctaagtattggtggacacaggcatgtgtgaaagctatccaaggtgggggagagaaacaccctaaaggagcagacagaacatttcccagagtttatacagggctgggaacggttcaccttcccaccagccagagtggaaacctcaagctcacagagcacctggtagagtactgagaatagcagcgtctctgtagtgggaaaaaattagccctagattaagagagctctggttccacctaataaagctcaaaggcaagacccaaaaaagatcaaactgtttccatacaacttgatcatgtcccagaaaataagctcaagaatgttttataggagtactaagatatccagcaaccaacaaggtaaaattcacaatgtctggtatccaatcaaaaactaccaggcattcaaaaaggcaaaaaaattgaacccataatgaaaaaatagtccatcaaaagactccccacttctgcaaccacatctacagtgtatttcaggacccagccatagagcccctctggtcctagaaatgcatttcaaagtgcctctctagctctgtgcaagagattttctctttttcattctaaagacagtaatcctaggtagaaacaagagagagaaaaaaaacagaaatgctcactttctagtttgtttctctgtttgctaacagtgtcacatttcccaagcagtgatactctcccatctcgttcatcttctaattctctgcctataattttacaaatgtctgtggctatctttagcagttttcaccagttttgtgttttagccacctgaccccctttcactctaccctaagttagatgactcctcattcctcattcataaagttctgtctgttaaacctagagttgatcagcgatcacgatacacgaacatgctctcttcttcagatgccctcacattttccttctttacttggggattaacaatttaatttttaattagtggagcatactcaaaatgtcatggttgcagccttccatcactcttgggctatattctctcttaaggtcttcatatggactgctgtctaaaacaatctagaagagcaagaaatccaaaaatgggcccaagtatcctagggctgtggatccaaggcatccatccaatgtgaactagataaactgcagtctgtctgcaccattgatctttctgagatgagggcacctgaaagagtgggccaagccactagaaccctggaccctccaccacaggtaccttgtggcagttggctttaacttcctccctatccttgccatattaatcttcattccctgtagtcataaagttctagaagaatatatcagctttgatctctttcagttattcatgcattctttcatttaagtaaacagatatttactgagtacctaccatgtgcttggcaatactttccaatcttcagaaccgggctctcacaccaagcccaagcacaggcagctacccttactcctactcaaaaatgtgaagaggctgaggcttctaaaatagaaaaagtcaccagctcagggtcaaataattaatggaactcgaacccaggactcctagacccaagcctctcctggccaagtctcattcactgcaatcacaggtccagcctggtcacgatgatgagtgggactgtaccctgccctccctgcccagcccattctaggcttcctcagaattccctactttgagtgctcctttgccatgtgaggctcagtgatttccttctccgagtccactcacatttgataggctcctatgaaatgtaggtgagcttcacctgaatctgcacctgtcctcattgctaaggtgatgagctagtgtcaagaaaggctgagggatccaaggatgaactcaggcagggcttgaggccactactcccggttcccctcctctcttccccatgaatcaccttcaaggacacttccatcaaacctgactcacacagaaggcccagacctgagaaatgaccagcccctgggccagagcagagagccagaaggcaattccctcccccatcactgctgcactgggtggaaattgggtcagagctggccagcccattcatttaatccaaacgccccctttccattcagctcttagtcctcagagctttcagtccaaggaagcactatttcctctgcaaaataaacaaaataaattaagcccatgctctttgatctcagggcttttgtgtggctgatgaattgaacagaaatgatctgccatcctcctggcatctcaaagacactgcaaaaattcagctgtagcttccagccacctgccaggcactgtgctgacaaggaagcatggctaaggaaggcactctttgccacccattctcccagggaagcaagaagagtctgcaggaggcacgacaggggaagtcaaaagagtcaaagactgtgaggcaggattcgtctttggccacataggcatggattcttcttcctctgctcattcccaccccagggactttgcactggcttttgtccccatgtggcatactttctctggagaccttggaaagctggctccttctcatccttctcatgtcagcttgcacaggacctccggagagaaacctttcccatcaaaagtagcccccagactctacccgcatcactgtctgccagccccctactctattatctccacacttatcataatcagaaatgaccttgttgctgcatttgttctcttgtttgttttctgtttccacttctacctccgtgacagcagggacatcatctatcttgatcagtgccatatccccggcagttagcaaaacgtctggcatatggcaggtgcaaggcaaatgtttgctgaaggagggaggctgcatggaggagactgggccctctttccagtgccagctctgcctgcatcgagcactatgtggcgcatctagaccaggatccacatccatggtgtggtttccccaggctgcagaagtgcactgtggaagcaggtctgtgtgcttgagatcagggaaagctgaccaagaagatgggacacagttgattctggagaggcagggaacagacaggggactctcctaacaggctggatcttccaggacagttgaaggacaacatccagtaggaccctagaccaagagtatagacactgtcgctatgggtgtttctctgagccctgagacttcccatgtttaagataagctggttggattactggttattgattatgttgaatcttttggtggcacagaccaacttgagaatctgaagatatcaactttctttctggagaaatgcatgtgcttacatagagacaaaatatgcctgcacttcctagaagggcaaggacccctccgaagttcattcacagccccaggatgacagcctctcacttaaaggctcttgggccgccctgctagtcattggcctgcttgctctgagacccagtctttacccctcgtctgtagactgtggactacactccccaggctccctcgctctttcttctagggaagtttgttctattcagcaggaatgcaggcagaagtctgcagggtgggggcaggcagaaaccaggacatttctccctccttctgcatttggtggcatctccagatagagaacatgtccatcattatatctatcacctctgggtatcctgccctccccagagtcctttcctctgtgatcctgcccagcccagcaggccttctgtagttccagcatccgccaggtgctgctggatcctgagttctagaaaaccagctcctcccttccccctctagccctaggatgctagcagcttcctgccattgctattctctgggctgcctctccattttttgcttggctttttatctccttggacacctttataactagttccccatataaactccttctactagatattttggcatgaactctgggtttcctctggggtccctggtgggatcagcctccctccagcacgggcattctgagagcctggtagcttcctggaaaggccaatctgagctgaattaacaaatccctaggaaggtcaagaagatggaggggctgggaaaacccatgttgcctgcgagtgcagtgcctccatcctgtctggttccattccaggaaaaaaagttatataggaaaagcctcacaatcgcaatgtagttaaaaactgtttactgcctttttctaaatgagggaaacaaatgtaaggcccagagcagcctcccatcaaatcatgctcttgctcagatcaaacggcagcccgagtgaatattcctagagttcctacttgggagctcacgctagctactaagtcctccctgccaaaaagacccgattatacaaagtggggcagcaggaaagccagtcttgtagcatcaaagaaacacactgtctgaattccatcagccacaagcaggcatcctccacccagggataatgcagccagggcactgtgccccagaatggccccacccatgcaggagggcaccttccctcctcactgtgctggcttcttttaacaaatagccctatctatgagctcccttgttccttccaaccattctaaagatagggcaggcaccaaggccaggggtatgggcaggtcctcctccctgaggaccaaggcacagagagtttccaaggccacacagccacttggaagcagagctgggattagaaccctgcctggacagggaatgacttcaacttacacacatgaacaaacacgaatctcaactccctgttatggtggggttccccagacacacatgcatggtagagatttcagtgcaaatttaatcatttgaaaatactgacattcaaccattttttaacctcaaaaatggcaatttcatgtggcttacatgaatagtttatttgggtagtgatcccaggggagaaccagctggggagtggggaaataaaatgggaaagtgagagggcagggtttgttaatggtcaggacactgctgcagacaaccaaggctcaatgccactggagacctctgggagatggggcagaaccaccctgtccaacatggaaggcaccagccacattgagctatctacatttaaattacttgaattgaaaaacttagttcctcagtccactagccaaattccaaaagctcaataaccacagatggctggtggctatcatattggacagcacacatacagaacatttccatcattacagaaaatcataggggtagcactggcatagaccatgcctcagagctgtgtcatctgaggggtagaatctggggtatttatactcccattagggtctatcattggcaagggctgcacctgggggtatttgctgcaggcacttccagatgtcttggctcacactggtagggggagggaaggcactgacagtaggggcatttgagtgggataggaatagagtggcctgggggcatgggcagggcattcacagcctctgccacaatcaccagcccttcctgcacatcacctctgctcttgttgaagcacctctggatgcaggcattttgacagcttcttcgcaatgggaatgtggccccagaatcctctgacctgatgacaagccattctccctggagacaacacacagagagagacacaatccaggccttccaagcatttgtgatctacagcaggcagctgggacacagaccacagcatgcagcaactatacaaacactgactaataagctaaaatcggaaatctttatggagaaacccttgtgagcagtgcctggctaacagcatgtaggtgttgcctccaagaactgtctagcatttgagagacacagttggagactgagcgtccccattaggcaggctggtccccgaatacccacattattgtggtaatcaaaacacagctttgagacatcactgtgctggtcacaaacctggcaaggtcaagaaagtgctctgaagaccagcacccaaaatcttcacagcttagccttcctcccaggggcccgctcttggcatagcacagtggccagaacacagactctctggagcccactgcctgaggtcatgtctcatctcctccttcctcactgcgtggccttaggcgcactatttgatctctctgagcctgcatttcctcatctataaagtggacacaataacaataactttccaatatggttgtcaagaaaattaaatgagcccatgcttttaaagatcttataagaaggatggcaaactttttccataaagagccagatagcaaatattctatggcattgcaggtcacacagactctcacaacctctcacttcggtccttgtagctccaaaccagccataggcaatatgtaaacaaatggatgttccaataaaactttatttataaaatcaggtagtgagccagatttgccctgcaggccatagtttactaacccctatcttagaatgattcctgctctacagtgagtgctatatgaatgttcgttgataaagtctgctgcgctctcccacctctcagattcttcctgtattattattctctctgcctccctctccacccatcctttaagaccaagctcaagtagccttcctgaaacagtgtggagatttctcaaagagctcaaaatagaactactattcaatctagcaaccccactaatgagtatctaccgaaaggaaatcattagaccaaaaaaacacctgcactcatgtttattgcagcactactcacattagcaaagtcgtggaatcaacctaagtgtccatcaatggatggctggataaagaaaatgtggtacacacgtgcacacacacacacacacacacacacgcacaccatggaatattactcagccttagaaaaaaaatgaaatcatgtcttttgcagcaacacagagggaactggaggccgttatcctaagtgaactaactcagaaacaaagtcagacagaaagtgatgggtacactaaaagcccatgttgtcacttataagtgggagctaaactgagtacacatggacatacagaatggaataataatactggagactccaaaaagtgggacggtgagggggtgtgggataaaaaattacctattgggctgggcatggtggttcaagcctgtaatcccagcactctgggaggccgaggtgggcggatcacctgaggtcaagagttcaagaccagccttgccaacacggtgaaaccccatctctactaaaaatacaaaaattagctgggcgtggtggcatgccactgtaatcccagctccttgggaggctgaggcaggagaattacttgaacacgggaggcagaggttgcagtaagccaagatcacaccattgcactccagcctgggtaacaagagtgaaactctgtctcaagaaaaaaaaaaattacctattggatacaatgtacactatttgggtgatgggtgcactaaaagcccagactttaccactacacaatatatccatgtaacaaaaccgcacttgtactccctcttttttttttttcaaaaaagaggcctccctggaccctccctcttttcttagccacatccttagaccacttccaagttgctcttctgtggtgacccttgccccaccctgctatttgtggggcaacttgtttcgctgtagaatttcattgttcctgttaaatgatgagatgatccaatgtcttcattttacagggagggaagcaaggcccagagaagccaagcgacttattcaaggtcacacagtgacggcagagtcaggaccagacatggatgtgtcttgattcatgattcagtacagtcttgggcttaaggagatttcaatactgaggagagtggggacacagatcacccagccttctacccttgatttagggctggactaggtcacccctccacagaggttccttacttcctgcctcagcacccctccaggcagaacacttacggggcttgttgccccaactagacaggtctggctcacttctgagtctgtcacatatccagcatgggcccaggcacgctccagatgcaatagtgttgaccctgtgtgctttgtcttcctcttccttccccgtgagtctgcccattgccccggggacacccaggacagactcacagatcttccccaggggacatgtcctgttcatgcctatctaagtcatcaaaggcaaattccagagcagcctatagccagggctgtgtggggactccccactgactatggggcttcacagaggcacagcccaaagtaccatgctcacagacacacaaattcagacacacacatgcacacacacacacaagcagacacatgcacacactaatataaacaacacagacacacatacacatacacacggacacggacacacacagaaacatgcacacactaacataaacacatacatgcacacacatacacgcatgcacacaatgaaacaggcacacagacacatgcacactaacataaatacacacagcacatatactcagatagatgcacacacctaaacacaaatatacacatgtatacccacactgatgctaacacatacacacatgagcacacacacacatacacagaaacatatatacacttaaatacatatatgcatggagaaacaaatgcatacatgtgcacacacacacttagacgtaaaaacacatatatttacaaacaaacacaaatgtatgcactcaaatagacatataaatacacatgcatacacacagacatgtaaacatacatacacgtaaacatacacacatctatagatgctcatgtgctcacagagacccttatatacctatgcacacatggataaacacacacaccctcacacatgcacttacacactgtgtgatgtttttagcttttacctttacagacagacatgggagctttccctggaagatgtaaggtccctgggaaagggactgtgccctgggctctcccccgggagagagtcccgcccacccacagcatctgcctggtgtcttgaacacaactagtgctcacgtttcctcaatggacggatgaatgaagtcgtctcatgcctgggccttgggtccatggggagagcttggctcaggaagccggtgctgcctctatcacctctgagtttccaagccatactctctcaccccatcccagcttgggaaacagccagcatcttgctggcctcttggtggagtgttgctgatccatgcctctgccagaggtgggagaaacctcgatgaaactcaaaccaagtcttgacttatctagggatggctgaaggtcctcctggggtggggagaaggtggaagaaaccactgactaaagtggtcctggccccattctcccagcatgtaggttttctggctggactttacaagtaaaaaccacagtgaggagctcacttctacctgaggtaacacagtgcatggcccccacctgcttcccttcatatcactatcttgcaaaactggctcagagagagcctcctggccctgcgtagcctgggaagataccacccaccatcatttgttacctccccacagtgggaaggtgaagggcttaggagacctgcttcttggcaccatcacactgtactgtgttgtcaccctatctggacctcagtgtttcctctgcttctataaaacggggtgaataacctttgcctcctaaataccaaggatacagcatcaaggagaaaggactctgacctcacaggaggtgggaccaaggagaggggcaactcacaaaagcctgaggaagaacattctttggtggcacctccctgatgagcagagaggagccgctctgcaagttaagtaattgatggagcacacgctaaaaatacaaactaggttagcactcagggtggtttattgctccaagagggagttaattcaggcactcaaatctccatggaacagggactgtgagcccagagcagcagactcctgagccaggaggcctcatgcaacccagctgagaagtgctgtttacttaaaggctgagcaagacggaaccagagaaaatgggctggggaagcatagggggtggcagagaagggagtgcccaggccttaggagcatgagggaaagaaaggaggcaacatgcaaattagtaacaggaagtgggacaggcgacaggagctggaagggctactccctcctagattgggctgcaaagaccccagcctcccagctttctggagccccttgctattccaagtaagctccagagaccagcggcatctgcatcaccagggctctcatcagaaaaacagaatctcagaccccaccctagacctcccgaatatacattgccacaagatcctcagatttcctgtgcacactaaagtttgagaagcacaagattaggagtcaaaatccctgagttcctggtccagctattgctatcaaattgctgtgtggttttgcaggacttgcttgacctctctgggtgctagaatttcttcctctgggctacaggatgagtgaggcttgtttctttctcctgggttctgagaggctcaagtcagacccttcatctgcaggcctcggaagcatgggagggcctttacagaaaaacgtttccattttctaccaggctgcccccttccgctttcttggagtcattagtacacagagaggtagatggggagatgatccttgaaggacacactgcagtcaggaagaagacttcttaatgtcattttaagccttgatatctctccattaaaaaaaaaaaattataaagcagcctcttgctaatggggaagcagcgggtctgagtcatgctaagtaagccagagcatttcatctggaaatccctggtctggtgttacccattgcctttgggacattcaatatcactactgcacttgagaaatgtggcttctggggctcagagaggttaagtgagtgggtcagagtcacacagccagtgagaaacagggccaggacgggaagccaggctcccggccctctaagagaaactcttttaagtacctcaaggtgcccacgtccttgacagctgacccagactggtgtgaggacaggaagggaaaagacattctgactattgcctgagttggacagagttaagaggataaatctgggaggatatgatatcacaagggttcagatagaaagtttctaaattattgcttaacttgtttcatcaaatgaattgcttccctccattagcccagggctgaagtggccaattacctgccttctgcacaggacgacggccgtgtataaatcaacttgggtaggtaacaaaggaatagccaaaattctaaaacaaaaatagatgagagacttaagcacaccccaaaataaaacacacacacactcggtaactcaagtattaagttctgagacggccaggcctgagtccctctcggcctccatccagagaccaaacatacagtctctgatgatgctgagcgtggcaatgaggcctttgcataggccacgatccctgcagcaaactgcgttgccttccctgggctttgggaaggacacttaaggctggagattcaactaagtgcaaagctggtacctgcagacccaggggcaccagtcagtctacagctatggagggtgttttaatgcaaatggtaaggcaactttgctggtccctccttctggctccaggatggcacctcctggggctgctgggcttttcccaggtcttaaaaggaattctggtattacagaaatactcagagttttggagttagaacagcctgagtttgattctggatgctgccactcactagctgtatctgccttgggtgagccatttaaacatactgaaccacagctttctcatctgcaaaatggggataataacaatgccagtgtcagagggctatcaagaggattgaataaggttaacatatacaaagcaccctatcggcacctggcaaacagcaggcatttaatgagtgtgggctccctccaacatagactagaaaaactggtcgaggggtagcctctccctaggaatattctcttcctttatacattacattaagagggtgaaccagtccaagccagattcccaattccatccttcagcccaaggctgctccattgcacagcttcaggaggcactgcccatatggtggtctagatgtgtgacgcttcccggggctgggcagtccacaacctgcctcagcctatggagacacccatgggatgctaagagggaaagaagagatccaaatccacccttggcagaaaatgggaccatcccaagaaagtgttcctggcaggagctcagtgggcaggaagtaggatgcccagcaagggcatacccttggcgggagcatcaggaactaaggcaaaaatagaccatgaggcccagggctgcatccacctcttcctggcccagacctctctgcccctctgaagcctggctgccctcactcctcgatcctcagtgcctagcatggactctccacacccactctccctcacttcgcctggtctccctaactagagagcaagctccctgtgggcaggggagtaactgatatcactgtggtcctcttgagccaaacacactgtgctaagaaagcccaggcctgcatcatctgctggctagctgcttcttcatctccaaagcccaattgacacagccacccatgtatctcagaggatggttagagagcccaaacgatgctcactcagtctttcaacaaacatgcattgagaacctactgcatgagctctggagtgcaatagtgaaataggcagaaaggattcctgtcctcaaagagcttattctctagtgagagacaaaggccaatcaagtacacaaacaaatactacatattacatatatgttaaattgtaatcaactacaagaaatgagttcactgcattatataatcaaccattgaaggcttcaatagtcacagaaagactgatgcaagagacaggctgaatgtagctctagtgagagagtaaggagccagaaaggtaaggaggggagaatatgagcaaacaagcctcctgtgcaggacatttccgtctgctgtgaccacccttcacagaactgagggcttgcctgttctgtcacgtgggatgctgatgtccatgagggaggcaggttatcacctttgatttgaaagccctagaggcagtgaagttgcaatcagatagacaggacctgaaagaaagaaaaaagggagggaggggggaaaggggaggagaggaaaaggaagaggagaaggaaaaaaagaaaaagtagagaaaagaaaaaagaaagccagacccctgtgctaggaaaaatctagctagaggaacgcagagcctagcctgtgatcttaaggtgacttctaggccagactgtgaagggcaccatgtcataaagccattgccacctccatttgatgtgcaccatcacctctcctggctcttggccttatagattcaccagtttttaaaaaaactcttacattgcagctgcttctcagaggctgagactcagtgactgtgtcagttttcatcttaattcatgtctgtactgccacactgttggcaggacatgtttcacaccaaataactacactttaatcaagctctctgttggttgcattttttgatgatggaaagtccgtctccgaagcagttgtcttcactaatgttgactgagcagtgctcagcagatgtaatgctgagcgaataggggatcccaagggactccagggtgccagtgcgatgatccaacagggttccagacatggcaatttagttggacttcatcctcagtcatagaatccagtggcagaactctatgtcacagcatcacagttgtgtggacacacagagctgccagagactataaaggccatagccttttccaccagcgcctgcatttgcccctagggaaagccaactcgaggtcaaggttagttcccaagtttccagacttgagagaggacagtggtcagagagtccagaagtttctgaaaggctgctccaaaagggcagggaggcacagcagggccacttggccactcgccgagttctacattcacagggaccacgaattttgaccttgaagctattcctgattaggttatgtacacattcctggagatgtattcatggaaggaaaaaatatggcattgatcatctgatttaaacttttatcctgttaccagatctcattctggtagtacactaggaattaatatgaagtttgcaaattaagtattatcctttgaatagtacaatcatattgtttccttgtttttatttttatttttatttatttttaaattttttgacacagagtctcactctgtcgcccaggctggagtgcagtggtgcgatcttggcttattgcagactccgcctcccgggttccagtgattcttgtgcctcagcctcccaagtagctgggactacagatgtgcacaaccatgcctggctaatttttgtatttttggtagagacagggtttcaccatgtgggccgggctggtctcgaactgtcagaactgtcaggggattctgtcagaaccaggggattctggagtcagaatgcctgccatcttctcctatagctctgtgtctacacacaagttacttagcccctctgtgcctattaagggctgatttatgttccccaccaaaaattcacattgaagtcctaatgcccagtacctcagaatgggatgtattcagagacagggtattcaaagatgtgataaaattaaaatgaggtcattagggtgggtcctaatgcaatatgactggtgtccttagaagaagaggaaattaggacacagacatatacaggagggagatgatacatacacagggagaagaaggcagtcttccacaaggcaatgagagagtcctggaaccgatccttccttcacaacccagagaaggaaccagccctgccaacaccttgatctcagacttctggcctctagaactgtaagaaaattaatttctgttgtgtaagccacctggcctgtagtactttgtcacagcaggcctagcaaactaatacagtgcctccctttcctcatcaagaaaatagaaatgataatagtcccttcctcacagagatgtgttgagtacccagttcccagcactcagtaggtgtccagcaaatgtttcttgcactacttgtgattagtacagagtcttaacccaacctggtctctgcatgcttcatcttactcttctgtgtgagaaaagaggcttataatgaaagcagagaacagtaaattctgcagacaagtcacacacttcacaatccccaccaccctccccgaccacttcgccccaagcaccttaaggttgaatggtttgagtcccaaatctgcacttgcataaggtttcttttgctctagccatgtactttgctgactgttgtaggacccgcctgcccatcctgtgttctctccacccaataccttcaaaggccacaataggaaccccgctactccttggtttatcaatattagacaacttaggatgcagttagagatccacacgccatccaagtccccacattacagaaattagaagcctctccttccagtttattggagaaggaggatttctggtcaagacgtccaccttcaagatgaggtgaagagcagacaccactctggacagtttgcctggccacctaaggaaaacacagcgtttagagggcagcgccagaactgtgtctcctcaagaaatttgtcttgagaagggtccctgaatataacggttgccagaggggactccttggggcctagagcaagcttactgggggtcctggaagagttctcagaggtgtgtgaactcactggcagctgactgagaaactgggagtggcacaaagacctttagaaaccaataaggacttcagaggtatcacccacaagcccagaagtgtggccaaactgaataccccagctctctgctgcctcagcaaggagccagggattcagtgatggtgtcttcttccaaacctgtatggcatggtaattaaaatcaaggtcatttagaacccagaaaccaaagccattctgactctagagggaattttaatttgttaatggatcttccggctgatggctgggggaaaagatagcaattcacaatgggtttgaggccaaaaatggcaccacagtggccgggaagccgctgatagctcctcggtcagtcttcaactgcagcaaggaacaggctgggctacccagggatacagatttttttttttaactttttaatcagctaatagcagatgaagacctaacaatgctgccaagattctgctccttctgtcagcagtggtgagaaggaggccagggtcggatgcgtccggctgcctttgctctctgaggttcttttggagggatgtaggaatttggggctgaggaggaaaccccagggccatcttctccactggtcaccaactgcaaggatccaggaaagggaaacaggtggaattctcagttccctatgccaatcctgggggagggcctgagacatgtactgtattaatttaccccacaaatgattatgggctgcttaaacggtgccacagatgtaatggagactcagcaaactgaggaggtgaggcccggaaacgtgtcactaaagctgcttactgtgtgccgcaaagggaagactccgggtggcctcagacagagggagggtagggcagcagaagagcttcatccagaaatgtaaaccaaaggcccggcaccctaccttgaacacccagtgctgccggaagatcctgtccccacatgagggctctgggcaggggatctcctcctaaccagcgccagcgaccacaaagggtgctcttcagtggagaagaaaaagaagaatctaattcctgacttttatttttagctgcaagtcagacagaagagcagaaagaaggcacttgaccataatcctgatcatactgaacgagtaatttaatcatttttaaagcctgtgtgcaggctccgccatcttactggggtctaacttgggaaactctcacctcatttcaagcaaccagggtttctctacaagagccatcaaaaactacttctttagaagcacaatttctaggcatttgttttgtccaaaaacttggattctcttactttgttccttgagctaaatcaagcacaactatgccagctgaggcagtgaggagaaaaccggggtggggaatgaagcaggcaagagggcctcctgccctcagagaggcagcccggctcatccaatggatagacgcacaccatacacacaccacacaacacacatgtaacacaacacacactacacactgcacaccacatacataacacaactcatactacacacacaacacatatacaacacacaatacacaccagacatgttacataactcacactacacaccacacacataacaactcacactacacacacaccacacacaacacacaatacacaccacacatgcaacacacactacacaacacacattacacacataacacaactcacactacacacacaacgcacatacaacacacaatacacaccacacatgtaacacaacacacactacacagtgcacaccacacacaactcacactacacacacaacacaacacatgtaacacaacacacactacttaccacacacaccacataacacacatcacacatacacacaccaagcaccacacacaatgcaactcacactacacacacaccatgcaccacacacgtaacacaatacatgctacacacacacttcacaccatacaccacacaccatacacatacacacagcacacactacacacacaccatacactgcacacactccataccaaataccacaggtcacacacacacaccacacacactatacatatacatacataatacacacccaacacatatagacacatcacacactacacacacacaccacacacactatacacacatacacattatatacacatatcacacatacacacataacacacatacacgcattgtccacacaccatccacgtacataccacacatatacacacacccaacaaatatacacgcagcacacacatactatacacacattatacacaacgcatgtacacactatacacacatcacacatatatacacacacataaacatacaagtggtatacacacactatacacacaccatatatatatacacaccacatacaccatacatacaccacacactacacatcacacacacataatgccacatacacacaccacacacacatacaccacacaccacacacatgacacatattcacatacatgtaccacatacacacatgcaccatacacataccacacacacacaccacataaatacccacacaccacgcattctgcacacactacataccacacatatcacacatatattatatattcactgcccacatacacaccacacaaatacaccacacacacacacactacacacacactatacatacatcacatagacacagacacatacacatagcacacctaggcacactatgcacatgtcacacacacatcacacacacacagagagcgtacatactaaacacacatcacatatacacatacacacaccacacacacatactacacacacactatacaaacatcacagacacagacacatacacatagcacacctaggcacactatgcacgtcacacacacatcacacacacacagagagcatacatactaaacacacatcacacatacacatacacacaccacacacacatactgtttatttccttgctttaataaaaaaataaaaagagagagaactttaaaaggaagcagaggaaaataggcatttggaaaattagccccatcctaccatgatagctcctataaaacatcttctagagtctgattttcccacatctaaaaattatttctttttattctgttgttgtttggcactacaatataaatatctgtgcgtgcagaagcagcttttagtctttcatctgtgacatctgtggagagcgctggagcttgtgtttattcataggcatcagtccgttccacccttcaaacaacaaaggaggcaggtggaacccagagatcagaggagtgaagacattagctcaagggctcaggatgggctccaggtgcacttactctatgctgtctgacattcatggtgggctcgtactaggattgggcagggtgagtttggcaaaccaaaacccaaatgtgcacttcccagcggggccacccaccagggtgctgtaccctaaccctccacggctgtggcctgccctgggtcacctcatggcctggtgctgcccttcacacgaggaaaacccttctgtcagttcctagtctccatctttctcctccctgattccaaagtgcaggtgcctgctgactgagttctttttagatgaagtctgttttcaccataggccctcaaccaaaggccagttgacttcaactggccaactttcatctcaacccagaattacagctatccccaggaggcaggcattggaggagttgctggaccgcagaactgaacactcacatcctctgagaaacggagcagtgaaggctcttgcaattatctcctgaggggggctgatgaactgggggccccagcctggagcagtggaggccaagaagagctttagccctgtcttcaagggcctgaagagagtggcccagtggtcagatgtattctgtccatccccagggggagaccagaaccaccagacagaagatttagagagaaatctctctcttgcttttcagtagagcctgactttcacaagataggaggggcctccgtggatggaaacaggctccctggcacaggaggcatttaagaagaggtggatggtctctcagtgggacactggagcagggggacagacatcgggggaagggtgggccagtgcgacctttccaattgcctcccaccttgagaatccctgactcgacagagtgaatacacagccatctgagacctcctggtcacctgcctgcagggctctcttctgggcctaaaaataagattcccagagtcctgatccaaattagatccttaataacgtgtcaccatggctataaataagtctctttgagggccagttaatataattattttaatcagctacactccctagaaggactgccagctagctccccgctcagcctcgctgcgttctgaacaggtgcgctcctcctccgcctcacccagggccggtccttagagcagtcacaatgatgaagggtgggtgggcagtctctctgcttccctctctctaatgtccctgagacactccttccattctggggcctacattctcccttgatcattcaccaagacttccaacaggaagacaggggtgaaaacgcaaagtctacaagagccagacacacagcaaagacatgtaaatcacacacggcatgatgtgagagagagtgttacggactgaattggttccctgcaaatccacatgttcatatcctaatccccaggacctcagaatgtggctgtacttggtgacagggtctttgaacaggtgattatggttaaatgaggtcattagggtgggccttcatccaacaggactgatgtctttataagaacaggagattaggacatggacagaaaaaagaccatgtgaagatacagggaaaacaaggcggccatctacaagagccaaggagagaggcctcggaggaaaccaatcctgctggcaccttgacctcagacttacagcctctagcagggtgagaaggtaactgtcggttgtgtgagccacccaggcgatggtcctttgttacagcacctcaggaaactcacatggggcgcggtagggtgtgccctgtctggaggttccacattcttttttttttctctctctcccaaagactggacagccaaacaacacagagccctggacttctctgtcattgtatatgactccctgagagaatgtaaggaaagaaaagcaatagggtgtcagagaaaggacattggcctggccgggagagctggtgggtttagccaggctacctgagcaagctgctcagtcttgggaactattcaattatgttggcccccatcctatcatcagttaactgaaacacctggcccacaatgacctttaaagagccttccaggactaacaattttgcccctgggtagcaaggggcagcctcagatcatgagcctagaagggagaagccctggaggacagagtgggacaactgcagaaggagcacacagaggtgtgggtgatgtcaggaggctgcttgactctttcctggagctaggagctttcgttcctgtcccagctgctctatttgctaagtgcctcaacttgtccccctcccgggcatctgtaaatgagataataggagtgcacgtgttgtgtaccagtgaaagtctacactatgccaagcatgctcaccattacgaaagaggacaaggacaggtgggtgcccagtggcttctcaagactgacatctacatttatcagattccccaaggggcaactccctgggcaaggcaaggtgggtcttcagagttggggccggagtgcctgtcttctccccaccacaaacctaggtgccacattactatacagtcctaaagatgctttaggattgtggtttcgtgctgaaggaggcaggggagaaatcgtaacttgcatctcccaaaggctagaagtgaaattaagatccttacacacgcttagtggtctgcattttacatagagctttcaccaatacaatctcccaggtattattattcccattttacagatgaagaaaccaaggcaaggggagattaatgatgaaaataaggcagtgtaaaaaaaagcacaaggcttgggttcttactttgacctttaacaaagtcacttaatatcttgttatcacatggcctgcaaacaaagtcctgtagccagtacaagcagggtcaaaacatgacctgaggacttccacccagaacacgccatatgcacatttcacagattcaaataatctcagaactggaagggcccttggcaatcacagatctgattcctttggatttatgccaaggaaactgaggtctaaagatctccttgctcagggtctcacagtgaggctctggctggactaaaaccagagtccagggttctttttcatagaccatcctgccctgtcaatttgacttcaaaatcttcctcttcaacacaaaccacaaccacaaagagaagggtcttctgggttatctgtattgggttgcagaaagaagttccacccgtacccccaaacctggatacttcctccaggccgcacggtgctggcctcctccagcgactttgagcaggagagcaaatgagtcaagctcctctcacaggatgaggctgctgggagcagctcagaggactggaattagaaattctaattattagaactctcggaatgcaccaaaggacaatttataattagcacatgtcaaaaggccatccgcaaaggggacacattataaatcagaaaacaaagatggccccagaaagggactggggagctgagctgtttggcctcccacccctcctgatggccctaaatccaatccacctcccactcctgtgagccctcctccctcctatgccagcctctctcctgctgctctgccctttgcaagcccagcattggtgcttcccgctccctaagccctcttccctctgctgctcggtcagggccactgtccgaaggccttagcacagggatccctctcttcagggtccatgcagctctaaccccaggtcctgagcgggtcagaggcttttggctcctgctgtcacaggctgcaaataaggatttaatgactagcctttttatgaggaagaaaatgtctccagtggactgataatgtcatcgtctgctgctcaggtgcatgtgcccaggtaagcctcacagccagaaccctgctcttatgatgaaagctcagggcacaatcccagtgcagacttggaaaggccagcatgcaaaagaggtcggggcacctccttgtttcttccatgaatgaatgaatgaatggattttctactgacttatatgccataaatattttcttgagtacttcctatgtgttagtcacagcacttgagattggagaggaaaagcagtcaaaaacacagaaataaataagacacgaccctaccctcccagaattcatagtagcacatacttgacaggtgaaaacatttttagaaaaacaaaaacgaaaaccagcaagagaactggcatctgaaggcaggacacctggattccaggaaaagctcttagctgcatgacttgcctcctgccggtcatttgtcttccttgggcctccatcatctgtgccatggagataataccaacttcgtggatcccacaggggttgccatggaaaacatgataaaacacaggaacagaccctctgagaaatgtctgcagtgtaactccttatcataacacgaaacactgaagattctgttggctgataggaataagaattctattttcccacacttgccagtctgactcaagatggcacctagttccttggacaaagatcccaagggtagagaaaggcaatttatcaggccaccatatgtctgtgcttaccaaggaaccttctagatggtgacattttctcatatgctgtggctcacaggggaaagactgcctctatgtctagggatgacaaggttttattccaggagcaaatgaaccccatctgtgtggtagtggctgcctggagcactgtgttaaaaaagatcctgaagttgcatcttggcttggctagaaagaacatcctgatagattatggatgtctgttatgaatatggagttggggagtggcactttgttacttgtgacctaggaagataacatgcccactcaaccacactccttgttgcacacctttctttagagctgtgtcctctggccattcaaaggtgagctgagtattggtcaatgccctgaacacgattccttctgtgtgaattgttaatattaagttcttagagccagcaaagcctaagacatatgcccagcaagaaactgctatttttaggaaattagctggtccttcagacccggttaaatgtgctaggtggtctcagtcatgttctttataaactgagaagaatgcctcacaaatttgggtgtcattagggtctgtggatcccgggcactgccacacaaaatcacccggttcaaataccctgcaggtacatgataccctctgccgttaattctatgccattttgttgaagtctattccacttccttcctttaccacttctcaggacaatgcattctctgagtttattatgagctttatgctctatgaattcttgccatttttctaatatttaccctgcttgcgttttaaaggggacctctctcttagcatgtcaggatgtggcaaagagtctgtactggcttagttgctctgctcacacttttataaaagtctattatgtctgtgttaattcccaacagagctgagctgcagtcaacccctgaactacttattaaaaagaagcactgagcagatgaacgctctgctcatgactgagaggggaagagaacagactgtgtccaagtccatcaacacatcatctgtgcaccaggaatgctccaaacacaaacagccctagtgagtcacaaggatagatgaatgctacggtgattcttacatttgcagtcaggaccacagagtgctggagacaagaggcagcttagaaaccatctagtgactaaagatgcagaaattcaggcccagaacaattaaccggcccacagtgttactccaagccaggtatacttactataaaaaagagtatcacaaaactctacatgtgaggtatttcatttatgtctctttttgctatttcagatggtttcctctcagaactaaaagcacattgtattgcacattgtagatactcaaagtctgttaaataaataaaccaatgaggtaatgtacataaccctgcagaaggatttcagtacaatgctatttataatagcaaaaaagaggaaaaagtaaagagcaaatataaggaaaaggagtgagcatccatataagatatagtcatttaaaatatgtttatagagtcccagtgtcacttggaaatgctgataacgtaatgttaagaagaaaagcagaacactaaatcgcacatattctaggatctcggcattataaagaaaaatgcacagtaatatatttgggggaaaataaaacgaatcatgaacagtagtagatgtttctgttgtgattatgggaggttttatttctgcttctttgcactctgctgttttttgcagataatttacaatgtgcccataggattttcataagcaatgcgagggtattaagaaatagaaaagaatatccacagatattattcagccttgctgggatttggaaagagacagagatcatttctctcttttcacataaagaagctgatgaaacaaagagacagagacactagtgatgaaggcaggcattagctctctggtgtggagggccatccaatgccaggcaaacaacagatgcgggataaaatccactcaaaccacagtgggagggggcaggaggtgtccagtcttcctcttcacaaaggttccatccttaccttatccaaaagatgagcaatacaaggctaggctcagcctttaccagcagagcctccccaaagactctctggcccctgcagccaatgacaataaattaactatcacagtgaggtttttccccttcgtcaggcaatgtgctatacacattgtctcattaaatcctccccatgtctctgaggcaggtcttactgtgcccatctgagggatatagagaccaggactcacacaggtaaacccaggtggccaaggtgtcacagtttgtaaccggaccccagaagcctaagccctcgcccctgtgccccggctggtcattcgttcctccagatctttgcagcactaagaagatgctgcctggtgacatttcctgaattgtttcccacgggtcttgtctttcaggctaggacaagttgtttaacctttcacgtgcgtctgtctctcttgcttccctcaattggactgttagctcctgagggggatgagggggtcctgctttataattccttgtgtgtcccacggagccaagcctggtgatgtcttcagtacttgacacttcagatctcagaaaatacctgctcatcgattattggattgaataggttaaggaggagaaccgtctcatgggcagacctggcctgcagccaagacagaagctggatgcgcctccctccggactcttgaccccaccaaatacgacgcccatatatgtcaactgtggcattggtgtttgtcccccacacccctaaaccacaagccaataaattgcagggcactcagacatcaggatgtgtccttcacttgccaccagacctgagctggctacaggccaatgacagcatagggctggccctgcccgcctcccatctggcagcaaggatccagttccagattgtgacctgtggttgagtctggcacagtgacccagggctccagcaggcaaatcccagtcataaaaccctggtctgaaccagccacgtgatggaccccagttatctcttcctaaattgcagcagagctgatcttcttccagctgagccaagggccatcagacagggacacgtttacttttactatcctattaaagcatcccagaaaaaaagaaacagtccccatatcctagagcaagaaataagcaaatcattatctacaatgatatcctttaagtctaagcttgcccagaaggtgctgcacatttggagaccaggctatggctcccctctctgaattcttttgaaaccgcagggactgttacaggcgcctccaagactctggagccacagcttgcctagcgcagcttccccctcccggcaaagccctccctgacaaccctacccacagtaatctcaactttcatgaaccttttctctccccatagggtgaacacataaagacacacacgtgcagccgggcacggtggctcacacctgtaatcccagcactttgggaggcggaggtgggcagatcacctgaggtcaggagttcgagaccagcctggccaacatggtgaaatcctgtctctactaaaaatacaaaaaaaaaaaaaaaatagccggaggtagtggcgggcgcctgtaatcccagctacttgggaggctaaggcaggagaatctcgaacctggaagggggaggttccagtgagctgagatcatgccactgcactccagcctgggcaacagagtgagactccatctcaaaaaaaaaaaaaagatacacatgtgtatgcacatacacacgcgtgcacacacacacatacacacagcgtgtacatgttatttctccaatgaaagcatatttcccttaagggataggaccaatcacttatctttccagagtctaactgaaaaatggacccaacatccttgaattaataaataaatgaacaaataaatttgttgatggactggtcagttgataatgtcaaggaactccctgcaacagcctacacaggttcaccctcctccaaaatcatacctttccaagtccaaggaaatgctcaattcaatcatgctgttttagaaataaagtaatgaatgatattaacaattgtttagaaactaacaggtgcctggccaggcacgatggctcacgcctataatcccagcactttgggaggccgagacgggcggatcacaaggtcaggagatcgagaccatcctggtgaacacagtgaaagcccatctctactaaaaatatagaaaaattagctgggcatggtggcaggcccctgtagtcccagctacttgggaggctgagacaggagaatggcgtgaaccctggaggcagagcttgcagtgagccgagatcgcaccactgcactgtagcctgggcaacagagagagactctgtctcaaaaaaaaaaaaaaaaagaaagaaactaacaggtgccaggtactaggcttttgatataaatctcatacgttaatcttgtaagtgaggtagtattatcattattatccccattttacaggtaagaagaataaagaccagagggctatccacaactgaagtatagacagtgggtgaggaaacatgaaccaaatggttcttccagactcagggccagatccctggcacaaagtgcctaccctgcattgccttcagctaacgtgccaagcagacagttcccatccttcaattttatttaatcaaagcaaagaattcataagaatctgcccatgttcattattcaggcagattaaatatttgatagccctgtagtttaattttttatggctcagagattggagtgaagtgctccctgggaagccacactgtccctgggacagggcagcagctggccaaggaggccagaggccgaggctccacagggctctgctcagcacccacgtgcatctgtcctgactccagtaagctgctcatgctgggtcccagggccaaaggttacagacactttgtaagtttgcaagagaatctacaaaaaggaaagaagggctgtggggacaggaggcttagggcatcacaaaatcagaaaggaacccagatgaaccaaaacatccaggtcccaggaaggggaggcagcctcctccttctgtctctgaccacgcagcagaaacaaagcttttggacaaatgcatgagacggcataagggcaggatcaacttgtccatctctctgccaactaaagcaccacagggccatttgggaccttttgcctgccccttccagccacatgtaaccttcacagtcactacatattcctcccagttcactgtctccctgcagaagcttgaaagtccacagagaacaagaagagctgggagccaagagtccttcacagcctcaatctgttctcctctggcctaaagaagctctctttcctagtccttttcttatcttcaaaatgaaattccagcagtttttgtctcagctaccccaaaatgcccaaatgtcatgcagcatgatttcaatccctgaactgctccaacccaccccgatgcccccaagtctctctcttgctctccttccctcctttcctccttccctttctccctccttcccttcttctctcccccatccttcctctcttctctctctctctctcacatacacacacacacacacacacacacacacacacacacacacacacacacaccccttgttcttctgtgcctaccatagaacaagacctaatatctaagaatttcactggtacccagtcaacatccaaccaattaatttgttcaagggtttagaggggccaggagaggagactttttcactccagcagcccacggagatttctgttttaatttctttttaattggcagcgccactaacagcatatcagaaatctctctgctccgacccttctcctctcctctgttctcttcaacttttacaagggaaggacatccggcagttttctggaaaaatagagacatgtcacagcagagcccagctcctttttcctgccatccctattcatcaccagcctcctgaggagccggggtggtgacacaggctctcacttcatccatgtggggctcatcggggcaggtgacgaggagaaaggcatgcgccactccccccagagatggggcctgtcgcctcctgggaaaactggggtggagggctctcttccccgatcacctggctctatcttgctctacagacacctcactgggccctcagtactctcatgagaagagagcagacttccagccacccctgcttgccactccaggcctctctgctgatgggtgtatggccacgggacactggaaataacaggagtgtgtggtgagggagaactgtttgcccattttccacattcaagaacctggtgaaaagatgagcaaggattatctccacactggaaccattcatgctgcaaaaacagcactgagacattgaaggggaggaggcaatttatttgctgtcttgacactgtcgcccaagcaattctcatcgtgacaaaagaacactctggacaatcactgcccctcctctttcaggaaaccacactgagttttcatgacttgcaggtgacattttaataaggaatcaacatggaaccacaggggaagtaagctgaggccaggatctaggaggaccagggtgggaggggccaaaaatggcactcaggaaacaaagtcacctacggtgcaaaggctctttgtgcctgcaagtctggcaccgtgggatttctggcttttttctcctctctcatttactatttgggcagaggggaagtattttccagaaaggacaaagtagaagcagcctcagtaaagagctctctagaaacttctcctattcagttggtgttttacaaagtgcaaagcactgcaggcacctccattcacttatcccgttacgtgggtgtcgttatctacatcttataggcaaggaaaatgatgtgcccaaggtcacagagctactgaaagaaggaaggagaaatcagacatttctgtgccacctccttatagaagttgccgtcccccatcataatccaattaatggtaaaaatcacaactgaggctagatatgcagtaactccttgtgctctgcacagtgctaagcactttacatcagttgtctcctattttaatcctcatactaatgccaggagagaggtgttatcactctcatttgtcagatggggaaatcaaggctctgggccatcagtcacttgtcccaggccacagaagcagcaggagcagaaccaggattcaaactgtgtgcccctgcctgtgtatctccatggttctcaatcttgcctatcatcagcatcacctggacaaatggtccaaacaagacatgctgggccccacccaaagagtcgctaagtcagtggggctgaaagcaagcctaagaatctgcatcgccaacaacttcccaagtgaggctcttactgctgatatgaaaactccactttgagaacctctgctctgtctagcctgcctcttgtcacccacaagctaatgtgagcatcctgttagacaagtaatggaacaagatgtgcaaaatgtggctgcaggaagttcacttcctgatgcacaaaatcgctccaagaaatcacacaccatccagaaacacttaagcatcatctgcattaaacatcaactaagggatgttctaagccaatttactctaagactcactctctccttcttctgaacctcctctgctgaaagtgaccatcttccagccagcccacctcatgatcattaaaatacagctgtggagacatagggagcacttctgaatgagcaacccccatcagtgtccactcccacgtgtgtatttgtatgcccatcatgcaccatatggtgctcatattacatacgcaataaagtgcacacagatgtaatcattttaaagagtgataaacgtaaatagaaatagatgtcttaacattttcttcccctattccaaaggatagttttgtgcatcccactttggaggctgctggtctagaattcactgttcccgtttctaatttctgatcattagaatttggcaaccaccccctgcccctgcaggctgaccgagcgtgtctgaagagttgctgtgctctgtggttcgaggaaaagccgtttcctttctgttagcaagcccctagagaacacaggctgaccctccaagacttgcccagcacaagctctgtaagtaaggatggctcagccaaagcttcttgactgtgggggtcttttctccaaaagagaataagaagcatctcagagcccatagagaagacagtggctgtctctaaaagcttttgacctaacaagcaagagcaggagactgagccctcacttctaaagcagcaggaggagagggaactggatcagggtcagagagcaggccttgggatcagcctccaccaataaccatgggtgagactgggaccacactgtgtcccccaaggaccaatgtccttgcttgtcaaatgagatatagggtgaccaaccagtattgtggggcctcccagaatgccagagtttagtgccaaaactgaaacacactagaatgtttggtcaccctagctgtggaccaggtaccgggctctgggcaactataagtgtttatcagccctaccctgacctctgctgtaaggtatcctaggagagcctgagggagctggaggccattccctgctcactagggtgttgcaatcctaacaagatagagataatgataagccatgccaagtcaaatgtcaataccaggtcaaaacagaagctggaaagaggacataatgtaggctgccgtggccaggacagaccttcaggaggagggcagggtgcaggaggaggcagattaagcacacactgaagtattctttcctcaacctcacctcatctcctccctccccttccccaccaccaagtagagcaggaccgcagagaatgaacttaggctctggagtcttcctgtttgattccaaatctggtgctacacttttccttttggagtgatctcgggaccattactcaaactgcatagctgaggtattgttttctttaaaatggagccaattataccccactttccagggttgttctaaagattcaatgaagtaatgcacacagaacactttgaaattgtggctgagagcacaagctctataaatattggctgttcttaacctctcttgacccttttcaatctgttcgtgaatctaaggtattttcaaagaacagtgagctctccatgagaatgagctatcctgaatatttctgttattaatgatgggtacagccggcttagttctgcttctatctgtcactcctgaagccagggaggatgagagggtgtgtggagagaaagtcacagggaagccagccctggccccgggcaaagcccaagggtttctcctggccctgtgcataataagaagcagcttcctctgtctccatttccagctcctagccccaagcaggcaagtcatggaggggtttcccttcctccctagtcccccaggttctgaagaaagaaaggttcagaggccttctccctctgcagaaagggtatgtcacctcaggccatgacaagtccccagctaagcatccgctcaggaccacttaaagctcttgaaaatgagctgtcttagctcatggcaggtttcaagaatccctgcaggatgaaataccagcagtgttccccataaactcagtcagcgatgttgatggtaggaaccaggaaaggtaccgtcctgcctaactttctctccatccagctcagccctagaactcaacacatatagtagaatctagatgagtaaacccccacacagacttggccctgaaattccaccattaggcattcacttctttgatatgaacttcttttctgtaggtaatacatttttttttggttgcctggtatgtcaactggaacacacttaaatgaagaagaccaagattcacctcagcctctccccttagaaatctcgcaagtcaactggggaaaacaagccacacagaagtgtaatacacaaaaagaagtgtatacttcttcaaaaagtatatacttttggtgcaatacacagaaagagagagaagtgcaatacaaaagagagagagagacactatcacacttgccctcaaagggatacccccaacaacactgcacattccccttaccacacccccattgcaccttcaacacaatatcccaataaaagtaattagattaaatggtcattgtttgtcatgggcaattctctcactgtactgtgagttccttgaggcaatttttctctttttatccccaaaatttcgtgcatgggacagagtaagtagtcaatgaagatttttaaaaattgttaattaaggaatattttaataaaagtaaaatggaaatgcaagacattttgagaagggcaccagcttaagccagtggtcctcagagatggccctggacctgcaacatcacctggggatgtgtaagaaatgcaaagttgtccctaccccagaactacaaagtcaggagtccccaggttgggctggtactgtgcgttttaacaaggccatccaggtgatgctaatgcccactcaagtttgagaaccaatgacttcattcagcctttatcatcagacaccttctgcaatatgggttaactgtcctcaactctgtgaatataggcatatattcattcaatatatgcctattaataagcacccatgcagcaaaggccaggtggagccagccctggtcattaggtggcccaacgatgtcgacaagatggcagacaacatggtgagtccctaagcagttactcccaaagaccctcaaaggctgttctgagccaacaggaagaaaggccaccaagttgtggctgtggccagctgactgccctttaggaggagctgtgaggatgagatttcctagcaggaagctgctctggggaagggggatggcatcctgacacctgggagcaacagcctggaccatggattgggaggcggagggaatggggcagggcagtgggccacccaccttgtgccattggctgccggaccctgagcactgactggtttggagcctggtgtctgggctggtaaggaagcaaaggtgaaaggggtgtgggataaggcaaggtgagggagcagctgagccagcatccccttctgatctgttgataggctccacatctaggcctcttctaaacaaaaaggctgagctgccggctcagcagcagctctgtgggtgcacagccctgcccatcatttccccctgtattaggaacaaccgcccaactctggcccctggggcaggcccagagcccaggggtgacgaggagacagcacctcagccctggaaggtaccatgtccaagtgctcctcagccagggcagccatgttctctggaaaccagtagaagtgcagaggacactctgttccccaatcaggggcaaagttgccacaacttctccagacttggttttccagggccataggtcacctgctgacacttcatttaaaccattctcctgttataaaaagggacagtttggccaacctctcaacttacaggccctttagcccagtgtggctagccggctcttcccaggcacccacaggccaggagctaggaatgcctgctccactcaaggcccacctgccccttcccatcttccccctctaggcagagggggtcataagggttgcaggagcctcagacaggggtagatgaccccagggcctacctgtgatctcagggcgatgggtagagctcacagggctgacagacaaaagatagggtgccagttacatttgaaattcagaataaacaagaaataattttttagcataagtatgtctcaaatattgcatagggcatacttaaactaaaaactaaaaaccaaaaacctatcttgcttatctgaaattcaaatgtaactggacaaccttattttctttttatttatttattttttattatttatttattttttttgagatggagtctcactcttgtcgcccaggctggagtggagtggcacgatcttggctgactgcaacctctgcctcccaggttcaagcaattctcctgccttagtctccctggtagctggaattacaggcacccgctaccatacccggctaattttgtttgtatttttagtagagacagggtttcaccacattgaccaggttgacctcgaactcctgacctcaggtgatccgcctgcctcagcctcccaaagtgctgggattacaggcgtgagccaccgcgcctggcctggacaaccttattttcatttgctgaatctaccatccttactctatcagcaagcccagaataggaaaacctggtttttccaaagcagagcttaatatcacaagagaaagagccttgaaaatactatagagtaaggcctcattcacatgggtgaggttgataatttacttcacaggtgagatgacagtatcaaggttctgtctggcctctggcctctggtcaattgattcaaactttggatcccagctctggtgcagctgtgctgcctaacctcagcaagtcactcccccttcctggtggtcagttgtctcatcttcaggttaggacagagtttctcaaccccggcactgttgacattttggtccagattactctttattgaggagggttatcctgtgtattataagatgagcagtgtccctggccgctacgcaccggatgccagcagcacccaccccaatttgccaatgtctcatgggaggcaaaatcatgcctggttgagaaccacggggttaaatgaccctatatcctaatatctagggctcccaccacttttaacagtcgagaattattgggtttacacatgaatttgtggcaaagattcctcttaaatatccaactcccataatgaatctaacaggagatgtgaatgaccagggtttgattacatgtaaactttttaaaaatgtatcctctacctcactcccctcaacctcattccagcattcagaaattgacctagcctgattccagcaagtggctccagctctttgatggccttacagacagcaatgacttaataatactaaaaaataaaattatcatcaccctgattgaagggaatgatttactggaacttcttgggcaaacagtttttgctagtttaatattaatatgactactactaacgatagagtgtgtagagtgcctacaacacgctaagaccacactaggttatgtcatttaatcttcacaatagacctaggaggttggtgctgtgcttattcacatttagcagttgaaaagaaattaggcagtttgcctaaagtcacagactctgcctgtgctctttccaacacagaaacagtctatttacatacagctctcacaggagtagggaaattcattcctccctgggcctccattccaggtaaatactcacagtctttcatctccaggaccgaaatctctaggaccacacagaaccccagtccttatagggctgccacgtacagacaacacactggcttgtaaatgtatcttgaccttgcttttaccttgaaccactctttgtaactccagggcctactgtaggagccctaatcagccctactgtaggagccaggcccacatcaggcactccctcaataaatggttgctaaataactcagtgttcccccatttcaaagatggagacactgaggtccacctctttccgtgcaagtcattatctaaaagaaaaccaacgctggctctcaggttttgtttgtcctgaatccaaaatcccccacagtgctgattcactttgttttcttaacttgctcttaagatcccacatttccttttgtattattagtggatggagagttgattggatttgagtgacctggttgcctggtggcccaaaggactggcccaggagaccactgaagagttctagagcctggatctggaactggggcctggaaaatcgtgtgtccgtgccctcagttactaggtcaccttgagtggggctgccacattgttccatggcccagtttcccctcggacagcatgctgagtgagattccccccacggcgtgctattattacctggcacaccaaggaattaggccactgctacaatgaggccaccccgccctccaagattcttcaaaattctgctccttagagcaggacaacagggcaatgtagggcagtggctccaatttgctgaggactgcaggatgaaagagggcatcttggggtgactgggtgaacactgttctgggacacccagctatgacagaagggaccacagaacaaaagggtgcaaactgtgggcctcaccctggggggaaatgggtttagaagtcatacacacacacacacacacacacacacacacacacacacaccctacatataccaccagggagtctaattttagtagccatttgccccagcaaagcactttgcaagtagttattttgagaaatggtattagccattcggttatttttaatgccccttctgtgacaggcatttgtgacataaacagcagctgaaagaccataaacccatagcccttagatgtgttcagggcccaggcagcagccccttgggatgtcccaagcccaattcaaatggagggaatgggcgagcatcttgtacgccctgccggtcccgcctcactgcctactgctccgttcactggggatgggcagcaagatttgactgaatgggaagcccctctggtctgtgacagccagtgtgctaatgacaaccttcagtgcttgccgacagagtgcaggtgaaaatccacactgctaatgaaggtccctcgtgggctgtccccaacctgatgttctcagaccctgctcccaacacatggcttccacactctctgccttcccacatcctcccctctgctcaagctgacctctcatttggatcagcccactcctcatctctcataacccagcccctgctgatctgcatgctctgattccccataatgaaagagctggatcacctccttggccttctgcatctaatagcttgaattgttggccacctgtgtacttgtatttcttattgaagccactgcatttactctgtactgaggatgcaccaggcatcattctaagcccttaatgaagttcagggaactttcctgaggatcctagctggtatcatcatcatctagattttcgagatgatgaaatggaggtatagggaagttacccaaggcttctttgcaagtagtgctctaagcaagactacagatgcaagagcctcacggtctaggtctaaccctggttctgcaccttggaaccatggacaagttcgtcagtctgtgcctcagtctttccctgagttcctgtaaagattaaatgagttaatgcttatatgatccctttacagatgtctggcacatgacaggcactgtctaagagtcctcgcttgtatgggagtggagaggagaggccagagtattgtaaggtaagatgtattagtgcctacaatgtgttatgcaatgtactaaagcattctgcatgtattatcatatttaatgctcataataccttgtgaaattttacaaagaaattaagcttagagaagtgaaatcattctcctgtggtcaaagccagtgaatggggatttgaaccaggtagctgaacacaagtctaagtttattaacctgaatcctctgctggttgtcttgactctctggaaactgatcatgtcttcagatttcccacagttcctggcactaggttgagcactctaaacagattcaatgccaattgcaggcttctgacaaggcttcctaaatgcagagccctggctgcagatcaggagaccctggcccctccaagggcaccccggctaatcagcctcttcttctgacttctgactccaccccaggacaggcatggtgcttcgaaagcagaagtaaggcagcagaacacttggagaagcctcgctgagggccagggcctggtggttcggatggcagcaagctgcccccagggacccaaaacccaaaggtcaggaatgtagtactggccagccagggcaggcactgctgtgtggtagaagagaagtccagaactgtgaggcgtcaagcgtgagttggaggcaggatggcagtgagaatgcacgcccaactgagcgagtgcgtgtgagtgaattatgtgtgtggttcagttttaggcactgggcagatttgcaaagctcatcaccctcctagagttgcctgcaaaaggccacatgtttaacaccacgtcaatcaatcaacggaggtgcactgggtggggagtgtgtggccaacccagcacggggagccgtgcagctgcagggaagagagcatctctttccccagtggctcatggtcatagccgaggacacaagactggcccttgtgggaaaattgaggggacctgttaaatgctgacctctaatgtggttccagttgagtcaccatatttcttgtgaacctccaaagcactggaagacttctgggcctcgcgtggctgcaggtgaaacatacagccaatcactccaccctggagtcttggtttcctcccctgcagaatgagagtgacgctgataagacatctcaggcagaggcgaaggaggtgagccctgtgggaatttcggctgcccctgtgccaggctgaacaagacagggcctttgctttctgggggctgatgagtcatataaaggggatagaatcaaacactcaaaagacaataaccgcaacacagggctgggtgaataaatacacaactggctactcagaatgggataaccatgggagaggacttttaatgccaaagaaactcaccacgttgcctttgactttgaaaagtgatctgtgcttaatctggcatttcgccaattggaccatgagcaatggggtcccagtcctcattacccagtgcctcctttgcttcaggccagggctgaataggtacttaggacattcctaagaaggactgtgcaggaggaggctagcccagctgcctggctagcctcagcacacacattccctggaacagcagcctcgcttactgccagaccccacaggggtttctgcaggggctggacaaacgggcacatggggatgaaaagggtagagtccccagagtcagtcaatgtcagtgaattggcagccgctgctcacagagctgtctggattctttgcagcccagagagcacctttcaccacccagatggggaggccttgccaaccctgagcccctcagggaggtcatacgtgtgattctcagacaccagagggagcagttttccagagagtgaagaaatgggatccgggaagcttggtgaattcgtctgctggggctgccatcataaagtatcaaaaactgagttggattaaataatagaaatgcattgtctcacaggtctggaggccagaagtctgacatggagatgtcgttggggtcagttccttctgagggctgtgagggcacatgtgttccaggcctctctcctagttttcttgtccttccttggcttacagattcatcaccgcaatctctgccttcatctttataggcattctccctgtgtgcatgtctgtctctgtgtccaaagttcccctttttataaatatgacaccagttattttgggttagagcccacgctaatgatctcatcttaacttgatcatctgcaaagaccttatttccaaataaggtcacattcacaggtacggagggctaggacttcattatctgttggggagacacaattcaaccaataatatttgagttcctcaaaggaaaaacagctttttaaaaagccaaactgaaattcctaacattactaatatactggaacagagtcccaagaagtaggctcaatgtgtgaaggagcttcccggttccagcccccacgttaccccagcccaggcctttgtggcctcccgcctgcactgctctgtgatgggccccttgccggctgccctgacttggcctgtctcccttctgctacctccgcatcaggctgccacaccttgcatctcaccaccaggtccacctcggtcacgacaccttcctggtctaaaggccccagtggcagtcaaccacccagagggctgactgtggctcactccttttgacttcagcacccttggtaatctgcaccaacagaaacatcggccaatgagtgccgtgatttctctgcccgttttctcattcatgaaagggagaaaaaacgaactctccatgcatctactcccaacacattcccctgagaagcctgcggggaagctccctgggagcccattgccaaagcttccacctcatggagctggcgtgtacacagacaggcacagcctgccgtgctgggccaccatactggtgactggctgtgctctggtcccagcccaaggggtgggcaaaagaggaaagccagcctcatgatgagcagaggacagggaagagacccccacaccagggactgacccctccattccctcagaggaagcagaggctactgagccaccagtacccccgcggttcctccctgtagttgctcatggaaagccaccagcctcaggaagtcttcctgtgtggaagctcactggcaccaaggcaggctgagcccctctgccaaaggttctgggcagccatcggtctgataaagacacagagccctccttggaggcctggaagccccacccctagaaggtggtccttgaaagctctgtcactcatttcttctccagagcccctgaagcatcctccatgcagctgtgcccacctgaccatacagcctggccctcccttagcagcaccctggactccattcctaccacctccttgacaacagaatcctgtctgtcaccctcctcaccaggtgcgggtcttcaagataagagaccacctcatgcatgttacaaggaatgctctagaaggagcaccattcaagaaagagaggacagggccgggcacggtggctcacgcctgtaatcccagcactttgggaggccgagatgggcatatcacaaggtcaggagatcgagaccatactggctaacatggtgaaaccccgtctctactaaaaatacaaaaaaattagccaggtgtggtggcgggcgcctgtagtcccatctacttgggagactgaggcaggagaatggcgtgaacccgggaggcaaagcttgcagtgagccaagattgcgccactgcactgcagcctgggtgacagagcgagacactgtctcaaaaaaaaaaaaaaaaaaaaaaaaaaagaggacaggttgagcgccctgtcagaccagtgggcccccaaagctatataccatgtttgtttacctacttgatttctcaacatcactgtgagggagctatgaacatcctcattttacatacaggtaaggtaactgaagttcagctagattaagtgtgttgaccaggacacagcactagcaagagcctgaggacacctggctcctgctgtcacctggctgtcttcacctggtgtcccacaagtacttcaaactctgctctccaaagctctgctcattgtcttcccactcgccatccttaccagcccctacccacactaccttgctcttcctgaatcctttgtcctcactaggacaccaccctctactctgctgaccaggcaaacaaaaggacccaggcgaacaaaaggaccagtgttgcccaaggcctctgcagaggtctgtgcatgcatctcagagagcgaactaaccatgggagttcagcactgatcctattgtgtccttccactggctttttgtctgagctcccactggaaaaaccctgcattcttacttgatgaattttcaaaagcagccagggctttattatcaactgtcttttatgaataatcaaagtccaatggggactccctaattagcctgggcatgaaggccatttgcataacatattgaatgcctctggagtgtcaggtacctcagtagacatgatggttcatgcactaaacctcagcatgtgaccaagcctatggccagacacagatgaacttgaaagtgatgcactggaagtcgatgccccttgagggtgggtgagctcacagagtctattcctgacactgttgctctcacctcgtgacaaagaaccaatgctgctttcttgcatccacccctgagttccagaacccccgcagacaggcttccaaaaactgtgtccccaaactaagactgtgtgatatgtaagaagaactggcaggggacccaacctatattataaaacctcttgatctcctaaaagagagctgagtttaacccgacttagatcaccaggacagatgctatcacagaatcttagaatctgaggttgtaatggtcttctccaattcaatatcaaatccagtgctcccagtcctcttctcctaggactttgtatttgaggtggggaataagggagaaagtggaagatgtggctaacttgcaggtgagtaaaggagaagtcaggaagaagtagtgacttgtcccccaattcccacactcaggagcatgggcagtggagggagaaggatgctgccactggcttcatttacatttgtccatttacaaataccatggcaacaagagctcaggcatgcaatgccctcctgcccagattcctgcttcaaaatcaaaacaaatccagtatgcctggaaaacctgccacagctcagcaaactaggaacaggtgccatcaatgtgccaaaaacctaaaggaatctgaaaaaaaaaaatcagttatgcagaaaaagagaaggcagggaggccccttgggcagctttgctccctgagaagcggcaggatggttgtgaaacaaggagtgaggcccttgaagaacctcacatcagagctgcctacatcagtagggctgaacagggaggtgagccaagtatcaggcaccgggactccctggtcactatggatcacagcagtgttcagcagcagcagcagctctgagaagccctgggaatcacatggcagatacatccagaagaaaactggccagggcaggggcttgtccctgacacagcaggtggcagctccaggaaggaggacaagtccaagcacagtttgtacctggcatgttggccaggttaaacagcaagccagatgcaaacagttggcacaaggtgcagtggctttaccaaacacagagaagaaatatcacaggattaagttccccttctggaactattcatggttccagctcactcacccagactcacaggtctctgcaaggcttcacttcatcatccagtgctctagtgcaagatccgagagtagcattctatgggcaatgaggtgcacagcagaggagcccaagagaattgaccctccctatttacaggcaaacactgactgcattcatggatgcaaaacacgaaaacctcccaccagaccttgaaaacattcttaactataaaaggtagagaatgcagcactcaaaataaataaatttgaaaaaaaaaaggactgggtgggaaagtgccattatcatcatggccaagagcacaggctctgctgtgaaactggctggacctgagtcctggcccccagtcagtacccagatgaggctgagtagggctcaaccctctggacatgcgtttccccaatctatataatgaggacaaacaaagcacatgccccttggagttgttctgaggtaatgcacacaaagtgcttagcacagtgcacagaggacagtctgtgctcagtaaacaactcgtgtgatattgtgataattgaacttggagaaaccatctattctatgtctgcagtaaaagtcaagagaacttatttctgaaacaagatgtgttatgaagggcacatttagaaagcactctcaaaatgaagaggaaaaaaatacagaagcagaaatactgtgaggtctaagacagattatacaaaaagatgacagatatagaggacaggcagccaattcagaataaacctaactgaaaagacgaaaacaaaaaaaagtttcttaacacagaagacagacccaagtctgaaagtcaaaatgctcagtaggcatgtatatatatatatatatatacacacacacacatacacacacacacacacacacatatatatatacacatacatacatatattttaatttcatggtgaagaattatcagcatccaaacagaagatatcagattatctatgaaaaaaaaagagaaaaatcaagctgatatctgatgtctcctctgcaaaacccaacagcagggccaagttgtcattcatattaaaagaaacaaagtgcaaagtgcgataaagcagaatacgttgttcaagaagattaaacaggtgttaaatttttcatatttgtaattaagacattaatcaaaacaaggaattcaacaacaggagatgtccatggtaataaagatctggcaatgaaccctaagatctattaggtttaaataattgttacaactgtgattacaaatcaaaatgaaaatgaaaactaaaatttattggaagagaagataaaatgtgaaaaatataataataataagtagaagttttaaatatcagattataccataaaagcatgagtgtaatattatggaatgggggaatgaaaagaagaaaaattatttatcttacgtggcaaggagtaagaggctatttcactctatacattaaccattggcaaaatatggttgaacaatagttttaaatacttgagaggcagcatgggtagacattccaatttaataaagaaaagtataaaataaaaaatttaaatatctattacagatagacaaaaaagactgcaaaaagcattttttaaaaaacagaaaggccaaaacatattagttattacaatcaaaatgtgtggtacacattatatatagtattaactatatgcaataatatataataaataaatatataaaattatacactgtttataagaaatataccctaaaccaagtgacaaaataaggttaaaagtaaaagaataaaccagaatatgccaggcaaaaatcaagtgaggctcacacctgtaatcccactgctttgggaggccgaggtggcaggatcacttgaggccaggagtttgaaaccagccagggcaatatagtgagacaccatctctaccaaactgtaaaaagcaagctaaggagtgatgccaagttaaaggcaatggtatccaagcaagtgaaattcaaggcaaaagacattaaataaggcaacacaggaggtttcacattgatggagataatccaaagtgagtatctaaaagtcaatgacttttaggcacaaaggaagcctcacaacacaaaacatcaaattgtcaaaaataagaggagacaagtgacagaaacccagtagcagtagaggagtttactgaagtactattgctctctcatatattaagttgtccaaaactaaacataattatgggtgattagaaggctggaatttctgcgttaactggtcaactggagagaactggtagaaagctcaaccctctggttttggaggttggaaactgagacgggatgatgagtcagtacagcacagactagtgtggtccctgggctttacctcaaatggaaacttattaaaaacacacattctcagacctatcgcagacctgaccgaaatcagaaactctggagtggggccaagccctccaggttgttctaatgcaggctcaaggctaagacccaccaaggcaacaattaagcccataggctctggagggccagggccaaatcctgccccatttcagcattgttgggtgacatcaaacaagttgcttaacctctctatgcctccattatcatcatccataaactgagaagaagaagaatagtgcctcctcttggcatggccctgaggacaagatgagatcatgtggacacaggctcacagtgcctgcacggtgtgagcactcattgatggcttgctttggttcaggaatgcttggcagagctgtgcctccagccccactgctctcctgcctcccaacacccagaggtgttgagggtgaactcctctgcacccaatcctctgtgcatgtgcctgaggaggatggactgtcccctgacaatggatggatgccacctcatggctgatcactgctgcatgaggcagtgtcataaacccctccttgatgctctctggctggagcggccagttgagtgactcatggagcttgtcatctcagggcctccttccctgatgcacacggccctctatccctgccccccagcctgattcctcctccccctggcaagactgcagagctgagcagaggctgacccgatctgggcccctcgtctctgcagaagagagaaagccagcatgcagcggactcctgggcaagttccaggatgctgtcctcaagtaccacgtggccactgctacccatggtggggtgggagcaggggcaggcagaggccttgggccacagaacaaattctctctgtctgtgagcagaccagggtcaggtgtgtcctagttaaatcaaaatgtcctgtggggcaggaaacagtttttccactcataaagatgcagttcaaatttgagatgtgtcagggatttcactgtggctgactgtgtgtcatcatgattagatcatacactcgagcattttagagctgtaagtccctatggaaatcaccctgtgtatccccctcctctgccaggtgagacccatgaaggacagagaggccctaaggcagccccaaggtcacacaacataaaaatctaacagcaagaatggaaaagaaactgccttctaccacattgggttgccatgaaacctaacagctgggggcgcctgggaagagagaaaaagtcacgaagtttcttcctgacactcccactgacaatcgtgattctgacaccagaaatgccttttcttcatagcatttcccttacatggagaaatacacctcttgtcttgcttcattcacagttaaatatgcttaggaagacgaggagacggaggcccgtactcttgagccacccacctctgaatccacctgcctctggatccaccaaaatacctgcccttcctatttgcccgaatgctctcatgtttcagagccctctcctccaggaagccctccctgcaaacttcatcttaccatccccttttccatcctggatactctagagaaatcagagctcagattgaagctgagtcctcagactttcagttgcgtctgatttggaaggagaaagaagaacccccacatctctggcacccccatggacaccaagagaagaacttcagtccatctgacagcaaagcctgaactctttcttcactgagttcaaatttgcctctaccactcacccaccctttgtcatcaggcaagccacttacaactctccgagcctcaattttcccacctggaaaagggcaataataataataccttcctcctaggttggtgtgaggattaaataagattacatgtgcaaaagctccaagcacccacaatagataccgaactggaagtcactataataaaactgataatgacaacgatagtgatggtgataaatatcattagtgtataatccatacttggaccaatttgggttttttgttcaagaccgctcggtgagctgagtgtggcggcacatgcctgtaatcctagctgcttgagaggctgaagctggaggaccgcttgagcccaggagtttgagacaagcctaggcaacatagctagatcctctcttctaaaagaaaaacaaaacaaaaccaagaccacttggcaactctatcaaagaaaggtaaacaggtaagagctttttgggttaaaatgttgcagggatctgaactcccacccctctaggccagggaaggagaatgggagtggtaagagacttcctagtttaaaaatataacaataaaatccatcttccaaataaaaactgacctagtacacattttggattttttttctttcttccaaagctctgagagttagttgaatcctttaaaaagacagcatgctcacctctttctccctagcaccaatgatttggagagacagatcacttcacttctgacattctagatacatctatatgttgggattctccgtccacccagctagggcattctatgaagccaagaatttagttctaagctcccaaaggaagctctatttcaaaaagccgggtggctttatttcaaattgaagaggccattaaattcacaatattttgccaaatgaatttctcagtgatcctgagcaatcctctgaagtcagctgtccttgtgcagtcatgggcccagcacagagcaggcgtacatactaagcacctgttccagcaggtagagacagtgtagtgactgggacaagcctctgccctcatggatccagcactccttaaacaatttctgaagaaactcaggggagccagtgactggtacattctctgtttgagctgccacaagtgctgcgggatttttcagtgctggaaggggtccccaccatattagcaacaaggtatcaagtgccaaacactgtgcgacatcttacctaagttttcactgggcattttctgtttagtaagtcaggcactgagggagggaacatgtgacatgtccaatgttcagcttggcaaacagtgaagagggggtccaatggggggcagggcgcaggtggctgggatatggtgctggagggtctctccacatagggatacaattgggtagcatctccatcagctgacgtgttcccaattgtcctttcttggttatctgcctgcctggcaagaatgtgtttcttacactgccgccatgagcttacacttcactcactatacaatttattccactcacttttcacagtgatagcaggttgcccatatggctttatctcttctggaaagggagagtgagcatgtcccttgccccatcaccctccagatatggtgtctgtgcagctggcaggattggaacccagttctgtttcactgctcttcaagtgtaaccttcatcatagtctacaccctgcagaggagaagccatggagtgggaaggcagtgatggggaaccgagcaaccgagaggggtgccagactagcccagatccttgcaaactttcccatgacagccctgaaggcagaaaagaagaaacttttacctcctacctcagggagtctggattagaatttgaagcaagccttccacaagcagacagtttctttatatatattttaaattttatctttttatttttgttatatttttagagacagggtctcactctgttgcccatgctggactgcagtagtgcaatcatagctcattgcactatgatgcaatgaactcctgggctcaagcaattctcctgcctcagcctcccaaatcactaggtattacaggcatgagtcaccatgtccagccaggaagcttctttaaattgttgcattttatcttttaaaatatgtatgcatattttattcctcctcatgacaaatgtgattgaatacaaaataatattcattcccaaaccttcaagaagaactggttctccaggaaaatgtgccatgattatactgcagcttctagcattccctgtgaggctctgggctgtgcacctctaatgctggaaagtccaaatccaggagactcgggtctcctgagattccttggccatctgttcattcatgccatccactcactgattcagggcccagaggagcaccagggttaacggctggcggctgagtcagcagctctcaaggcaatcaccttttccacctactcatgaatcactaacctgctgcccccttgctacgtgcctggaaatgcataaatgtgcttaaaataagtggtacctgggtagcaagtttctcaccagcaggaaccagtccaagtgagtacagggcaaatagcagtgcggggtgaaaataaagactgactaccactggcaacccttggtcactcttcatttattcatccaacattgctgaatatttgccctgtgcaaggctccatgccctggcaatggggggcacttgaaggcaaataagagctttacaaggctctaggagatgtcactagtattccaaaaaccctaacagaagatacaaaagattagtgccattagagaggaaatggggtagaagctttggttggggggaagctcattagttagaggagagagatgttacttctaacttagaacatcaaaaacagaagcttcctggctttagccccaggccatgaagaatgagtggaatttcaggatacacagacaagaaagcagaaaagataaaatgaactcccacataaggcaggagataggggtgactagttatgtgggttgcagcccaggaacacagggaggaatgatggagatctttgagcaccaagaagagaagtttggactttttgttttcctttggttaatgaggagccatgaaagagtatttgtggaggaaagtgaagtaattagctaacatttagaaagtttaagtgggtagtaagatgtatgactaatcagaaatgacagagtcacgagaccagctggaagagtactgcaagagtccaagcaagcagcaatggaagcctgaactagaaaagagacagcagcagtggagaagagttgagccacgaggatttggcaactgactagagaaggcaccaggagaagcaagtccctgaaaaccatgctgcttgggaaagaccaactctttctctcatttcctcttagggaattgtaaaaggaattccctatcaccatttaaatttggttaaattcaccaaagagtgatggggtgaatcactctttggtgactaacccctctggctcttgtgtagagctaattagagtttcttctggaagatctgaaaccaccaacagtgagactcctcagatgaccctgatgggcaggtccatgattcaatctgtttcttccagcatctccccactggctgcagcacatctaggggttcaacctaagggagcccccctactctgggtatggttagagctcctttcaagatcattctaatatcaaaagagggaatcttcaaggagccttgttggcttcttatacttagagagaaaccaagaacacagtcagagttgatgtttttaaataccaaatctgtatgcatctatcagagagacagagagagaaagagagagagagagttagagagagacagagttttgaaacatggagagagggaaagagagatgttcctagagagagagagagagagagagagagtgtgtgtgtgtgtgtgtgtgtgttagagagggagagagacagagagggagagagagagagagagagagagctttgaaatatgaagagagagagggaaagagagatgttccgagagagagagagagagagtgtgtgtgtgtgtgtttgttagagagggagagagagagagagagagagctttgaaatatgaagaaagagagagaaagatgttccgagagagagagaaagagagagagagagagagtgtgtgtgtgtgtgtgtgtgtgtgtgtgtgttagagagggagagagagagagctttgaaatatgaagagagagagtaaaagacagatgttcctatgaagccctcagctcctaaccctctctctggctcagtgtttgaagcccctccagccgcccatggcaaaacttccttccagaggagcaggccatgcatcccagacccatgtgtatgctgtcccctaagaatgagagcagtgctctgtttcccaaatgggcaggggaagcaaacttttgtttccatagtctataaaacatttttaaatttaaaaacaaatgctttgcagcctctgaattattagttttttattaaaaatacaaacagctctatggaacaccatgggaaaatgaggactcttgcaacttcgtttggctccctgttaaacagaataatgttcatgaggaagaaggtactgtttgttccttaaaatgttgtattgcgtacaatggagaagagcaacgtggagatgactttccaatgtgttcccttgaaatgacctgaggaccgaatcaggaagctcagtctgaccagctcagcagactacccccactgccccatcccagagctgaacttgcagtcagccctgataaaaatctctggactagaaccagagcaccaatatcaagggattatccatgaactgactgttctttcctgcaggcaggctccacgctcctgggtggccagagtgccaatcagccctgtcccagtgctctaacgaggtgcccattcactgcccaagagacaacatgcccaagctatgacccagctccaagatctgaagggaccagactgccttcctgtttttctctgcatcccctgagctccctcttgaaaagggaaggaaagctaacagaaaagccactttctcacacacttttggtgagatttcatgaaagctgcatgacctttctggaaagcaacttggcaatgtatagagaatcttaaaaaacatgtgcatcctttggcccagcaattctgcttctaggaatctgtcctaaagaaacaagtctgtgatgtaaataaaaatggacatattcagttcttgactgcagtgcaacctgaaacactgaaaaactgaaaataactcagaggaccaacaatagggagatggttaagtaaactgcagtgtatctacttgggaaactaatatgcatcatttaaaagcatagcttcaaagaattattgataaaacaggaagatatttatgtatgcatctaaatgcatagagaaaagagtgacataaaacattcaaatatgaacagcaatcatctctaggatttaactgctgctttcatttttatttgattttattttgagacagggtatcactgtatcacccagccggcaatgcagtggcacgatctcagctcactgaaccgcaaccccctgggctcaagcaatcctcccacctcaacctcctaagtagctgggactacagatacgcatcaccatgcctggctattttttttttttttttgtaatttttgtagagatggggtttcatcatgttacccagggtggtttcaaactcctaggctcaagcagtctgcctgcctcggcctcccaaagttccaggattagaggcgcgagtccccccactcagcctgctttgacttttatgctctttttattgtggcaaaataaatatcacataaaatttaccattggaaccacttttcctttttcttttttttttcttttctttttttttttttttttgtagaggtgctctctccctctctctctctttttttctttttgtaaaggcatgatctcactacgttgcctaggctggtattgaactaagtgtctagttctatagcacgaagtacattcacattgtggtgcaactatcatcaccatccacgtccagaattttttcatcaacccatggtgaaaccctgtaaccaaaaacatctccctattccctccacctccagcctctggccaccaccattcgctttttgtctctgtgaatttgcctactccaggtatctcatataagtggaatcacacagtattgtgttttgtctttttgcgactggcttattccacttagcataatgtcctcaaggtgtgttcacccatgttgtagcatgtggcaggattaccttccttttcaaggtagaataatcactgtatgtctatgccacattgaacggacatttcagttgattctacctcttggttactgttttttgttgttgtcattttgttgggttttgttgttgttgttgttgttgttgttgttgttgttgtttgacagagtatcactctgtcacccaggctggagtgcagtgatgcaatctcggctcactgcaacctccgcctcccagcttccagtgattctcctgcctcagcctccagtagctgggattacaggtgcacaccaccatgcctggctaatttttgtctttttagtagagacggggtttgaccatgttgaccaggctagtctcgaactcgtgacctcagtgatctgcctgactcagcctctcaaagttctcggattataggcgtgagccaccatgcccggccctacctcttggttattgtgaataatgctgttatgaagatgggtttgcaaatatcgttttgatttcctgcattcatatcttttggttatataccccaaagtggaactgctggatcatggtaattctatgtgtcatattttgaggaactgccatactgttttccacagtgaatgcatcattttacattcccgccagcaatggacaagggttccaatttctccacatcctgtcaacacttgttgttttccaacttttttgataatagccatcctaatggatatgcatttttatgcttttatgtattttcagaatctccttcgggaagcatgtggtatgtttataataagaaaaacaaaaattaacgttatgttttaaaactgtgctagggaatggctcactggatgttatccactttactcctcaatgctgctgggctaacagtcctcctcccaccctcagcaaggcacagctaaattctggggatcattagttgtcaaacaccaactctatggcaagtggagtgcaagaccctacaaccttatggggctgatatcataacccaattagcacaatcccactgctgctgcttggaggcctggttctccttccatgagtgttgctcctttctccccactcctaccccccacttcaagctccaagcgatgacaggagtatagaaaggaaagaaaagagatttggggattcacacagtcctggggtacaatcgcagctccacagttgctcagtgataagataagcaatgtcaccttcctggacctcagattgctcatctgctaattgggtgatggtatcaggttcataagtttgtagggtcttgcactccacttgccatagagtcagtgtttgacaaataaggatccctattcatttctggaattgtgcatagcttctgccacaggaagaaatacagcatacctactagtaaataccacttaattgactgattgaaagaaacccgtcactgtgaggatcccaattcaattatttatgtcctctcctggaagcctctatggagtgcaggtttctcaaacatagtcctgttctcttctcctcaaacaaaggatctcaggatcaaataagcctgggaagcacaaagattgttatcttcaaaaacagcaaaagaataataattaacatatgaaaggtctgtaaccaagaaacctatgtttctctggcaagaccctgtctctacaaaaaaaaaaaagaaaaaattagctgggcatgggggcacacgcctgtagtcccagctacttgggagcctgaggcaggaggatcacttgagcccaggaattcaaggctgcagcgagctatgacagcgccactgcactccagcctgagcaacaagaaaggccctgcttctttagaaaaataaaaaaggagaaacctatgtttctgaaacatattgaccactgaacacctttttggcataacgccaattaacaacacatggagatgactttccatgtggaaacacatggaaataacatatctccaacacatggagataacgccgattaacaacacatggagtgagcagtgctgctccactcctcatccgacctgaaacctggaagtctggttcctcaaggacatcgagccttgaatttccacatgcaaacacctgtgagtatgttggggctgctgcagatcagcagtctcaaaattcatagagcatgagaatcaccaggaaggcttgttaaaccagcgtcctgggccccagcctcagtttctgattcagcagctctgggctgggacccaagaatgtgcatttctaacaaattcccaggtgatgctgatgctgttgacccagggaccccattttgagaaccactgatgcagacagtcaaaaacccctcacatacaagtttaatacaggaccatacaggaaatctgtctactttctgcaatgccaaagaaatcaagtataattcagaacttgaaacatccattctcttctgggacaagttcttaaaggaagcatttcatagtagttaagaaaatggactctggagtcagaaaagagcacgtttgcaagtcccagatctcccagtgcctggctgtgtgaacacagcaagttattaaaacttcccaagccacagcctctttatctctaagggagagaaaatcatggcaatgcctagttcatagaatttctgtgatgcagaaataaagcaagcaggatgcttggggaatgcctggcatctagtaagtgctcaataaagattggttattctttttaatgactgttatttaatcatcttatctggtaaatagctcatctgcgtactgtcagctgacctcaggatgtgactatacagtcgtccctgtcatgggcgaatgcaggctgatggcacaggggtaaaagaatttaccaagaaaatcataggtcaagaaaggcagatttattagagaaagtggggaaatatgttgcctgagagacaatgggcaagttagcctgagagaagctaacttccagaagacaaaagcttgctgcagattttagagaatggaacttgggctgattgataatgccaaggcagcagggagcttaacttgcattcctctgtcagcctggatgtttgataaattgaggtgtttgatggtgagcaggaagcccgggagttatgtatgttatccgggcatgaaggccaaatgtcttgggtcatatatcctgggccatatgccctgggccacaaagaaaggcagacctgtaacttatctggtttctcttttgtttaaattctctggacgtgaagaaaggcagatttatagcttatctgctttatctcttgctttcccctggtcccaccagcctgactccttttccctaattaggactccacagtccccccttatccatagtttcacttttcattttttcagttacccacagtacagtacaatgaggaatttttgtgctctgtaatgagacagagcacagtcacatgacttttattacagtatattgttataattgcacaattttattattcattactgttgctcatctgtcactgtacctaatttataaattaaactttattgcagatatgcctgtgtaggagaaaacacagtatatacaggtatcggtactatccatctgcagttccaggcatccactggggtcttggaatgtaacccctaaagataagggcatctactgtatttggagacagggtctttaaagaagtaattaagttaaaatgaggtcattagggtgggccctcatccaatataactggagcccttataagaaaaggagattagggcacagacttacactgagaagacagtgtgaagacatggggagaagacagccacctacaagctaggcagagaggcctgtgatgaaaccaaccctgtcaacaccatgatcttggacttccagatagtaaggactgagacggtatatccgacttgagccttaagtccaagccaccgttccactattaactcccaccaggacaagtgcagtggcctgaggggcccttctgcttccactcctgcccttactccctggccttactgttacaagagtgaacttcaccagtgttaaccagatcacacgcgtggctgcctaaattcctccaatatgtcacctaatactgagaaggaaatccaagctcctcaccatggccaacaaagccctgaaaaacggcccctgccagcctccccctacccagcatttcccccacccccaccatcaccacctcatgccctaaactccactcagagtggcgtttttgctgtttcagaaacaagcaagctaatccttgccaccaggcctttgcactagctggtgctactacgtggaacgctcttcccccaaatttcctcctggctggcttcctctgagttcaaatgtcttctcctcggagaggcttttcccatccatcacaaagaaaccctcagcatcatctcacgctattgtcttcctacaagttagcagtagcttatcactgtctccctgagagcagccaccgtagctatcgaatgcactgctgcctcccgggagcctagcacttattccaaggccttggagcttagtaaatatgtgttgcctggataatgtatgtgaaagagctttgcaaactgtaaagtgctgcataaatgtaagataatgtcacaaatatcaaaaagagccagccaaataattcaaagaaaataggaaacaaggggagaagagggatgaggaattcagaatgaagctgagagatttcaagtgatgattcaagaaataaaccaagcaaccaattttgttaaatatgtgaggccacagggcgagggaagcacaaaccactccaatgatccattcaggccatgtctgctccactcagccatagaaactgcataaattacaggcagcagcagttttcctggagccaggcagtagaacactctccttggtgccggcctgggaggaggatcctggcctggcaagcagggctgactcaagctcattgcattagccctcccctcctgcatctgggcccctctcaccgcagtgctgcctgcccaggacctgcactcctccagcgggcgggactgtgactcacagatggcctgtcactcccagtgccagcacagagcaccacccgtgcctatctttagaagtttcgcaggctgaaaaatcaatttgcccgcctggcacctgggtctggggcctccccgctaacatcagtggcaggcgaaatgtggcctcccctctgcctgccctgatgcgtcagaccttactcagggtcccgagggcctggcagtgccgcccaacagactcctgtgagctgctgcacccacaggtgtgctggtctgcccctcagagatagccaggcctcaccagaagatgcgggcaaacaccacgccctagaaaatactggcaagggggaagcgaatcactttgcatcctggctgcctgactggcacattccccaggtggtcatctggcacctaatccatgtgtggtcacagcaaactggcttgcccaggtggtacaagttcagcctcttcctccaagcagggaccagaggtaagagaacagcacacaactccacgccttaataaaaaggcccaggaggcagattcccaacgcagtgacaactcccagctggcccccaggcttcccaactactgaaaatggccacatgtgactcccacaagccaaagggaccctgtattactgggtatgcggagagagaaccatctcagacatttcaccatattaataatctctctttcaataaagactcgctgagcacctggcagtggcagggtgggtggaatagggtaagaataagctgaggaacaagagaaaggaaatctctggccctggccctgtactttctccttgcacctgtgggcgctctgtgctcagcctttgagatttccaaatcccctctgaccttctgcctcttcactcacgtctagacaccatttttacagaaaccaggagctactgcctgttttgtttttttttgttttttttccagtaatacagcctagggccctgcccaccccacctccttttctttatgagatacagtgaagtccagctgtcctgcagcagatgaaaacagagagagggctctcacccgctagctctagttgagaaatgagaatgccccagaagagcttaagggctcaaaagccatctctgagaatttgcagaagcacaatcctacatgtttgcttccttaatccaaaaaaggatccaaggtcatgtgtctacaggagccagcctgttacggtgagtgaggggtgctgcattcagcaccgggggatgggggggaaaggagagcgtgcaatggctctgcccaaaccaatcatcaccatgaggggacacaggcacacaaaggtacattttcaatcttttattttttcaaaaacagctagcaatccagatttttatccaaaatctcctttgtaaatataggcaattgatgaaaaaaaaaattaaaaaacaatgaagccacatgggctaaaccaaacacacctgtagactgccagtttgtcccctctcataggtaggatggggtgactgaattctggggagcacgttcagaggtcgctatctttctctgcttctccccagagaggtcttcctaggctgcctctcagacacacagcaccagccagagggcaaggaccaactgataagccaggaagtgtggctcccatcactttgaggagggaatcaggaactctttggaaacccctgctgtacaccttgctggtgccatttcccaaatatttgtggttcacccctcggctttcagtgtctctttccttctctgcctccccacccagggctaactcctctccttcctgaagactctgttcaagcatcagctcctccaaagagctgcccactaagcagtgcccctccctccagcccctgggctgggaggcttcccggcacctggcatatcatgcactctgcatgcccacacacaacttccaggcacttgattgaccctcactagcagggagctcctcaagagaagggctggttctcttccatccctgttatccctgcagccagcgcagatcttggaacacagagcagctccacacagaactgaaccagcaacttctccaggagcaaatgttttctgagcactggcctataccaggtgcatgcgaagggtgcataaggccactgagatgaatttgacatatccaggggcttcagaggatcacagtctcttgggtctgacagatgtttaagaaatccccatcatgtagagtacccacagcccacccccctactccgccccgccacagccaccctcctcccatccttcctgggtcttggccacacttgctcttccttctgcctgcaacatggccctttcctgaaatctgctccaaactccccttaacaaagagctttctctccatgcaccctccatagcactattttttcccattccctgtttcatttgtgcttgtgcacttatggccacctggcttctcctgtttccctatttgtcctgtctgtggtctgtctccactactagacctaacccaatgagggcagggcctgcatctgcttcgttttctgcagtatgcccggtgcagaggacagcgcctgacccatggtaggtgcacagtaaacagtggttacccgaatgaatttaagaatgagaaagtaagatacgttccaaaagctctgcatgctgcaaaggcctctgagcctctatatgctgagaggcagctggacctctgcctcctcctttgcacggtgggcagagcacctgcagaactttccacttctcatgcctcatcatgtgtctgggctccggctccggtgctgcaaagcaggtgaagggccccctgtgcaagtgtaagaggctaaaacgggggtgcctgtgtgagcggctggtgtggggtgggcacctgccggtgtacgggagactgaagggtggagagggcctctcatgcaggcatgtgtgagcagctgcaggtgtgtgagcaaatgtgcatcactggggaacaggtgtctgtggatgagggaggaagtgagggtgagggtgtttgtggacatagggatgtgtgttttttacaaaaaaaaaaaaaacaaaaggtgaggggaagccggcctgcatacatgtgcatgcatgtgaacatgcgtgtgtgaatgtggggaagggcgcattggtgaaaaaggtgctggtgctttttctccctgatgcaaactcaggctggagagactgggactaggcagaccctacccttggcactccaggaagagttcctccctctatgaagagctgcctgacctcattcaaggtgtacagaaagaaagcagtgtcaccggaacccaggcctccaccataaatgggccagaggcaattccacagcagtaaccgggcaggcaaaaccacccctggaaaacacaagctgacacgaaggatgagcctctcaggccccctgggcgtggggtccctggaatccctctgtccctggctcctagtgattttacaccaaggctgaacacatagatttgaggcaccagtgcagtgcaggacatgggcgtgttattaccagctccatggttaatgagcattgcatccactgggagcagccaggctggggatgctaagacctgctgggtggttctgctgagttggggctcatggggcaagaaggccagtttctgccagcccctcccagcagcagtgagacaaggacacagacactgaagggcccgtgttctcagcctctccccctccgactcctgcccatcttcctggtcacatctcctcccaccgtctgccttgcttgctgagtccatgcatttgttcatttccccattcaacaaggaggtatcaagcaccactatttcccaggcacattcctagggtgtagaactgaaaaacacaggtaaagtactgcctccatgcaacagacattgtagttgaggaaacaggcgataagccaaactgataagagaaatataaggtgtgttaagacaaatataagatggtgacaaatgccccagagaaaataataaaatagggaagggaggcaggaagaggggccgttaatcagggtagccaaggaaactctccagcagccagcctcgttccctccccagaggcttcacagctgctgttccacacacctgaagtactgttccctcaaagatcccccatagtttccttttccaggcaagttgatcttgttccactcattggccacttccttagaaagaccctccctggccaactacataaaacaggttccccattgcactcacatcactatccccttagcctgtttcatattctaaaaccagttctcattatctgaagttagtttattatttatttactatgtttctgcctcccccagtgaaatatgaggtctcaaaggagagaggatgtgtgtcttgctgaccactatatcttcagcacccagaacaggccaacacatggcaggccctgggactgaaatttcatagtccacttcttgttcctttgggttaagcaatgccctcccccagcatccatttaaaaatactctcaggcaagtgatacatgaagtcatgaacactctagtatgaatccgtcacttctctctaggggctgctcagaaatctaggagcacgtgttagtactgagggaaggggacagggccgaaggaagaagcccacaggctgcctgcccaagcacaggactggaagggaggaggcctgggtgtggtgccagctctgtccccagcttctgggtaacctctctaagcatccgtttcttcatgacttagagctgagagggagctcttggtcacctatgctttggggactccagcggggaggaaatgagtcaattaggaggacatgaagttggctgcctcctcactttgccatcaaagacaataggtctatgttctgatccctgcctcagacaaaatggagaaaacccaaagatagtgggaagccgcctgcactgtatgaatgcacgcttggagaagactgtctccctgctgcccagcacccactgtccacgcatggttactattagaaagttaatcatggaaaatgctgaggtctctttccccagccctgcacctctcagctccacactacaatttcatcttccatatagtgttaccagacagtgccattggctccgtccactcacttgtcccaggcctttatgacctttccattcaagccacacaccacgtctgctccacagagctgtaagacacactggcttcagcccgcctggcctgggccagcacgctgacattttccatgagtccacatcagccagtgaaatgctcagaggggattaaggcaaccttctccatcacccccgagttgctttaggaaagagaataacagcactgacccctccattggcagctggtgatatccacacaccatctctatccagagatgaaaggctccttctccatccttgacttgcaaaacagggattatttcccacctcacgctttctgaaatatcaccaaagatgcagctgtgtttgaaggccagcctcataaaaggcgtaggacccacgtgtcagtcaacactccactgagaagataattgattttttttttgttttatgattatttgcgggcactggttctctttccattagcctggataatcgagggaagactgtaaagagtattaatatcacggccaaggtcactcagctggctcctgctgccattccaacccaaaggctgaattactatggcttttactaataataacaagaacaataaataacatgagtgattataaagccagggaactctgcaattacctcaacaattaacacatcccttcgtgaaacacagaacagaaaaaattttcaaaggttcaagttagaaaacttctgcattctgtttggtgcaagtgacagtcagaaaagggccttgtttgagggtatgcagtgtgagagtatgcagtgtgagggtatacatgaggtctgcagtatgcagtgcagtgtgagggtatgcagtgtgaggtgtgcagtatgcagcgtgagggtatgcagtgtgaggtctggggtatgcagtgtgagggtgtgcagtgtgaggtctggcatatgcagtgtgagggctggggtatgcagtgtgagggtgtgcagtgtgagggtgtgcagtgtgagggtgtgcagtgtgaggtctggagtatgcagtgtgagggtgtgcagtgtgaggtccggggtatgcagtgtgagggtgtgcagtgtgaggtctggcatatgcagtgtgagggctggggtatgcagtgtgagggtgtgcagtgtgaggtctggggtatgcagtgtgagggtatgcagtgtgaggtctggggtgtgcagtgtgaggtctgggatatgtggtgtgagggtatgcagtgtgagggtgtgcagtgtgagggtatccagtgtgaggtctggggtatgcaatgtgaggtctggggctggctccagttggtttccaactttaccaggtgtgtggcccgggcaagtcacttcatctcagcaggttcctgcacataggggctggtgaggactcaaggataaggcacactaaagggcttggcacagtgaccagcaggtagcagcactctctaagtattagctgccattgttgtctttatcattaatgtaactacatcttaattaggaatgatgggatctcatttggcccccacaccaatccaggaattgagatgagaatagtgtttcctctaccatccatcagccaatatccagcagccaccccaggggaggccactggtcatcccacgccatataaagttcactgcccctggatggtaggctcaccccaagcctgctccctcatcctcattcccatcctcaacagagaggaaagtccaccactgtctccattttaaagaggcagcctgtgacatccaagagaccttccagcctcagggaaaggcgtgaacaagagctccagctgggtctttacagatgaagccccactttggtacctcttctcctaacaaccccagcttttggaagacatcaaaattccaaaggctcagctgcagaaagatcttccaaatttctcattatagttattccctgaaaggccaagagctttattcttcatccatttactcaacactttcatggagcaactgctacgacgtgtcagcctctgcaggaggcagctttaaactaagtgtgacagatgagaaagaaccataacacacaaagcagggagaacagtgattccagccaaagaaaacagcatgtgcaaaggccctgaggtgcataaaatttggcatgttctctgtggatagggttctaaatcatgtccaggacagggggacacctttgtgtcaccctcatctgaaagcaacctttaagaagccacaggacagactgtcttcaactcagaaaacctccctgatacccatcttccatcctccacccctacattctcactcttgtctggtttcctcagttaccatcctggtgcctaatttctggtggcagcaaagtgcaagattagaggcccacacactagtgcccggaagcttgggcttcaatcccagatccgccaattatggcttcagtggtttggggcaagtgatttaactgcctctctgtgcctcagtttcctcatctgtaaaccatggataacagagaacctctttggagatctgctgtaaggatcggacaagtaaaaagaagtgaggctcttggataaataaatatctaaggcacatagaagttccctgaaaatgtgggcattatcaatatttattttaagcatcatcatttttcttattatattccctttctccatctggtcccttgagagtgatgactcggttgaatgaatgacacccaccccagtttctcaccccatctcccaacaccaggatccttttgcctagtgggtggttatcacttagatgtgcccatccccaaacctcacttgatatagtgatttctggagaccctaagaggactcagggaccaggcacggtggctcatgcctgtaatcccagcactttgggaggtcgaggcaggtagatcacctgaggtcaggagtttcagaccagcctggccaacatggcaaaacctatctctactaaaaatacaaaaattagccaggcgtggtggcaggtccctgtaatcccagctgctcaggaggctgaggcaggagaatcacttgaacccaggaggcggaggttgcagtgagccaagatcatgtcactgcactactccagcctgggtgacagagcaagactccatctcaaaataaataaataaataaataaataaataagactcaggggacttcctgcacattcccatgagccatgagccatctccaacaccttggggcagagtaggggactctatgactccactggggaaggggtcctgcaatggggcctgagatgtgctttcccccagctgacactcttttccttatttaactttttcaaaaactcccccaaatgttttgccttttcatttgcctcgcctcctccttaacactctccacctgccccaaaatccccagtagtttcaaaattgaataactgtcgggaacagcatttaaagatgctaatttaaacacacgtgtcagaaaaggcaagctggatccctgctcctagcaacagcccctcacccacacctcacagctgctgctgcccagaaacagggcttgcttgagtgagctggcaggggggccggatacagggaagcagagttgtgggacctagctctgagcctgcttctggcctttccccttggatggaggtctttatccttgcagggcagccttcaaaggtgcaaactctgccaagctgccaattcctcaagaaaggggtcttggggcaaccaatggtttaagtaaacccattgtatcacattttgaacatacagaactgctaacacagagacctctaatttcctttaataaacccaaactcttccatttgagtaagcttcatacattaaatagcaacacctactgttaaagcataacaagtctcctttccatttttcacatcataaatgtaagtttgggtcccatcaaggggcagattcctctaagtgccaatgtaaagtgccccctcctctatgtagtcctcctgaatgaccctccatgccacaggtgggagtggtcttttcctcccctgaactctctcatgctcttcccagctatctttcattgtagcaagatcttggtcaagctcatgcatagcttatctccacttctagactgggacatccttaagaacagaagctatgtcttactcaaccttggacgtgccccccccccttgcaatcacaccacagaaccgcatagtaggtgcttaataaatagttataaattattaacatcagtcaccttggagctctccaatttaaagaaacagttttttaaaaatatgtatagtaagtagacactgccccaatagttggtcccattggtaaatatagcttttcatgtgttgggtttgcttcaaatggaggtataaaaacacacagaaagaccaagacagaagctaaaacatagggaatgcaagcctggtaacctctacctgggagagaaatttgcccaactgggcaatgtgcaggcaaggctgatgtcaagggaagatgctggagaagagaaatgctactgaaagagcacgcaagtgcctttgcatctccaggtaagtgcttatttcaagaaagtgtaaagcagctatgtttcttgatttggatgttagttccatgggtgtgttcagttttgaatatgcatatactttgtggtgtgttcaagttttagtatcatattatatagttcaacttgaaaagtaaaaatatttgtgggatctaaaaaatcaaattagagtagaaagagagttaccagaggctgggaaggggagtggcggattggaggggaggcaggatggttaatggatacaaaaaaatagaaagaatgaataacacctactatctgataacataatagggtgactatagtcaataataacttaattgtatattttaaaataacttaaagaatgtaactggattgtttgtaactcaaaggataaatgcttgaggagatgaatattcactctccatgatgtgcttatttcacattgcatgcctgtatcaaaacatctcatgggctccataaatctacacacctactatgtaacccacaaattgttttaaataatttaaaagcttttttaaaataaatgactaaacaatatttctcacatggaaacttatcctcgatgtccaagtgaagttattgtgagaataggggttgtggtgcaaaaattcactctctagagaacacagctgttaccacctataaagaaagcgaggtctccactcacaaaggaaagcagcaggagtatgtgagatgtcgaaggagaacgtggaatgcctaagtaataaaacagacacagaaaactttccatccccacggtaagagaagctttggcagagtttgctcttcagcctcagaccaacagagctccagcatccaaatgctgaagaagccaagaatgtgcaaactatgctctctcagaataataagaagaagaatattcccttctcctctgggactcttcaaatgttttgaagtttctgacactctcaaaaacatgcagaaaccgcagcctgaatttagaaacctcagcatggtggtatgtgtggtatgagttccaaattctcgacagccctagaaacctgtttctagaggagaaatgaaaataccaggcacactgatgcagcttgtgggttgctttattgctttatttagggtggcagctcgggactgagggacctgggtctcattatctatcagctacctccccactcacattttctgcaattgacatcatgcacaatgagagccacctagctggtaagagaaggctctaaagactactcagagggttatgcgggagggaagaggaggaaataatatgagcccatccacttcctctaaacactggggtcgagggctgtcatggatcacctgcacggatatgatccccggcctccctcagcaccagcaggctaagccgctgtcactgcctgaccccctaacccagtcaatacccaaccatcaagatcacagtcctcaaatgagctcactttcagtaaggtaccgtgttcgatttttctttggacaattttatctggacgatatctaccatgacttaattttgtagccaatgtatacacattaaaataagatgaaaacaatactttctggacctcatgcagttctaattaatataattccatatggatttatggataccagttgtgttctagacactgttgtaagtccttggaatcaggcagtaagaatatgaaaaaagagaccaaaatgagaattatctccagaagagaaagcacatccagcctggaatatgtccttacaggttggaacccgttctcttccagatgccttgaggcttctttaactttactctttctcataaccacccagaaagtgcagggttggagactcaatggttgatcaatacatttattgaatgaaaatgacaggccctacaagtagtttctggaagccctgccaacattttcccaccctgggttctggtactgctcccaggctgtgtggcattgactagagtgcttcaacggcccactggccccacacagctggtgcctggggcccagggtggatccatgagtttgggcaactcctcctcattcctggagctcagtttcttcatgtgtaaaatgaaaggattgaagaagattgtctctaatttcccttccaagttctagcattctgtgatgccatgtgcaccccagttaagtgagaactgccctttgctattcatggaggcaaaagatgtcaccctcctcctcgttactaacatggccccatcttgtccaggttcccactccttctccacagtgtcttgcacctcagataaactgaccccattccctcaccagctggtgggtcctgtctagtttacatcagggcattcccattctattgacactgactgatttggagccaggcaagtggcctggttttggtcaatgagaaaaatgggagaagtatcgggggctttggagaaagattttctctatatataaagtcctcaccagaagagatggtccctgccttgactctggacattgccatgtccagatgtgatgtccagaaccactgcagctatcttgcggccatgagagaaatcagacttggtataaagctgtcactaaggacagtagggtgaagaaaagaaagggcccagggcctcatccacatcactgaaccactgatccatccatagtggagcctttcctcccccaactctgttctcttatgggagatacatttccttactgtctaagccaatttgagtcagtgttcttgatcattagtaatcaaaagcatctaactaatgtagtggacccccaatttggaaagaatgaaaatattctgaaacactcaacactaaaactactgtacacagttgaatctttctaatgtctgagaaaatgctctacaacactatctggatggaggttaccctttcaaataaatgcctgacatcctttctttctcaaaagccaatagcatccagatatttgcacttttcggttgcttggtttctagacaaatgttagtggcccgatcattcctacaagaaatggcactgacttgcccttctccatggagacgatgagcacagccatgaactcaattcaaagagcagcagaagagtcaaaagtggcaccttgaaactgaattctctgttgtgttgattttctgagctttcaaagtgttattcatttttttctacctgtgaatgaatccttgatttctcaatctgcctactcgctgagatagatttcagcaaaataacagtagacatgggtttccttctcctctctctctctctctcttccccctctccaacttcccatcctccctctccatatctccccctctctaattcaccaaggtaacaaaagaaacaataattaagtcaatgagcatgctcgcatgtgcaacaaaaaatacctctcttattacattgccatttccttttcaaatcctttgggggcattgtgtacaaatatagtaaacagcattagagggaaataatgccgacacatacttctgggagctcgtcatgtccctttaagacaaggcccactgttcagttccattctaggccacagctcgggtttcaagcccaaggtccccttactgcctcatgcagtattaatatggccctggcatactcccaaatttacattatgaaccataatctgggccagctcccacaggacgaactggcttggggctcccctcttcatttccccagagggccttctccccatccatagccaggccacccccttccccagggatcccccactttcagcctcagccaggggaacacacaagtgcttttcaacaagtagttaattccctagcatggagtatcatctgtgggggctgcttacacaatggcagaggaattgcgctgtcctgcaggcagtcacagggggagaggggaagaaggcactctcagacattagagccagagccaactcagggtcacttctgtggcaggcctgaaagcaccaccaggatgtccaggccaggaggtcccatgggcatacccagatctgctgaaggaggcctctctgtctcttctctgtgtctcttcctctctctctccccagttataaccagaaggcaggtgcaatttctagaagagcccataaaccatttccatttattaaaagagaaagaaagagagagagcgagagagaggtgaggctggtggggagtgaggaggaggcacaaggaaggagtgcagaggggaggcaaggcaaggaaagaacacagggtggagggtggctgagtgggccctggtgcagccctcatccccaggggctggctcgggctccatgctgtgcgcacagcctccaaccaccatcaggaggctacaggctccatccaggatgttgtctatgggactcctgtctctgaggcaccatggggtgtgttggggagagactgcactctggacagcctgtctgggttcaattcccagaccctctactcacaagctgtgtgaccttgggtatgatgcttaaccactctgtgcctgcatctcctcatctgaaaaccaggaccaagaagagtgcccaccacctggggttgcttgtgaggatggaaaacaggacctggcacaaggtgtctagcccatgcctcagagcttgcacccaacagagcaagtaacaaggtcaaggcaacaacagagggtggacctgaaacacatcctcaagaatccagcaatttcctcaataagttaaacacagcattaccataggatctagcaatcccattcctaggcatataccccaaatcaaacacaggcctggcacagtggttcatgcctgtaatcccagtactttgggaggccgaggcaggcagatcacctgaggtcaggagtttgagaccagcctggccaacatggtgaaaccctgtctctactaaaaatacaaaaaattagccgggtgtgatggcggatacctgtaatcccagcaactcgggaggctgaggcaggagaatcgcttgaaccaggaggcagaggttgcagtgagctgagattgtgtcactgcactccagcctgggtgacagagtgagagcccatctcaaaaaaaaaaaaaaagaaaagaaaagataccaacaaaagctcgtacacaagtgttcatagcagcactattcacaatagccaaaggcggaaacaacacagatgtccatcaactgatgtatgaataagaaaaatgtggtgtggccatgcacagaactaaaggaacggagtactgctgcatgccacaacacaggtgaacctcaagaacattatgctaagtggaagaagccggacacaaaaggccacatatcctatcattctactcataggaaatatccaaataggcctcaagaagcagcaagcagatcacaggttctcaggctggatggaggagagaacggcagtgactccccattggtccagggtttccatctgcagtgctggacggttctggaagtaagtagcacagatggttgaacagaattctggttgtatacttaaaatctcacaatggtcaattttatagtgtgtatattttaccataataataaaaaaaaagaattcagaaagggcacagcactcagactcttctcccctgagtcctctcacgtggtgaagagccaggcaaaagggttgagggcattgttgttatgcactaagttcccccactgtgttcctgccctcccctctttttccccctgcaccactctgcctgtggtttcccagctcacctctgggcctttcctgtgctattccctctgccaggagtgcagcccctgccaccccagcaccctcccacctcagccagcctagctcctctcagcccttcaaacccagctcagcccctgcctgctgtagaaggctttcccttgttaagatctcctcctcagggctcccacctcactccccggcacctaccctttgtcaaagcaccatgttctgtgcatgctagacagagctccccacctcagctgtaagcttcttccatgcaagggccagatctaatttactcttatacccttagagccgagcacagagaaattatataaataacaaatgagttaaaactacagactattatctagaagtcatgagataggaaagaaaaattagttatgaagaagggactctcaattcctagataacttaaccccattctcacccctgatcccagaacctctccagggaaaagaatgaggacaccccaagcagagagtgaccaggccaaccaagagcccccacgtgggcctttgtcaggaaagtcaggggctgaagaaccatgacatcctaatcccagtttggagtggacagcctggccttggattcagtctccgctactttcttcaagggagccaagtactaggctctccccacctcttacctcattcaaacctgcagaggtaaaagccaccttatagaggaggaaattgagactccgggaggtcaggcgcatgccccgacaacaaagctaataatgttcaacaccacaggcatctgaggccaaaacttgtgacttttaaattcgtttcctcttcctccagcagtgtctacatggttgcctcctcaatcttctaactaacacgagaaggccagagacacaggcaatgctaaaggacagatccttgtggtgctggactaacccaccgaatgcagctgggtcctgttccaaaaactcacttcaaacaatgatgctattgaccaggatagacagagggacaaggaaagagagatccttggggaaagacacaaaatgattcatctcagccactgtgctcaactacttgtgtggctttgagtaagtccaggtctctctggggctttttaatttttcccttttgtaaaaaaattgtctaagtctaacataaaatgcagtaaatcatctccaaagtctcttctagctcttaggttctaacactattacaactaacagcttccccagaaggatctagaaaaagtggccatcttgtccacattcacttagtgcaagtcacgcctagagcagacagcgttgcctgtgagggtgatgcagtgcacaaagctaagtcaccatcaccttttctctgggagcttcttataccaatgccccaaacattccttgtaccaggacagacacaaagagaaagatgcatttattctgctcccaccacatgttctataggagacctgtagtgtaggtctcagtagtactccaaattctgtcattctctcccatcttcctgatttctgccccgcctgcctgcctgcactaatattcagtgcatattatccttgaaatcaacttgaaattgtctcgattttttcaaattagcattgtcctgggcaataatatctgtgaaatcacgagctctgatgtactagttctatttttccacaagtgtattcaaatacacaactataataagaaattcgtctgtgtccctcctcaaagcatcttgcatcccaccagcattgaggtgtggcaaaacacagcagtagctcacttagtctccaccagcaaacctcttaggccaaacaaagctgtttcctaccattttagaaaaaccgagacttggggaagcaagcgttcaaggtgacgcagccagaaagcaccacgcggggcttcaaacttgggtgtgcctgattctaagtcccaagtctttgccgctcttgtaagcatccagcttgtctacagcagatgggggtgaatgaaagtcaagagattgtaaataatgccaatgacctttatcacctattctacttaatcctgtcctaagaacttgacagcaagattttccacgataatctgaaatgagagtaattcatctatgcataaacaaagctgacagccagcatactgaaatggacagaaggagagcactgtatgagtccagaccagttagctccctgggcaggtgcccctcacccacgccagcaaggtcaaggtttattcccactccaggcaacgctgggttcaagctgtcccagttcagaggctgtaccaccgaccctgccagcgctcctgcaaatgcacagcttagtcacaagggactccggctgtgcatgtgcgtgactcagcacacatccctcagccctccaaggaaaacaatgacaagagcacatgggatcagcagtgtcatccgtgaacacagaaacacccggcccttcatgcataaacccaccaaagaaaagggcttccaacctagcctggaaaattcaagaactggaagggctggtgctcaaagtcatctggtctgacccctcacaagacagcaaggaaaaaccagagccaagaaagaggcaacaagggacttgcccacgggcactcagctgtgtcagtccagggctaaaaggaagtgcccctacagcttcctgcagagtcagcagccccaggcacagtacttctctctgcccacgtggcactgaggaaattgccaattacagagctatgccctaaattcaggaatcaataaagtgtaagtggagagcccagttacccatatgaattcaacaacaacaaagaaaaatgaagaggaaaactacccagctcattatctctctgaagtgttttccagtaacaactcaatacgaatcagaaataatctcctacgagaagcagcaactggggggaaaatgcactgaactgtgcttggagaaagaaggggctggccatgcattccagcacgatgagaatccccccgtgtgtcacgcaatatgccaactgcaggaggatcccccaagcaggcgtgtgctaacacgtcatttgactccaacacgagatgactttgagttcccaatgatgtgcgcaaaagggacagattctccccgccagtacagtgggctctctggaccttctgaccaagccaggaagggaagaggttggcagcagatgagggactgaccagcgaatgaaaacacagcgatgccagatgcaaaggacactccttgggtgggaaggaggtagggttggtttattttttcccagactttttcactcatttaagcctggagaatacctccctccaaattttatccaagaaccagccaatggccaaaccccactcaaaagagaaaacatgaacactaaaatattccatgtactgaatatttttaaagcaaagttaggattttctaggtttgtttccatgggggaagagggtggtaattaaatgatttacagaagaattttacaacctcttcattttacagataaagcaagcaagacataaagaagcaaatggttttttcaaagtaaccctgatagtcaatagcagaaccaaaaccagaatgcaagtgaaaaaatccagatttgccaaaaccttcctattggctctatgagagactaacttctgagtccgggctatcctgatgatactgacagggtccccaaaagctatcatgcctctctgagtatgttctcttggcaacctgaaatcactctcttccttagctcctctaccatctgtaattaattattctataacttttattgaagactttctcccctgcaatagtagaagctctactattatgctgggaacataataaatgtttgaaaatatttgtagagtgaatgcatatgtatttctgacatatgaacactcgtgcattcaacaaaccagggctgaccatccagggcatgacagtgctttcatccctcagtgttgctaacatgcccagtgttgagacaccccaacaaggtcatactacacatgcaggggattcaacaaggtcagacacaaccagagccccaaggagcagagtctactgggcagactagccaacacacagaagcggctgcatgacacaggagaaagggcacccgtgaagctggagctccgggtctagtttcccttccctagtcaatgattacatgacttaggacaaatcatttaacttctctagaacttgtctgcttcatttgcaaacacaagccaaacaagaggaaggcaggcatcccgggaggaggaacagtaaatgttggaagtaaaagccctaaggatcctaatctccttgagtacagggaccagtctttcttcccgcatcccaccactcttccccagatttgtgtgccaggctctgcccctcccccacctccatcactgcccggcaagagtcaccaaactctgacagcattattcttccagccactgacctccaaatatccctctgataaaatcaaatcctaacaaaggaggatgaactccccctgcttaggctttgtgggagagaactgcctgttgctcattggtaactcagggcagaaatatcagaaggatgaactgtggggaggctataaatgtgtgactgttccttaccacctcatggccacctgtactgtctctatagagccaaagctctaaaaggtactcatttgtcttagctccatgcctgaatgttctactcctgattacagagggagaacccttccctctcttgctccatctatgccaaagctggcccactatgctgcttggtgctggcctctaggccagcagcccctgccaagggcacacttgagccaggcagccaggtaactccaggccaggcttccccctcagggcgttaccaggctcctccccagcttctccctagcctggcaaacatccagccctatgctcatcccagaaacctaaagataaaatcattaggaaaacttctagctcagagatgattattgctatgttatttataatagccaaacagcagaaacagcctaaatatcctacactagagaaattatggtgcagccataccaagtagaatgtagtcataaaaagggtttacataggagatgtttgttatagtaactgggaggcagaaggcagcatacaaaattggcagagggtacagtcagagctaaagaagttgaaataatttaaaaaattggtacaagcaggcttaaagaaaatgcatcaaacgataaccaactggtgtcctaggaagaaactagatacgaggtcctttctctatccacgtttatgtgtatttattatagcgaagcataaacattaccactgaaaagcatctcatttttcctgaaggaacctaatatactcaggaagatcagggatttgggcatcaaaagttctgggttcaaggtccaggtctatctatacaataggcacaaaaatacaggtagatggaaggaataagatctagtgttcagtagcacaacagaacgactacagttaataataatttactctacatttcaaaatagctaaaagaaaatatttgagatgttcccaaaacaaagaagtgacaaacgtttgatcaatgttctttctgtttccagcctacaatctatacctacaacccacagcctacaacccatacctaccatttacagctataacctacagcatataactacaaactaaaacctacaccctgtacctccaacttataccctgcaacctacaactgcaatctataccatatatacctacaacctataacccataatctacaacctatatctacaaccacacctacaaactacagggatgctataagggtcgtggagattcaccaagtgccaatctttacatgaatatgttatatgaaggtggcgcatgaattataatttcttaaattctacacacatgcacacactccagtagcaaccacacatcagttactaagcacatcttaattccagaaggacgctctaacatcccaaaatactccaaccagggctcaaaagtcaaaaggtcccaccattgactcctgttcatctaccccacatatctcaggactcatcagatttggtccaagaagtttattcccctccttccgaaaaatacggatggaagtagttataattcagttttttaaaagacagctattatcaaaaagtctgaaaataacaaatgctggcaaggaagtggagaacagggaacattcatacactgttggtgggaatgtaaattggtacagccactatggaaaacagtatgaaggttcctcaaaaaactaaaaatagaattaccatatgatccagcaattccactgctgggtatatacccaaaagaaaagcaatcacacagaagagatctcttcactcctgtatttattgcagcactcttcacaatagccaagatacggaatcaacctgagtgtccatcaatgaacaaatggataaagaaaatgtggtacatatacacaatgaaatgttattcagccatacaaaagaatggaattctgtcctttgcagtaacatggatggaacaggaggacattatgttaagtgaaataagccaggcacagaaagacaaatatgacatgtccttactcatgtggaagctaaaaaactatctcatggagcaagagagtagaatggtagttaccagaagctgggaagggtagtggggaggggatattaagagggattggttgataggtgcaaacatacaggtagatagaaggaatacgatctagtgttcagtagcacaacagggcaactgtagttaacaagaatttattctacatttcaaaatagctagaagagaatatgtgggatgctcccaatacaaagaaatgataaatgtttgaggtgatggtatcccaggtgcccagagttgatcattacacattgtgtgctcacagcaaactatcacaggggcctcataaatacataaaactattatgtatccataaaaattaagacaaagaaaggaaaatgcactggcatgtgtattttgcggaattatttggtttggcaactactctttgtctagagatggagtttagaattgtccctcaggtttgaggccacagttcctggcatctcggagcaggaggacgccagcatccttcttgttagaatcagacagcatgggctttcccagagcttacttcctgctgtggtctttcttcccagtgttgggagaattccctcacttcactgatcttcaatatcctcattagtgacagtaatgccaatatttttatcatttagaatgtgctagatacaaagctaagggcttcatacctacgaactcatctattctgtgcaacagccttactatgaaaataacattaggtacgttgactgcctcccccaggtagagatgaggaagtagaggcacaaagaggtgagtaacttactcaggttcccacagcttgtgggcaggatgttggggttggaattgggtactctgtctcccgcactctgatatgtctgtcagctggaagcaaaaaggcccacttcagaagtcattgactaaattttaaaagccaatgatctaaacaccatagtgcaccctcaattggtgtcatcactggtctcctccccagagctgccaacatccacacctttctctcaacagccatttgaacacagggagaacacatgattcaccacagccaatgactgggaaaaaccaaacacaaagctcaccgcatggagtgtgatgtcttgtgtcccattcatttcccagtgatttgcaggaccttgtatggtgtctgggaaaaatgtgtattgactttagttcatttccttcgtaggttcagcctcttattattttatgttcatatttattttccagagatagccctaaacacgggacatcaccagttccagtgaaatctccagggggagtacatagagccccaggacagacaggaactgtgtcacctaacccaacactcccaagacttctgaatgctcctagaaccaaactcctcttctgctccattgcttcccctccacccccctgctcctttaatttcagtgacaggaaatgccttccgtttggtccatcctatgtcatgcatcactgtgccaactcaggggacacattcttcagccacaagaacaccaccccagcagaaccacattgagcctacagtgcccacaccttgctccaaaagtcacatccttgcccccacccagggcccaccttccccaaaccatggacaaatgccagaaccaggcctgagaagggctctttcagagtccaagacacatgagcttccttggaaagcatcttccctatggaaattccccccatgactgcagaaaaattaaaatcactcagaattctctatttcttcttagagtttcagaattgacttgaagacacctaaaatcctaatctcaccaactctccatctcctcctctgcctctaaaggaagaaaaaaaaattttaaagaatggacctagcattgagaaacagagaacaatctattattgtgactataacaactcctaaggagccatcagagtctcggtggcaccgctggccccatcgtcacccaaatcatcacagtgggccgttcggactgcaacacgctgcctgctcctcccggcgcacattcttcctggctctccctcactgattttttggcagggctcagcaggaatggaatgggcttccacgcccgttatgatgatggatgggcaggctgctggtggagtggggcctttggggaggcactgtatacacacgcacatacacacacactcacatactctcacattcgtatactctacacgtactctcacacacactctcatattcacatactctacacacacactcacacacatccacatactctcacattcacatactctacacacactcacacacacccacatactctacattcacatacacactctacacatactctaaacacacacacatacactagacacactcatactcacacatactctcatattcacatactctacacactcacaaacacacatatactgtcacactcacatactctacactcacactgcatacatgtgctataccctacaccctacacatacccatacacactcacactcaaactcttggccagcagcacccaggtgaatccactgtggtctcgtgggccaggattctccccaagatccttggtcgctgaagcagccccaaacccgctttgtctgggtctcttccaactctagagctttcattgccatcattacccccagctggacttctgagtcaaccagatctgagttagaatcccagctccacagcttactagctgtgtggccttggcaaggtcacctctctgaacctcaatttcttcacgtgtgtcttggagaatgccagtactaaactcccaggctaatatggagtcctcaacagcccagctagatggtgagtcccatctatgatccatcaatggcaccccctcccccaccttggtccctctgccacagactccatggatctccttaaaacctaaggatatggagttaaaatctgacccaacagagggcctctatgaacctgttctcgtgccacaaaaggcatctaatcccattgctccctgcctgtgaagggctggttgtcaagactgattcaggggacagtgtgtgtggagtggttagcacagggctcagcatgaaggctctgcatagtaacagctgcctctgaggctaggaggctccgtacataggtcccccctcctgctgagcagtaacctgtctccttcatgtcaccacccacggtcctacatctacccaagaggctgaacacactccaatacaggctggttggtccgggaggaccctagggaagaagctggagactctgagacttacaccattcataaaccagctcccccaccctaggtaagagcatatgtctctgaggaacccacttttctcttttctgttccctcaagagcctgcaaggccattctcttatttgccattcccaacttcccaatgagctagcatgataggtactaacgttctgcattttaaagacaagcaagcacctaagtcaggttgcttgtccaagataatgcagagatggagatgggatcaaaacctatgagtcatctcccaacaacgtatccactaaaatacctgcaattctagttttacaggtaagagaatagacatgggtgggataagtgagtggcctggggatacccagataatggagcatggaggtgaggcagaattgagcttggggaccgaaactctatcctcttaaatggcagatttgggagacattccctcaagaatgaacccagctctggcagggcccctcatccccaggtgtccccaccaaattcctggcccctgctattttggaagtctatcagagatgggcaacacagacactgaggagccacgggtgaattcccagccctaattttctgttctgtgctcagtctgtgggccctgggcttgggtatcgccctctctctgcagagtgtgtgcaccacccaccaatgcaaatgctgttggccgctgggagaaagcaaagcaaaacttgctgccagcccagctctgcttcgtaatctgccctttgcattgctggggaagcagtgggaatacagttgcagctacctgatggtacatctaaaaaaataaccagctaaaggggcccacagactcccacctgtcctctcctacccaccactctgggagagcagcgaagagctgctgtttcttttttctcccaccccaaggaaatcaatatgttgtgcaaaaacaactccttccagcaaaactccactttacacctacctccatctggaccatcccttggagcatccccctaattcaccaataattcctcccagaatcatcatgattgatttcacagacctgggttgctgcctgtcctgctatgtcccagccaggtggagcagagcagtcacatccacactcagtccccaaaagctttggatccagggtcacagccaaagagacacatgcctagaactggcttgcagagcaataaggcaaagctggggtgttttaaaagggaagtccaggttggtatccatataaaggctaacagtgattgagcacctactgtgggctaagcactctgcagaacttacctcattgaataatcagtataacattttacaaatgagcaaactcctttgggaaaaactggcactgttcagactataatttgttcatataactttcacaatgttcatcttcttgataccatacttatggataaaaataatacttagtggctctttgggtaaaaatggtaatattaattgtagtgctggcagtagtaagactagcactagcaattggaatttattatgcattttaatgactgtcaggcattgtgctgaatattttgaatacattatttgagtaaaaatactgttatcactttcaatgttcccagaattatgaaaatgtatctcaaaaatttaagagtaatcactaggagaaggctgggcatggtggctcatgcctgtaatcccagcacttcgggaggccgaggtgggctgatcccctgaggtcaggagttggagaccagcctggtcaacagggcgaaaccccaactctactaaaaatacacaaaaaaaatagctgagtgtggtggtgcacgcctgtaatcccaactactcaggaggctgaggcaggagaatcgcttgaacccaggaggcagagatcgcagtgagccaagatcgcaccactgcactccagcttgggcaatagagcaagacttcctctcaaaaaaaaaaagagtaatcactaggagaacagaatatgatctacagcttatgaaccaacaaaatttaaaaaaagaagaaatatggaacaattcctttaatataagacaggaaagggggaaagaggagcaaagaaacccaaaataaaacagcagaaaaaactcacatattgtatcagtgagtatattaagtataaacgaattaaacgtacctattaaaagacagagattatcaaaccagatgaaaacattaaacaaaattcaattatttgatgattgtaagaaacatatagaaaagccttattaaaagattgacaataaaaagacaaaaaataatatgtcagaaaaactctacccacaagaaaactagtgtaacatgtaattaatatgatatgaaactaattttgttcctcaaaacaatgcaaggtagaattaaaatccctattttgcatgagactgtgaaatagagaagttaggttacttgttcaagctcacacaagcagcaggggcagaaaaaggacccacacttggatttctattactccaaagcccattcttgaaactacgtgactctattgttctaagtaacattaccttagaaactattcagtgtgtagaaagtacatgttccaaaatcaaggcttgagataggagtaaggaaaatggagaatggatcatgagtcactaaaaaaataagaaagaacaatctactggttctcagtcttggaagcacgctagatagaacacctagggaactcaaagaaaaggccagtgatttggccctaccctagaccaattaactccacatgcctaggggtgaggcccaggcatcaatattttaaaagcttccaaagtgattttaatgtgcagccagagttgagaacaacttatccattcactaactcaagggcaagtttgctaaaacatggagggtatctttaggtcattgtgacaaagagaaatgagaagatcctccaaccttatccctttgcaatggtttgaatatttgtgtccctccccaaaaatttatatgtagcaattttaacccttataagtgggattactgctctataaaagaggtcccagagagctgcctggtcccttccatcatgtgaggacacagaaggctccatgtatgaagcaggaagtgggctcttaccaaaaaccacaagcaccttgatcttggacttcccatcctccagaattgtgagaaataaatttctactgtttgcaaatcacccagtgcaaggcatttttattatatcaacccaaatggaccaagacaaaaggaagaattggcataaagagagacataagcccttcttctgcatagtgagaggatgccatgcctgagaatatgacagaatccctgtgctaacaccccctccctgtttcttaaagagaacacaatgaaccacagaatctcagcactggaaagaatcttaggggaaacttaaaatggatcccagacttggctgattgttagaacgccttggaagttttataaaaatataaatttctgtggccctcccctaagggaatctaattctatagctctgtgttgagcctaggaaattgtatttttttaaaagatacgcagggaggcttttggagaaagatggcagagtgtcccaatacataatcagacaaagcaaaacaaaaaaacaaaaaccaataagtgaaggagaaaagcaagcagcaatcaaacaaggaactggcacacactcatactatcaacatctaaaagacctggggtgagggtgggggcaggaacaggatttggcagaagttgtcaggttcctaaccccaccccatgcttcagaagtattattgctgaggccaaaatctttagacttctcactaattactatatatttgcagagaagcagactgtgagtgtgacatcatttcttcctcttttctgacttaatacggagagagttggggaaacagattgagaactattagaaaaagagctataaaacagcagcatgaacaatcaagactctctctctttctctctctctcattctctctctctttctctctctctcattctctctctctttctctcacagaaacacaggttccagggctcaacgcttaattgaggggatcatctaaatggcaaggacatcccctcctatatcccctcattagtggaatgagccctggaacagcacatttaacaaagtcatgcaagagttaaatgtggtcctacccaaaggagcacacagctctgagtctgaccaccctcatctcccatgttcccctataatgctcccaggcatcagaaagcatctcaaactggagctgacaccatggcagaggtttcaggtaagtcacaaaaggagtcctaaagaatttgccctcaatatcagagtgattagaagaagtggacagagctacccaagttaaacatatgcaagataaaaaaaatatggcacttgtgaacacacactacaggaggaaaataaggaacataatagcatattgtgctattatgatgatgaagaacctctctagaagaaaacataaccaaagaaacaaagaaaattcctgcaaatgtttaatgctatagaagaaattaacaaaaacatatattcaatgaattcagaaaagttagcaggtcaaagaaaacaaatcaaagaccaaaataatcccattttagattgtcgagtaaactagaacagaaagaatacaactggaaattgaattcctacgtaggggacatgcttgagactaaacaactcagggacttgttagatattatcagccttaacaatgtaaaaataagctataattaaaataagaaagggggtaggaggtaggaagaagcaggtgattgctaattttttcatcatttataacatgggctcaaaagtctaaaattgaaactaggtattaacagaaagcaatgactccatcttcttaaaatttttcataaccttgatgagctcttctaaaagatatccatttcaatgaagacatatttttccagaactcagaacttcctttagatgtacttgtttcctcttagaaatttaagccatgtacgttaatactctttgttaaaattgggatgtagagtgtgatcccattattctaaaattattcctgtcaatctgtgatctacatatctttccagctgtgtgtgtgtgtgtgtgtgtgtgtgtgtgtgtgtgtgtgatgatagagagattacgtgagttttcttaatgttcatgatggttatgtctaggaagtgagatttttgagtaatttttaaatttcttctctgaactttgatattttcaaaaacaattgttataattgtttaaaggaaaaaattcccaagtggttgagagggtcacagctaaacttgaagagcacggcatctagcccaggaatctgattcctgaatctccaaaaatcactcctgagaagaagccacacaccaagctgctgtcaaaatctccagtgatgatgaagcactcactatcctcatatgccccatcccactgcagggcaacttcaattttacaggaccacaaattttctttctactgctaccctatcttctagtaataatatccacctttcactgaatttccctaactgtgagctaagcgtattctttaaatcttcagagcaactctatgaaggtatgaggtttcactatagttttgcccgtcttcctgttgaagagactgaagcccagagaagtaaattttcctgaggtcccccagctagtagtttgcagagctgggcttcagcttttcattgtggttgaatacaaagcctgtgtttttaaccaaaattctttgctagaaagtattgcatcatattgaccccaaatccacttttctataacttctaaccaatggcactgactctgctccctggggacacagcaaaaagtctaatccccttccataagcattgtcttccaacataggaagacaaaaatcatgtgaccctcatctaccccatcttcttcctccccaagtgatccttctgcaggtgcaaaatgtaccgagaagagagcatattttttctgacccacgatgaagtcactgaatgattagtttaaatggaatcatgaagtttctaatatgtacttaactatatgctatcatttaagttctgctttgaaggagttcctaatagttgggttcctccggaaaatctcctaagagggtttcatcccacagacaactcccaactccctgggttaactggaggggtgcagtggtgtggataaagtaatttatgtctgacacggaaatgtattatatgcatttttcaatttatcttcctaattaaattttttcatagactcatatttaaatgagtttccactcccctaacacatgaggactgacagtgagtggagggaaaataggataaaaatgttaagtagattttccaccaagtgtgaatcctccacacacgaatcactgagggaatcgctggcactctgtgggctgggtggaggggttttctttggtttataaactccccagaacctgattttcacatgcagacatgagagcctgtccagccagcagagtatatactgtccagcatctcctgtgccaggagccacaaggcagtggggcatggaggtgccccccgggccctgcctggaacatattctcccaggactttgagcttcctggcagggtcatgttccaggagccccgatttcagggaaatattctgctcccttggtttcacacagagggtagcaagcctccaccaaaatgcacacctgtgttggcagcgaggctgtggactgtggcctggaaaacatggcctcacgcctgggaaagcatgcctcagcgtaggaacagagacccaatatagctcagctcggactgagtcaggcactgaccccactaccctgtccctaaatcccccctgcagtgtccttgatgtcacctccctgatgtcctgaaatccaagccccccagccccctggggcacaggcacggctcttcactccctccctatggccattccccagttaccatctgaactcacttattccaggcccaggcctggctgtcccttggagggaaggagagacacccaacaccacagcccagaaggaacctccacagggagtcagtcaaaagccagacactaaaattacattttctcactcccttctcatttggaggaaagtctgtgtggggctggctgtgatcacacactttcatcacacactttctgcataagtgagagaactgtctcaactgcctcctcctcttcctcctcatcctcctcctattccctctccctcctccactgaattcccagctcactgcctcccactagttcacagtgtgctagggccctccagccccaccgagaagccacaggaagctctgatccacccccacagggaaaaagggatcagaaccaccacccagcacagatataggggccttgtgtaggggaccagccagggagcccctccatcttgaagaatctaagtcacgaggacaagcacaggagcaaagcaggcagcctgagctatccatgtcccaggccactgccggcctgttctgaaaaatttcacacaaggttatccccaatattcccagacatgtgtcccttccccggtgctgcatggcccccacactggctgagtatctccagtgggagaggaaaggacagaccgactcttaggaatgcctgctcactccgtggtagcatgtccccttcaggcctcctttcccatctttgaaagtgaatcctgggtggctccctgtcaggggagcacacagataacccagccccaaagatggcggggcagacctgggcattagcaactggagttctgttttcccttctaggctacctactatgtgtcgggctctgtgcttggtgctttgtaaacccactctcattccatcacccagcaacagtgagacccaaagctcagagaagtcaaagactttgcctgaggatcttacctacaattaatggcacatggtcaagacacaaatctcattccagaaaccaagatctttctaccacaccaaatgtttccctaaagagagcccataactccacacaggaacccagcccagcctggataacccatcagaacagaggaagaaaactcctctgtcaaaatgaaagatgctaatagcaagggtgtttactaggagtgttcaaatttccattaaaaccttcctgtgcaaagatgagctacgaaaatttccttcttggaagcttgtacctcctggaatccagacatctactttcaagctgctgaaggctcccactgcctccccacagggctgcaatcccgaccatggattattaaggagtccacaggcttggctcaatgaacagaacggctccgttatatttcaacctacccactaagacttaaatatcacaccctagttcagacagccctcgcctttcatttttcttggctttaggaagacagggagggagggcatacagagccaagaacccaagtgtctgagcttttacagtaacccaaactcacccaagacaggctgcccaaccgggcccacctctgtgtggcttctccagatcaacagaaatttggggtgaaagcctgcttttctccatgcagtaaggcatctgcatgaaaggcacatgtttccaggaccttccaagctctttcttgagtaaatattctcttaaaaaggttttgaagcagaggctaaggagaggagtcaacatggaattttatttctcttggattatctgactcaagcagcacccaagactagcaagaccaaagatgggctgacccaaagataaccatttacaacaggagtcagcaaaccaacagcctaagggcccaatccagcccgatgcctatttttataaataaagttttattggcacacagccatgctcatctgttctggggtgtctgtggctgatttcatgctacaaaggcatagttgagtggctgcaacagcatggcccagaaaagcctaaaatctctattatctggccttttacaaattaaaaaaaaaaaattgccaacccttgatttagaaaaactttcagatgtagttaggcctatttcttgagcctttttaagagcaaataatatctctggaatatatttggtatagtcttatatggagggaaaaggatgaaaaaaaatggcccctgagtttccttccaaatccacaggaagccaaaaaaggaatgaggtgcctggtacaaatgcctcaggtgacagacatcctatttacagaaaggcaatctgtgcaccacctcagggaggccaaaccaacatgcctggtgcaatcatgcagccttaccctgcaaccacgcccaacacttggaagcctaacgtggacaacgcctggtgcaagagggcatgtggtcagatgttccacccccacttagctcaggggcagacagaaggcttctccaaagctgtcccttggcaggatttcatgtagcagatgccactagtctacagtctctacagcctctgactcccagcatgtacacatgtaggtgtgcacagaggcccagagaagcagggtcaatggaatccatgaagctgacctggtggcagctcagggtttattccctgcttccaacctaccagcaggcacaactcttgatagatctaacagcacactggggatggagcactgcatcaggactgaggagactcagggtcttgccccagctctgtggctaactcctgatgcaaccttagaagagtcatatcatgtctctgggactcactttcttcttctgtcaaatggattaatactacccactccatctaactcacagagctcagtcatgcaacaagtaattattgggcatctactatgagtcagacattatgctaagcacttgggatatagtggcaatcaagatggacaaattccctgccttgtggagcttacactctggggttggtatggaaactaataagggatgcatagatgaatactttgaaaaatcatgatgtgcttcacttgagtcgtggatggtgatgctatcttcccactctgggccattcatggactagactcacacactgagcagacctgctgggaacacatcactgataaaagtcattcattgggaactattctaaatgccttgtatgtattaacctcaccatcacagagagtcctcaacactgaagtaggaactctaaatatgcatactccacaaacaaggaagctgaggcctggagcactggagctaaaaaggaaatatgtgtcctgtcccttatgatatctcccatactggctggagatgttgaatttactatattaaattcttctccattatcttgaggagtaaggccaggacccttcagatggagaggaagtctctctccctagatggggaagggaagttctccttccctagttcaatcatcacagaaaaggaaagcatctaacaggaaagtagcacccagaagagaggccttaaactccttggaagaggtgatcctcctatctgcctctttgggctgaactctcctagcaggggatttttagaagggtggataaccagttgtgggctgcagtgagaagagcgaacccagcccatgaagaaggccaaaaaaatgaggactctggcagggtctgtgagctaagatgagctatgccctacagggcagttatctagctctgtcagcctccattcatttccttttttctgtctccacattttcagtaacgtcctgtctaaacatcccaccagactctcaacgcaacatagacaattagcgaaaggttagaaagtcatgcacccaagcttggcccaccacagttagaggaaaatggcaccaccttaaaactagtatgtaggtgttcgtactaaatacgtgagaaattctcccaaaggaaggtgaagctggagagagtcagggtcatccaactactttttgccctctcagagcattttcctccttgccaatgctggacaatgaaagcactagtttattcagggaaatcacagtttcctttttagaagagcaggatgctaagaagggagcaagaataagttgaaaacaaatggagtaagattcagcattgtgcacgcacccccagcccagccacccaagagattctcccaagccaggcagtgatgctcacatctggtccttcaccaccaggaccaagtcagagcaaaggagaaaagaagagaaggaagagacaggagcgcactggatgggagagtgaagggttggagaagagagggatcccagcctactcccaagcccagtgggatcatcttcccctaggaactcccatctgatattggctctggttggggctgcctctctcccagcacctgctgggtagacttccccatgtttggtcctgggaggtgctgtagcagctggagctgtcctctttctgccgctggaagcaactggaagtcccaggggccctggcgctccctctgggatttcaccctattctttcctgtctcgctttctcttttatctcctggattaacttactgttgtgccatctacccagttgtcagtgtgcctgtctcagctttgtgatctcacgtagatccacagaacctaagagctggaacgggccctgaaaacattctggagcaggcgtctcggcagactcaggcatgcctctccccagggaaccaggccgcgtctgggcagaagcaaggcttgggggagtggcaaggattgtgtgtactccctcgaagcacatcttcagaagtggagcattttcaaggtaggatgttgacataattgttaggtccatgaaggcagatgctagaagcagtgtgaaaataagactctgaggttgtccaggtggggggctatttttatacatttccccccacaacccaagcagtacatgggccctagccctcaagcttcacctcccagatgtaagactccaaccaagattttggagtcaggggcatacaaagcccactcaggggacacactcatagagtattcaactgattcagagatgtgggaagaacgctattcctatttatttttttgtagaaacagggtcttgctatgttgcccaggttgctctcaaactcctaggctcaagtgatcctcccacctcatcctcccgagtagctggaactacaggaacacgccaccacacccagctaccactatttttatattaaataaaacatgtatcatggagtgacaggaaaaacctatgcaagtttaagtaaatattgtacttaaagtgggtgactttaaattatgctcttatatgtacaggggaaggacagaggaagggctcatttaccttcattcttctctctccctagagaattctgtgtatccaattttaaaaattcatcatatgtcacagacagaggcacagaccccctgagccatggtgggaagatacttctggacaaatgtatacccagcaaaaatctcaaaagctccaactttctaatggcttcattttactgatgagaaaactcagacctatagaaagaagagcagaaacagactggatcccaaatccctgtgccccacagttgatgctctttccacctccaatctgaggcactgctctccatgtggccaggaaccgtttccaactaaactggtcctgcctagggcctggaaaaacacactgttaatatgcagccttaattaaatatttctgatgagcacaatgatgcttcaaaattctagctaggattcgactgatgctgcagcctggagccatcaaggaagagcctctttcccctaagcatggtgtgtgtggagcttgctgggaagactgagaccttccaatccaacctggccagcacatctattcaagccatcaaccagaggacagatgtagaagtcaccttctccttccagggaccactcttggaagcagatttccacaaaggggaccgtacagttctaagcttacagatggttagaacagaccagccccactggaaggccagaagtgacgaggatgaggtcaaatgtcagtgacagagaggctcagacctctctgagccatggtgggaaaaatctctctgacccatggtgggaaaaatctccctgaactaatctgcaatttccaggcatttctgaccagtaaggaaaggatttggttgcagaaggctgggaagctagattgtagaccaagagatggagaaaactcttcaaggggagagcccagccactacaaaggggcccagcatgaggtgtgctggaggtaccctgagggccgtggctgcctgactgacttatcctctactttgggaaaaggcaactcagtgcctggattaaaccattagctctggaggatgcctgtctggtttgaatcttaatttctccatttcccagctgtgtgacctcgataagattacttcatcctctgggtctgcttcctcatatgaaaacaggaacaagaagtgcataaacacatttcagggatgtagggaagactaaaagggttaatatagggcaagcacttagcacagtgcccagcatagagcagtactgtctaggctgtagctaccacacatacccagtgaaggcactcaactaccaggtggacaagcaactgatacatgtgtgtgctgctctctgctcccctttggacatttggaatttcaagtactgggacttaataccacagagggcagagttttgtttttcctgcctttgacatgatgtttatgatcttcttttcttgtgaacaccccagacctagggaccagcggtggcctggcttcctgatgcagcccatgaacacatttaagaatccaaaaaggttagccaggcgcagtggctcacgcctgtaatctcagcactttgggaggctgaggcaggccgatcacttgaggccaggagttgaagaccagcctggccaacatggtgaaaccctgtctccactaaaaatacaaaaattagccaggcatggtggtgcacacctgtagtcccagctactggggaggctggggcatgagaatcgcttgaacccaggaggtggaggttgcagtgagctgagattgcaccactgtaccccagagcaagaccctgtctcaaaaaaacaaaaaacaaaacaaaacaaaaaaacgccgggtggcggggtggggaggcggggagaaagctgcctctgcattgcaacttcccaaacagcacagacattaacattttagtgatgaaataacaaagctgatattctcagtatcattcctttattgagtgaaatcagaaatataactttttcttcttttttttcccccgtgggactccataaaactatttttgttgtaaatgttttaaaaggcagcctgtcaatatttcaaatgttcctgaattggagctcatggataaatgactcttcccccattggccaagtctcctctcctgctgcagcaaggaaaggggcacttgggagctgagaaggcaggaaccaggcgccgttgacactcctctagtgagatgaatgttccctccactgggtcagcagtgagcaccagcccaagaagtgccctcgcctccctcctgctgggcagtcaccaggcaaccctgcaggcagtgcaccaagctgttcctccataatgcacacccagtcagggcctgggcacctctagttactcagcagtgagcccacctgctatgtctcaggggcatcccacacccagaaagctgcttctacttcaagcctactcccaggggatgccccatcagggactagagggtcctgctgaacccaccccaggttcaaggtcagcagcaggctgtttcaccaggaaggccaggagctatgctcaaggtaaccaaaaggacagaaggccccacccaagtgtcatcttgcccctcctcccagcttccccattggctagtaaatgagtaaacagacatggttctaaaacctagaagagcatcagaactccctgtggatctgggttcaataacacagatttgatattccactcctggatattccagttttgtaggtcttgagcagggatcgactttttttttttttaaggttccaacagatgatactgtggctacgatgggcagctcagatgtaggccactggcaacacagagtggaaggagaagcccacagggttcctcactgggcgacacaagctcttcaaagcaagctgagtaaatctcttggtaacaagccaagccggactgcccacagctatgggcaggtctgctgtgtctttcgcctgctgaaagcccaggttgcagcacagggaacagcagagacaggatcaaaggctctctgaggacagtctgtggcaacaaagtagcagctcctctctgatgaggtaaggaagagtccaaagaaattacttttgggctgggtgtggtggctcacacctataatcccagcactttgggagaacaaggcaggcagctcacttgaggtcaggagttttaagaccagcctggccaacatggtaaaacctcctctctactaaaatacaaaaattagctgagcgtgctagtgtgcacctataatcccagctactcaggaggctaaggcaggagaatcacttgaacctgggacgcagaggttgcagtgagccgagattgcaccactgcactccagtctgggtgacaagagtaatactccatctcaaaaaaaaaaaaaaaaaaaaagaaagaaagaaaagaaaagaaagaaagagaaagagaaaacacttttgaaatttggaaatgaggaagactaaggaagagtccaaaagaaactttgcctctgcccaaggagcccacaaactttccaaggccttcctgttcctggaaacggtgccatctccaaagactcctccgcacatggaagagcctgatctctcgggcacagtcaaccattacggcccattttctcaaactaggccctcctgggggtcttagggaaagggggcaacattacacaaggcaggtgaaggggatagccaatcacagaggggtgcaggttggcattgacctcttcctaacttttctcataatatgaaagtgacttctcttctcagaagaaccgttcataatgaaattcgagctgcctcaatcttccttgatcatctcttcactcttaccacatacacacacgcacgcacaccacaggaaaacgcatcagatgaagaacttccccagtccagtgcagatttaagaaagaggacactgacatagggaggtgggctggggagctggggagggggcagacaaacaagggcatgtgactgatacacttcagggcgggagtcagacggccccctcacaggccagggtgacatgtgacaaagtcacaaggccctgtggtatttcttgaaacttgatttcagcccaagtcaaactccatggatcaagggtcatttctggctattataggatgagagtatccaggactgaagacctcatggggcagaaagaaaaaaaacagaaaggtagctcttggagaaataacctaaagattagaatcaaggaagagccaacctctcttctaacagggaaaaaaaatttactaaaatgacacttcagcatcacctattttttcaagcttgtctttctgaacagaacttgaaaacacagttgtaaaactgttttactagttcagccgacttagaaaaacaaaaagagcttctcacagctttaaacagagtcctgtgctgaagtgttccaacactccagccccactctggggttaagaatgacagatgatgcaatgtaaaaacatcattttccactggacacagagaacatggtacaatactttggaggttaaacagatgagaagggaacagtacagagacccaaacttagctcctccatgcctctagcacacacatatgcctcatggaaggcatctggagaggttagtgctagagaggccagaaatcttgtttctggttctgtgctggaattaactaggtaaaccctggatgaactgttacatctttgatcgtcactacctgagaattaacttagacaaacattgacactctataaagcagcaattgcaaaatgtgggttttcaaaagcactctgagttcttttcaaagaggatggcataagaatcgacacagctgacatatggtgtggacagagagaaatagcttgggcttggatttccggtcagttcccctttctgccagttaccatcagaggaaccatgggcaaattacccaatctctctgagcctgtgtcttcacctttaaaaatggtattatagttctcaaagtaattgcgaggaattaaaagtcaattcagggtcaggcgcggtggctcatgctgtaatcccagcactttgggaggccgaggcaggtggatcatttgagtttaggagttcgagaccagcctggccaacatggtgaaaccccatctctgctgaaaatacaaaaactagccaggcatagtagcatgtgcctgtaatcctagttactcgggaggctgaggcaggagaattgcttgagcctggtaggcagaggttgtggtaagccgagatcacaccactgcactccagcctggacaacagagtgggactatctcaaaaaaaaaaaaaaaaaaaaaaaagggaattctatgccctgtaaagtgcagtctatggaagtgatgatgatgaagaccaggatacagtacaataaggactctttatgctttcaaaaccgtgattatgctgcatctggtggaagccaggactctggaaatatggcccagacacacccagaactgaggatcaagatgagcgtggatccctgggtcatgagcatcccaaccaagtgcctgatgcccaactccagggaaccatcttccctccgcacacaatagtcattccatggtggtgcacacctgtgagtcaaaaacaccctaagaaaatgtaatccttggggcatttcctcagctccagcctccggcccatcaatcacaagcacaatcaaactgcaatgcctcaaaccaatctcctaggacccctgccagggcagagactgaaagtcactgaggcaatagagcatgtattatattgatgatcctctagctgcaagacctgattggtttgagactcccttggataatgctggcaattaattttggcaaaagagcaaaagatagatgtgacatccattgaacacagagctgcacaggagtcaggtttctggaaggtaggaagaatgcaaggaaattaactccagagtggtttgcagggaatgggggctccaggctcattatttcaatcttgaaagctgtcaatcactgtcaaaaggcagtttaatctcaccctgaagctttcaagaacactatgaatccaggcctacaattagcagtccaatgttgggctgatgagttatgggcattttccatctgggagggcacaagcttctcctatccagggcgtgccctgggcataaaggatgtgtggacaaatacaaacactccaccagccagaggtgacagaaataggcctataatatttgcccaactgggtttatgagacaagcatgtagttcaacactgtttatacagttcatgagagaatcttgggcagtgacagagaatgtaactctcatcctccttagggcttccagaaatgaacagaggatatatatatttttttaaaaagtggatcctccacattttctaaagtttttaagctctctggggcaggttaagaaattcagactgcccaggaagtgattttttttttttttttttttgcatggaatttcgttcttgtcacccaggctagagtggaatgcaatggcatgatctcagctcaatgcaacctccgcctcctgggttcaagcaattctgcctcagcctccctagtagccaggattacaggtgcccgccaccatacctggctaatttttgtatttttagtagagacagggtttcaccatgttagccaggctagtcttgaactcctgacctcaggtgatctgccggcctcgggctcccctctttacaccattctctaagcaaataagctaacatcccagaatggaattatagaaagattgcaccagtcaaaaaaggcatttggtatacatattctaagaaatgctacataataacaatatgaattaataataaattaccttctttcaccttgaactgaaggatttgcaaattttctcaagttctctttcatttgaccttcacaacaaacctgtgacatttcttaccccctatgaatggttaaggaaaagactcagaaagtgggttcttgcttcttcagatcccagatgactcctgaaatattcataattctgatcttaaaaaaaatataacacagatggtaggacatgcctcgtgaatcaggtaataccctggcagcatctcccttagagcgtagaattccacaggcagggatgtgccaaacacctctgcacgccaagctgggtgtagcaactccatcaaatccattggatcacgatgatcctggtacagggagaggggacaatggaacaaccaaggccctggaagacagcaactgaaaattttgacctgtggttcaccagcttgaatccagcactgggatgtcgggggtggggtgttccagggaaaaagaccacagcttctggatggttccaagaagataggttccctcattaaaactggtatcaaccaaccctcttgtacacagacccctgtggtgggtgtcaaggggaaagaaacagatgggcccaggatagataacacagatgcccagtccctgcccccaagaaagctgcccctgccagttgagaacactgctgcatctcatctgaagagaagcctacacagcagtcctggaattccaaatcaggtggaagaaggcagatggcgcaaaataaactcaagaaacagacaatgggaagtaagcatcaagccaggtaccttgacacagtacctctggcatggtccccaacagctggcctgttggcctccccaaacaatgcctctttctaatgagtctttctttaaagtggtcaccgactatacaccttagtgtagagctgctggtacaacttcctgtaacatagcagttgcagtgaagctccagggctacgctgggagtatgagtgactggctcagccccagaaggcaagtcactctccgtgtcctggtcagcccagcccctgtcactgggcaacatgtggttgtgttcagacatctcccacctgtccataaaaggtgaggtctaatggtggcctctttgggacaaccttagggcaatggggcatacgtccaggactgaggctgagaagcacacactggtgcatccctaccagggtgaaaatattgaaatcctttttacatggtggtaagtagcagcttccctgaattcctgcatgcctactaccaccacccagcctctacaatgggactccatgcctccccatgatccagcgactgaagggttggacctggcacagtcgacacttctctaggactctgtcggtgcccaggcagctgtgtaattgtgaaatgctttgaatatcctccccacacgggcccagtcaatggtgctgcaccttaacccaaacacctcactagtagaaaggctaaggaactcaccttcctaagaacctgttgaggccacaccaccagctgtcctccactgggcaagaaggtgtcacccccagctctcctctctagctagggatcctccattcctgctgagagggacaatcctggaaaaagaactatagcccttcaggtattgtatccatacctctgagtctatgtgtgtttttgagaggaaaaaaaaatgcttctggtttcacctttagaactaaaaatctggttgatctaatatgctagacatttcagcaatctctggcccaacacagagtagggtgccactgttctctatattcctggcccagctgaatcacagcatcatagcatttaagcaccctcaactatattcagcccgatatgtttaaaactgcaggttatggccaggcatggtggctcacacctataatcccagcactttgggaggctgaagcaggtggatcacgaggtcaggagtttaagatcagcctgaccaacatggtgaaaccctgtctctactaaaaatacaaaaaaaaaaaatcagccaggcgtggtggcgggtgcctgtaatctcagctactcaggaggctgaggcaggagaattacttgaaccctggaggtggaggctgcagtgagccaagatcgcgctactgcactccagcctgggtgacagtgcgagactctgtcaacaaaaacaaaacaaaataaaacaaaaaccctgcaggttatgacccatcagcaggtcacagaatcaactgaatcattcacaatcagcatttttcaactgaaacaacagcacagaaaacagagtactgcatattaaaagggttgctgcatggaacttttgtttaattacatacatgaacataagtattgggttgagaaagaaaaggtatttcttattctgggtttcaggggaaaaagcttttgaaagcccctgatctagctaactccactctatcattgatgaggaaactgaggctcagagaacagcatggtcaaggccactcagagaatgtgcagccaggtgaggtggttctcagtccatgcagcctgcggactttgcttttcttctaagcagctctggctctggccatgggcattgggattctgggatgctaagtagctggctcctcagttcctaagagctgtgctcaagtggtctctagtgccattgagattttccccagcagagtaacccttagcactagatctcctgaggctgaccaggaggccctgagaagagatgccagccaagcaccccatcccccattcccacagcctggtagtgggtttgggcccagcctctacatctcattctctctttataaagtctcaagcaaactgtgtggctgggactttataataaacttggagccttcttcaagctgaggctccagcaaacaactagatctttctgagcagatgcttctgctctttaggcaggcttcctgtctctacaggtggtctagccctgggactactggaaaaatgagggagtgagggtgtgctttgtgagaggctgggacaggggaacggctcctcctgacaatgtatggaaacacttttttttttcaattaaaaatagcatagatcacagatgagaaactaactagaactatataaaaatacaactttttttttttccaatgggacctgcttagatagaagctaacattccctgaaaactatttgtcaagcattgtgctatgggcttcacacacattatctccctggatggtatagtagttatctcacttgatataaaataaagttcagtgataccagtgaatgtattaatgacatacacagagctatcacttctacagtgcttattctattctaagaattttgtgtgttatttgatctcatcatcagcttgatacagttggtgctattctcatccccactttgcggattatgaattgaggtaagaaaggctacctgacatgcccacactcacatagatactaagtggtggggccagggtttgaacccagatggtccaagctttggaccctcctaattacctccactacactggttatgattccttccactttctggcgcagaagcagagactcgggaaagttaaatcatttgtgtccactccacccagaagctctccacgtacaccagagggatggaaaacatttaacaatgggtaaggcaggtccatgaccttcacaaggggcaccattggctaggctggagacctcctgctatgctggaaactgagccattttaggggctgcttcaaggggaaacccagagggtttcagagaagggataaggtaacagggacactcacagcacttagggcaatgtctattttaatcagcagggaagttttccaatatgttatcaattttggccactgcaaacagccaagataagacagtgctaaagctcttagtcgaaactgaatttttgcatgtttcggggctggaaagaactcttgagccatatagaattcaacagcctcattttaccaatgaggaaaccaaggctgctatgcaaagcatggtgcccaaggtcagagaactagtaaatgacagagtcaaaatgaaaatccagggtgcccagatgcccagattggtacttagggtgtttggtggtggtggtttgtttcttccctatctgtgctgattatattcaatacacagatgctgatgtgcatgcacggggcccagcccccagctgctgtgccacaccctgacaacctcaggatcttcagagaggctcagctgctcaaagttccaccagggaccatacaagcttcatggatattcagattttttttagtaagcacctgaattttgtgtaactgatttccacacccattgaaggcggcttctaaatttagaattaacatccaaagcggtctgttgcacaaatgtatacttcctcgcaagctgttgtcagaaacagtaaaactgacatccataaaacagtttcttcataccttaataatattgaactataaaaatagaggatctcaagcaaacaaagctgtaaccataataacctttacaaagtctactaccacagtcaagtactgtccagatctttttttaatgaaaatgtaaaggtggccccagccttattctcacatgacaatgcaattccctaggcccagcattccctctagacacttgtcactgcccaatccagaactttagtaattgatcatttggggtaataacctgcaccttatacaataaagccacctttgcagaaactgcagcttcactttcatcacttcctcctttgcctattccaattagttgcttagattcagttagacacgtctccccataccaagcacattcagttgtgccaggaggatggaagaagtctttctttcaagacatcttaacaaagtagacattgcaacgcaataaagtagtgagactcatggttgatgcttacacacaatcttccaacagaatgctttatcatcccttgcccagaacagatggggaaaaaattacgctatgccctgaaattttccattcttgatctcagcccaaaggtgacttttttatttttaaacttgagacttgagcaaaaaaaaaaaagttcaactatttttgattcatgcccaggctaaagaaacacatggtaagattctttttttttccaaacccgtaggtagctcaaacagctaagcttcaaaagctcaagctttccaactagcactaatagtgttcacagaggcagcacctctgcagtaattgcaaggccaaaaatcaatagccggggtgagaaggagctgggattccactttctggacacattgtccccagtacctctaaatacttaaaagaaccgcatagaattctcaaatgtttaagcaggatggttgggcctgaagcttttcctcccttctgggtgataaggcaacccgtcctcatcaccattttttcattacccatcctttgatgcatttcagtcctctcgagagtccaggctacccagagagaactgacaggtctcctgactgccctctgtccccagaacttgctctcttctaccccgtccctcccagccctagccccaacactgactcctctactccttctaccctccctccatcctgctattcccagtctccatagaggaaaaagggagtgtcatgcctagatgaaaagatttggggttcaagtcaccccatgtacctccctggttccaacgaacctccggaattctagccacagatccccctcttgccctctcatcctcccctaacacatccctacacattgcaggcccaggggggagtccacaaaatgggactccatgcatccatccttctgtggggccgcgtagcacacccacggcaagactccagtccctggtcccggctctgccacttatgaactgtgtgcccataagcaagtcgtctcttgctctgcagactggggcttatcacatttgtcccacctgtcccagagagctgttatgcaaagtaaggggaatcacagatgtgaacaggcttcagaatcagagctcaatataaatgtacctccttattattaggcacatggcacagtgccaggcagtgtggtatgttccttggggctaaagtccaagagatattggcaataaaagaaagtgaattataccgggcagaaaacaaggaacaaaaagagaagaacagagatgaggattcaccagcctccagagaagagtgaattcacagtgacagtgcaatcaataaaggcttcctgcaagaggaaggctttgtatgcagcctgaagtggctctcaccacgctgatcaaaggtgatttcatggccaggcatggtggctcatgcctgtaacacgagcactttgggaggccgaggcggacagatcacttgaggtcaggagttcaagaccagcctgggcaatatggtgaaaccccatctctactaaaaatacaaaaattagccaggtattttttttacaggtggcacatgcctgtaatcccaactactctggaggctgagacagaagaatcacttgaacctgggaggcaaagattgaagtgaaccaagatcacaccactgtactccagcctgggcaacagagcaagactctgtctcaaaaataaatttaaatttaaatgtaaaaaaggtgatttcatgcatgccccttcccaagaccaagcgctctttgagggcaggtgacatgtctttatgtctcagccttcgcagcttcctcctggcatctaggtgaaagaaagaatgaatggagccttgaactaaccaggaactcaactaagtggaaaagaggagagactcccagatagcagagggaagacaagctggggtcagagggcggactctttggcttaggagtagaggagttcagaagttcaggcttctgatcacaaagggaggtaaaaggagttcagaggagtcagtgacatcatgaaatcagtatttggggagcttaattgggcagctgcatgcaggatatgcagcagggggtgaaggaaagctggcagagtggccaggaggcaagggcaatgagtcaggcagacggtgagaagggaagccactgcctctcggccaaatcgccctctgggagcacccatctctgtcccagtggaagccccatcaagggccactctcagtgactgtcctctttaggctggaccttaagtgtcccctagtcctcctgccttgcacccagcactggcctcctgcaagtggttaccttccccttgtgaatccctccaggctcagggattccagggattccagggattccctcccattcccgttttagaggacaacgcggatggtaagcactcccttaaaggaagcacagtgatgcagcagcgggcggggaaacagggagagagcttttacttctgagcacattttcccaaattgctatcttttcaacacttttataaggtagtatgttaatatgacagttaagatgatgataaaaagaaggtagaggaaaaaaatgtggaagacaggaccagtgcattcaacacacagctcagacatgattgagaaacagatcctggtgctgaagagctggggacaggagcctggtgatgggcagcctcggttccagggcaggccctgccaccaacgcactgtgtgaccttaagcagctgtgctcttcccagtcactctcttccacctgtaaaatgatgtcagagatagttcccacccaagagggtagttgtaagaaggaaatgagttgatctggtgcagtgcttagtacttggcacaagataagtggttagtaactggtatctgtgatgggcaccaggctagcagttactgcctctaacatctggagacgcaaaccctagcactgcagctatcccacaggaggtgtcaaatgtgagcctcccaccccatccccctgagatccccacatgaatgcacctccccacagccctaacgctctcaccagggacacacagaacaagccagtgcctcctcgctttacagaccatcagaaatgcaaaggcagttgctgtgcctccacggaatattctctcccctaaaatcttcatgtttttctctcctcttatttctcttctattcacctactgcacaaacaagatcaggcagcagtgataggcaaggaaagatggaaatattctttaagtggaatagcaaaaataggctttggaaattaatgcctagaaatttaccctgtgggctctctggagaccaacccaaatgaaatcccattgacagaaagctgcagccctctggggaatgtccccccatcccatcccccaggatccttggtccaggaaacatggaagttggcttctgatctccctggtctcccagggatcctgctcggggcaccacctgaaaagtccctcggcagaagcacttctcgccatgcgtgaatgctgtggaaagcatctgaacatgaagtttccaattactgctggcatttctggagtgtcctgatgctggctgcagctgtcccacggaaggccagtgatgtcatcagcaagcctgacagcactgagttccaaggctggctgggaagaaaggttccctgcaggctgagcccccatcactggagagggaggaacctgccatttcccccgcaaaggtgggcactactcaggtttgctgcttcccttcctgggtagaattccattgccataacttggactcacaccaggaaaggttcagaagctgcaccaatgtccaggatgattccatctgactgcttctgaaaacttactatgtgtccagagttgttccgggtggaggcaagcccaggtgagacctactttccaaatgttcatgtactcacttcgtggcatgaaaacaaaatggtcttgcattcttcggctacagagagacaataagggaagtaaaaaagggaaagagagaaacggagaaaaagcaaaagaaggaaaaggtgggaaggaaatgaaaagaggaaaagagagagaggggaagggaaggaaggagggagaaaaggagggaagaagtttttgtcctgtggctagttttaccttgaacctccctactcaagaccttcccagttcctctctcctcctctcccttgctcagggagctcaggccctgggggagccctggcagataccgtcctctagaagagctgaccaaggagacagagcacgggatgcctgcagagcgatgtaacagattgggccctgagccctacagtagagttcaagctcaacgcaatgttcagatttcccaaggcgggggattagattaattggaatttgcaggctgtgcccaaccaagatccatatctgtcaccatgttaaccacattcaggcccctcttaaaatcagaaccccgccatccatcaccaccccggtggagaggcacggccagagcctcgcagtccaagactgaccttctggctggcagcctaccttttagccgccagcctcctccatgggcttccagataagcgtgtgtaactcttgagcaaatcctagcccctggaggaactaccggcagttatgaacacagtccctttgttcatctcaggagctgatttaattaaacgagaaactatggacccttcctaagggagaaactatttagtatccagaaccaaggaaagtaaaggctaaagggaaatccagatcctttcaaaaactatctaattgaaccttgggagcaaaaccatgcagtcaaattacacaagaggatccaaggggctgcagtgtaacccaaggtgacacagccattaagtgaaacactcaggtctgagctagggcaccctttccaatgcattatgacacatttaatctgtaaaactgtaaattattttttttaaaaaaactgtcttgggccaggtgctatggctcacacctataatcccagcactttgggaggccaaggcaagtggactgcttgagctcaggagtccaacactagcctggccaacatggtgaaaccctgtctctacaaaaagtacaaaaattagccaggtgtgctctacgcaaataaactagaaaatctagaagaaatggataaattcctcgacacatacactctcccaagactaaaccaggaagaagttgaatctctgaatagaccaataacaggagctgaaattgtggcaataatcaatagcttaccaatgaaaaagagtccaagaccagatgcattcacagccgaattctaccagaggtacaaggaggaactggtaccattccttctgaaactattccaatcaatagaaaaagagggaatcctccctaactcattttatgaggccagcatcatcctgataccaaagcctggcagagacacaacaaaaagagagaattttagaccaatatccttgatgaacattgatgcaaaaatcctcaataaaatactggcaaaccgaatccagcagcacatcaaaaagcttatccaccatgatcaagtcggcttcatccctgggatgcaaggctggttccacatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtactgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattagaaaaagaggaagtcaaattgtccctgtttgcagatgacatgattgtatatctagaaaaccccattgtctcagcccaaaatctccttaagctgataagcaagttcagcaaagtctcaggatacaaaatcaatgtacaaaaatcacaagcattctcatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactgttaccaaaacagagatatagatcaatggaacagaacagagccctcagaaataacgctgcatatctacaactatctgatctttgacaaacctgacaaaaacaagcaatggggaaacgattccctatttaataaatggtgctgggaaaactggctagccatatgtagaaagctgaaactggatcccttccttacaccttatacaaaaatcaattcaagatggattaaagacttaaatgttagacctaaaaccataaaaactgtagaagaaaacctaggcattaccattcaggacataggcatgggcaaggacttcatgtctaaaacaccaaaagcaatagcaacaaaagtcaaaattgacagatgggatctaattaaactcaagagcttctgcacagcaaaagaaattaccatcagagtgaacaggcaacctacaaaatgggagaaaattttcacaacctactcatctgacaaagggctaatatccagagtctacaatgaactcaaacaaatttacaagaaaaaaacaaacaaccccatcaaaaagtgggcaaaggacatgaacagacacttctcaaaagaagacatttatgcagccaaaaaacacacgaaaaaatgctcaccatcactggccatcagagaaatgcaaatcaaaaccacaatgagataccatctcacaccagttcgaatggcaatcattaaaaagtcaggaaacaacaggtgctggagaggatgtggagaaataggaacacttttacactgttggtgggactgtaaactagttcaaccattgcggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactacgcagccataaaaaatcatgagttcatgtcctttgtagggacatggatgaaattggaaatcatcattctcagtaaactatctcaagaacaaaaaaccaaacaccgcatattctcactcacaggtgggaattgaacaatgagaacacatggacacaggaaggggaacatcacactctggggactgttgtggggtagggggaggggggagggatagcattgggagatatacctaatgctagatgacgagttagtgggtgcagcgcaccagcatggcacatgtatacatatgtaactaacctgaacattgtgcacatgtaccctaaaacttaaagtataataataataaaaaaaagaaattacttttgaatgggaaaaaaaaaaattagccaggtgtggtggcacatgcctatggtaccagctactctggaagctgaggcaggaggatcactcgagcctgggaggtggaggctgcagtgagacaggattgcgccactgcactagaacctgggcaacagagccagactctgtctcaaaaaaaaaaaaatactttctttgatatatctttatgagaattgctatcttaatgttgctcataaaaataacttacacaaatgtgtgccaattgctgaagatcttcagtttcagttattctattttttatttctggaagtcctatttgtattcttcaaatctccacggattttaaaaattagtctattgtttcttcctcatttgtttcaaacatttaaaatacattacctattccattggaactatatctgaaaccctcgggaatctgattcttctgtctgttgtttctgctgactttcactcgtggtgactggtttcctcatctgttttggattttgagagtgaaagctcatgcttgaatggctgggttttacctacaggaatccatcaaggcttgagctacaagtatgtccctccagagagaatgtgcatttgattctgacaggaactctggtgtgaccaaccccaaactacctccagttaattttgcagcgtggagtctcctgggtcacccaggcagtacaaattcaaaccccaaacttgcatgaaggcagacttatgattacaaattctcacagcaaacattgttccatcctttggcaagccaaagccaaaacagataagggcccctgtcttctccctttgcccccctgcagatgtctgctggaccacctgtctgtcccctagggatatatttctcctgtaggggaaagcttcagacagaaatctcatttccaactccccacctggcaagggtcccaggtctggctccctgggtattctaaaggccatgctttcaatcctggcttaaagcctgacacgccctcaatctgatttattgtaaacacagcgaagtctttcttagagcctagatctgtgctttttcccgtacctaatttaaagctagatacacctttctttggtctttggagcccagagttcccagggccttctaaggaataagctttcaaaactttgaaatgtagatgtatttataggaaaaggaaagcagcagcaacaaggttttaatgacctataaggctaatggaagggaggaaaaaacgcacacgcctgtgtagtcagcagttccaattgaggagcatctgaaatgctgtaagaaggtagaacaaagtgggaaatattagaacagagcagagtggatggggaaagaatctacaaagactgtagagacatttctctctgtctccgtatctttctgggtcattcttcgtcacaggatgtcaacataagaggtatattttaccctatacacacatgatgtgggccaaaagttgaaaatgagtgtaggattagaaactacaattcagaattttaaaaagaaaccagaccacacacaacaacttatccaggtagtttccagaaggcttcatagccatcactcagttcgtcctcacaaaagccctcaaaagtgcattttataaccagtaatggccaaccttctgataaccagtctactgtactttctcacatctgtcactacttcttatcaaaaaaaaattcattgattaatcaataatacgtttgggaggctgatatgtctggatcacttgagcccagaagttcgaggcagcctgggcaacatggcaaaactctgtcgctccaaaaaaaaaaaaaatccatatatatatatatatatatatatatatatatataaattagctgggcatggtggcatgtgcctatagtcccagctactcaggaggctgaggcaggataatcgcttgagctcgagaggtcaaggctgcagtgagccatgatcatgccactgtgctccagcctgggcaacagagtgagatcttgtctcaaaaaaaaaaaaaaatcaataacatgcacacactgcaaatatatctccagctctatgattcctcactcaaaatcttcaaaaccagatgtgttttagaattccaattgtttcgggttttaggaaattattaaggtgaatctctgaggtttgggctgcacatcacagtcacacacactaacatttcttcaatgacacacgacaattcagactaagctggatgaatgaagaccataaactgcctcgcagttcagggcagcttccactcaccaccagcccctccatgaattaggtaaaaacactcacttttcagagtttgggggacttcaggttgggaatgagctggtgtagaactggatacataagtcatctctcaaaatatcttatatttaaatccatcagcttaaaagtccttcccactaagtctcaaaatcttcactctgattctcagaaggggcagaaaagaacagtgatcagaagaggagaggagcatgaaacagttgatggccagagagagcccagtgggcctccccgggagccatgatgtgtagtgtgtgcatgggcggtggggatgtgtaggcataaaaccacaggataggtcagacatgacccaggaagactcttaacaaagcctcaggtgtaacagcaggggcaggctgggcaggggtggccctcagtacagttgcatttggcctcagatttgtgactaagagaagcataatatgaggcaaaacctcagcatcctcctctacagcaggagagctggactacaacagcaatttcagatggcaggcctcaaccccctggttgaccaggaaatctatgtaacaggttataagcaattattttttaagaaaatggaatggaatggaatggaatggaatggaatggaatagaatagaatagaatagaatagaatagaatagaatagaatagaatagaatagaatagaatagaatagaatagaatagaataggtctgtacctcgctcaacagggacagaagcttctgtactcaggacccttccagactcaccctgtatacctgtccacctgcctgttcatttatatcctttataatactctttttttttttttttttctgagacagggtctcactctgtcacccaggctggagtgcagtgacacaatctcagctcactgcaacttccgcctcccaggctcaagtgattctcccacgtcagcctcccgagtagttaggactacatgcgtgtgccaatgccaggctaatttttgtatttttagtagagacagggtttcaccatgttggccaggctggtctcgaactcctggcctgaagcgatccacccatcttggcctccaaaagtgctgggattacaggcatgagccactgtacccagacctatcctttgtaacattctttataatgaaaagattatgtcaagctgcatctcatgtggtaaggacagccattgtttcaggaacttttctttctataagatatatatattaatatctatgcgtgtgtatatatatatatatataaaatctagcagaatgtatccacatgtatatataacacatagatataatacacatgtatatacacaatgtatgctttgcacacacaatgtgtgctttaactgtgggatgtggtctaaaaaatttaggatttactgtgctagatgactgcctctgaatctttttaacacaaacatcctgtggattgttttttctggtgttactgaatccaggcattctgtattaaaatcatcccagactgaaaatcaaaaagaagtctcgttaaattctctctttttcaggatgtactttagccactgggacctgacttctaaggtctctgccactcactcattatgaccactagggcatttatctaatctctgagcctttagttccttatttctgaaatgcagaggctgaccatcacagacctctgaagagcaactgctcacataaaattggagaaatgacgactcctagctcatagaatggtcgtgaggatcacatgaggtcatactttgaatggtgcacccaacacactgtaagtgccatataattttgcctctaagacaagactatgaatgctttccatgtctggtgcttcatgatgcttttgaatccagtattcattttgcacatgcagcctgcttggagtgggagctgatggctttcaggaggccccagggcctgaccactgcaggggctgggaccacagatcgtaccaccaccctttgttcctgcctcctcctagcccttgggaggcaaagcttgtcccctcaataaatgatgaccagaaccctgtgtttgttgcccagcctcctgggagatgggcagtggcatagcaaagggattactttgggtaaatatttctctaaacctcattcttgcctccaccagtgcccagaacgagccggccagctccccaacagccccaccgttccaatgctaggacagtgctgacagcatcagctccctgaatacagggcaaatgacctcactaaaggtaagccccagaattaagcagtggtggcagaggctgggaagcacaagaggaggagaatgcatgaactgttctctcaaggcactagcgatttccttttccagagcaggttatcgtctttacagcacttagtacttggaccaaacagccaccacattgcaattccacctgaggccatggcgggcatccaatcctgcctcctccaaaacgggaatcttggctgcacctttctggacagatggaagcccactttctggtgtgccttccagaacccagggagctaagtcttaatgctccccaaggcaccttcccatcactggcaggcaaacagaggttagtctacccaactgatagctgagaacgctgagatttagttcacaggcctaaaatgctggttcgcaatattggctgcacattaggatcacccggggagcatctgaagttcccagagtccctgccatacccagaggctattcggatttgttccaagcatttgctttatctccccaggagtttccaacgtgcaggtgctctggctcttggttatcgatctcactggtgcctcagagccactggaaggccagttaaaatagagccctgggccccacccccagaggggagtccctgacttgggggttgggcctctgaatttccatttccaacaagctcccaggtgaggctgatgctactggtccagagaggaaactagagctttgagatccagtgctcaaggcccatgtttctagccttaggcttctcagccatggattggggagaatggctcctggcttgagaagctctgttctagaatagcactcctcagtcttctgtgtgcacatccggacgcatctagattcatgcccaggaggtttgggtggaacctgtgctgctgatcctctaaccaccgtctgaggaacaaggccctagactagcaggcctgactgccaaatctacattcttcccacttcaagcaggtctagggccaggcaactcgcccttccctaacagagatctgcctccttgaaacctccactctgagagacttgctctgagccacaggacaaagaaaaagacttcctctcccagaaaggcacccaggtatcctgtccccacctctacctcttagcctctctttctccctacgaaacaatcccccatcctttaactcctcttgctatgtcacaacaaacaaaacctcagggatcttggaagcaggcggactctcggcctctcccagcacttgatggggcagtactacgtgacatttaagtcccctccactggagacgtgcttcctaagtgtccaccacatgctgcatatggtcctcagggcttgggacccagctggggcacaatgacagaaacacaggaagcacacagccgtgcaagaaagctcaccatgggattctaaaaggagtgacgctaacagctggaacaagaagactgcaaaggaagaagatccagttcccatctgcaggccaggggtctcaggactgctagccttctgccctctaagccactggtcccattctctagcctagagagctacaggatatcaagcctcgagatgctggtaacctgtccaagtcatttaacgggaggaggaaggacgacaatggcttacactgtttcccatgcaccatgtgttaggcactgtgtgaaatgctctgcaagtattatttcattcaattctcactgaaatcccatgaaatgctcattgctatggcaccacagtttaacaggaaagaatggagaagaatggagaattacagatgtgaagtagcatgccaaacaggaggtaacagcagtaactgaccccatgttgacgagcctacacactctctttttttttctttcctcggctcactgcaacctctgcctcccgggttcaagcaattctctgcctcagcctcccgagtggctgggattacaggcgcccaccaccatgcccggctaatttttttgtatttttagtagagacgggggtttcaccatcttggccaggctggtcttgaactcctgaccttgtgatccactcgcctcggcctcccaaagtgctgggattgcaggcgtgagccaccacgcccggctcacactctcttaactgccatgtagttgaagcagttaacttgccttaactgcctaaagatgaggcacttaacttgcctcatcaaggaccgggagagaccgagactcagcctccttccaagatccaggtttctatgcaagatggtcccgtcctcaggccatttcatatggtaataaataacatcaagcaatataattgcacttaatacaccaggcaactctaaactacatgtgtatacacatatatacacacatacgtaacttatgtatagataaaaacatacactcattccatcctcacaacagccttctttgtaaatatctagatttccattgtgcagatgggaaaactaaaggacaaagagcttgggtaactagggtctcccagctagttggtggtgaagccagaatttgaactctgacagtctggtttccaggttgtgctggtgacatccccctgccccctccacagttcacattggctttggtgcctaaactgaataaagagcacagttcaaggtgctttctgtgcccacattgcacccagtccagtggccaaatcctctgcaggtaccttgataaacatccagtaaggaccaaacaggtgcctcctgccctatttatagctcccagcatggccagctagctataattagcaaagctcccctaggactggagctaaattaaactggtgggattagaggccagcagcttcggacagtgcctctggacacctccagcaacacaccactggtgatactaagagaagcctcttcaaagaagtagtttggcctcaccagtgggcctttctcctgagtggtgtgtggacccaaggggttcctttaatggcctcctcccaattctagtggctgatctgtcctgagatcccccaattaaatcagaagaagatgagtgatctcatgctctaagggtcagaaaaccagaactctggtcccggctgtgccgctgatcagcccggtggccaagggactcaactgctctgggtttcagctttgcttcttgagatgaagacaggcctatctctgaagtccttcttggccggaaaatcccagacatctcacagatctcaaaaaggggcttccagttaagtcctgtggtagggatcaaatgccctctagagaagggtctgagggaagcctgcagcccccaacgagggaggaggactctgacttgaaagtctggtgtaaactcttaggctgctggtgctgtgagcctggaagaagagaagtgacaacctctcaccacctcctggagcctgaagaggacaaagaaagagatctcatcttccctctcgctccagagtatccagccgccaagggctctgcctctctcgggactcagatgtcacctcctcagaggccttcctgggttccttatctagaaaatccacctgccaccacttcctagccactggccagggcactcccaagacatggactctcatcccctatatatttgttaaaatgtgcattaactgtctgtatctcccactgggatgtgagccccacagaggcagggcctgcatctgtgctcttcacatctagagcacctggcatataccaggcactgggtctgctgactcagtgagccattttggccccaggcctcctttctctgtgctgagcgcccagctgccaacctcccggagtcgttgggcttctgtttttcctgtccaaacagggagggagccactaaaccaaacaggatgaaagggaaagaggggaggtcaggaagccttcttggagaaggggatttcttcaaggatgagtcagtgatgtctagccaaggaagcagcaaggatggagagaagagaaggggcaaagcacagaggtggaaatggcccatgcagggcatctgccggcagctgggagttgctaagagcatggaaggttatcaaagcaggagggatcagggaggcaggggtgtcagtgacaaatggccacaggtgtgtgcgaagaagcctgaattttatcctacagctcaggtgtgggcaaacttctctgtaacaagctgtcaatctgtcacaattactcaactctgccacggtaagcttgaaagcagccataaaagatacatcagtgaatgcagatggctctttcccaataaaactttatttatagatatttgaatctgaatatcttatcatgttcatatgtcgaaaatataatgtgtctattgtttttttcaaccatttaaagagatagaacccatccttagctcatggactatacaaaaagaagtggccggtagactcctgctgtgggcaatggggaagttttgggaggttttaagaaaaagaaagacaagatctgggttacgtcttcaagaggcctctctggtggccagtaaagaacggaccagtgaaggtgttattccagaggctgggagaccctcaggaggcccttgtgatggtttaggtggaagacagaagggatcccagcaaaggaaatgagtcacagaagctcccctagaaagtgatttccatctgacccattggggcagtgaggcaggtgtccccggatgtttcttccatgaacagcaattgaattgaatgccaaatttgaatttggataacagcctctcgtcctagcaaaccagattaatactaatcactttccctccccacacatatccagctaactttccataaaatgctatccttaataaatccagaaaacaaacaaaaaccttcaatgtctacaataagattatagtatatatataagaaatgtctggccgagcaccgtggctcatgcctgtaatcccagcactttgggaggccgaggcgggcagatcacgaggtctggagatcgagaccatcttggctaacatagtgaaaccccgtctccactaaaaatacaaaaaattagccgggcgtggtggcgggcgcctgtagtcccagctacttgggaggctgaggcagaagaatggtgtgaacccaggaggtggagcttgcagtgagccgagatggcgccactgcactccagcctggacaacagagggagactccatctcaaaaaaaaaaaaaaaaagaaatgtctttattttcagaaatgcaaactaaaatctctagggatgaaatcctgtgatattggtaactgactttcaacatatttcagcaaataaaaaatgaacgcatcaaaaacagctccaatctctactgccttcctcctggcccatgacttgggaaatgcagggcagggtcagcctgccccaggatcccacacacacttctaggaggtaggtgtctctggatccatgtggcctgtgcatgtgatgaggggcctcttgctcctgcagaagagccatctgtgctttgcaaaagaggtcagagtcccaagccatagcagccaagggcagagaccaaagtccagacctgttcctgaagctaaaccactgttgcaggtacctttgctctccgtgatcttttgccaatgacccaaaaagaagctgtgaatttctgaccctgcactcataaatgctggtgtccatcaagcccttaccatgtggcccaatactttatatgcattattatctttcctaaacttcacaacaagcctatgggaaatatactattttctccactttgcagatgaggaaactgaggcttagagtacaacctgtgccatcatacaggtccccacacctgggaagaatccatgcttggcttaatgctctgctatcaccatcataaaattcttcatacattttataggaaccctacattcgcattctgcacaggaccctgcaagttacatagccaatctcactcaggtctcacggctcactggtggtgacatcaggggtaatgcaggcagtaggactccagcacctgcctgccatccatgacagtgttagaaatttcatgtaagtggctatttgattccaggctgctaaaagccaaagccaggacagacaccaggctctgtttgatacccaattctcaacacttttttttttttgagacagagtctcgctctgtcacccaggcagagtgcagtggcgtgatctcggctcactgtaacctctgcctcccgggttcacggcattctcctgcctcagcctcagtagctgggactacaggtgcccgccaccacgcctgtttaattttttgtatttttagtagagatggggtttcaccgtgttagccaggatggtctcgatctcctgacctagtgatccacccacctcagcctcccaaagtgctgggattacaggcgtgagccaccacacccagccccaattctggactcttaactcaggcaggacaaacagttggtggcctgggcccacccaactgccgtgctcagttgccttactccctccactctcagcctccttgagaagcacctttcctctctcggccacttctgtttcctccacagtgaccttggaacggtgactaggagtgctgcaggtggtggccttagaaggacaggggccagcccagtcccactctccggctgtcactgaagaagcacatgctcctcaatggaggaagacagcttcaaagagcatctgagttttaggaagggtaggagacagctggaacagaggccgattctgccagctgtcatcggtctctgatctcctggcaagaaagctggccatagagtaaaacctctttttaaaaattcagcaaaccaggagacataccctcagggtgtagctctgaggttccaatatacatattttcccagggctgagaagactggaaatttctccagcaagatcaaatgcaatgcatctcaacccagacccaccagggcaaaagcagaatctgtccccgaaggtcaacgacatcatcactgacattgagtctagctcaggctctggagctggtctgcctgggcttgaatcctagctctgatgctcgctagctgattggccttggcaagttatttaacctcttcatatctttgtttcttcctctgtaaaacagaaataatgatgcctgcatcagggttattatgaggcataaacaacttaatatatgtggaagaggagcttaataattgctagtgattaaagttgatatcatcattttcaagctctgcttagggacctgaagaaatgctcattccctacctaatgcaagcggggcttaaaacctagatgacgggttgatgggtgcagcaaaccaccatggcacgtgtatacctatgtaacaaacctgcatgttctgcacctgtatcccagaacttaaagtaaaatttttaaaaaatgttcattcccccggaagtagccccaaccttgccatgccctaaatccgctgctctaaaatccctaacacaagcaagaagtattgcctcttcttgaccaactgcaaggaagtgcctgcttctccaggacacctacaagggcagctcacagagccatgcccctcgggggacttcttgaccttggtggtggaggccttggcagacgctcaggtgtttggttccatatttgcttccagataagactgtttagtagacatgcaactgcttagctatgccccaaggcatggggcaagccaccagccagggagggcccacttcctctgactcatctgcacacatgacaggccaccagccccatccgccaatagcaaggcaaagctgactcaggcaacatgagattacgagagcatctccctcccctcctacttcagtccacagcaatctgtgcctccaaccttctttgtgctacaaagataactcactggtccaggattatcatggtacctctgtgacaggctcatcagcagggctgctcttgccaatctcttactgctcagagcctggcccttgtagctctgcctgctcttccctggtcctgaaccttgcttctgctccttggactcccaggttgggcttcttcctggtcagtcttatgcaggtctgaccacaactagtcccactatgaagcccatcagaaatgaggtcaatgcatcactggcccagtttcacagaaagatggacgggggcacaaatggctgctggaatccaggtcctgacaaatagagacttgatagagcatggttgaatatttctcacatagggacacaagtccagaaggcatatggcatctctgagtactggatgtcataccaggagagtctcatctcaaaaggaggtgatgatcatgtatttggccttcaaagcccatgctgctataattttctaagatctgaaatctgagtaatacaacagcagtcagcttcatgaccaagagcccatccttgagggaaactgactcttcctcctctgatgagtgacttgactttccaggcaagtaaagcaggattgagcttactcctgggtctcagggttgcctccctggcctggggcagagcagatgaagaggaagtgggtgttgattcttagtggtttggggcttcaaccttgtcacctacctttcaggcctagcctcagtcctgactcaacaggagaggccaacacacccaactccacttcctaaaggctttggtgcccaaccccaagtcctgatcactactcaggaaggaaatacaaggaaatgccttccaggtaggaaaggaggtataaccatatgtagataaaaaaggaactttccatttctgtaaattgaagtcttattcacacaagagacagattgcagggggctggatttatggggtaagatgattaaattctgtgtcctctttcatatgtcatgctttatcacgcattactaaggatctgatttggtggcaatttgttgatttcttcagttcttagctcagttacaaaaacgcagtgagcaggacttgggtaccctgccagtcagctccttagggtcagagaaacaccgtcagtccacagtgctttataaccacccaaccaccttagacggggccttggtattcactacccactcgtcctcccctagcaacaagcaccaacaatccaacatatacgtaagacttgtgggaagcccttatttgtctttatagccacagaatgtggtacatttaagttgttccataaatgtttttgtttttgttttgagactaagtctcgctctgttgccaggctggagtgcactggcgcaatctcggctcactgcaacccctgcctcccaggttcaagcaattctcctgcctcagcctccagagtagctgggactacaggtgcatgccaccacgcccagctaatttttgtatttttagtagagacagggagggtttcaccatgttagccagggtggtctcgatctcttgacttcatgatctgcctgcctcagcctcccaaagtgctgggattacaggcataagccaccacgcctggccttgttccataaatgtttttaaagaagaacatgctccctgaaatccagcccatacgccattcagtctctgactctgtctctgacagagacactcaagagtgagctgggagaaggcctggctgtctgacatcacctaggaggctgaggtctgacccagtcttccagaccctaagaagtctcacagagaacccagcactcggctgcacttaaggcttccacagcacgctgttccagcatcacctccagctccctatgggaagcccacacacctggccaagggacactggagcatgcactccctgcacagtcctctcagccactctagccctttgctcacgttcttctctgaccccagaacaacctccctacccttctccaagctgtccctcaaaacccattgatcacttaagaatctccatagcagatcttttgtacttggcatactgaactctgaccacatgctgggcagtttgctggatgacaggagtaccaagaggacgaaaacacatgcctgctctcaggccactcagactatcgggggaggtgaacagaggaacaaatggctgcaactcctgcacagtcagactggctggggtgagtctcagccccacaacgcactagccgggtgacctgaagcaagtcgcttaacttaaaatgtctgtttcctcttctctcatatgaggacaagcatggtactgatttcaccaggccgttgtcgcagttgtatgaattaatataattaaagacaacatttattttactcaaaaattactggagtaagaggagtgaaggtaatgcacaagctatattacttggttttgtaccaagctcttatcagattgctttcactagattggtgccctgtgcacatggcaggccctcaagaaatgtttgtaacccttccttgaacatgctctgcactttacccagcttttctgttctcatcacctcttcaacattgtttgtataaaaattatgtattctgcaaggatgagatcagatgccacctcccctaattaggtttacatgcttcatgattcccagacgaacaacttccctgtcttgtttttggatttctcaggcatctaaaaacaggtcctcaccaccttcagttatacccatccatataggtatactatatgctcctatcagaccacagctccttgaagacaaatactgagattcatgcattgttatttggggccaaggctctagcgacagaacaattaaaaagcagtgctatttctgtaggggagcactccaaaactcctttccaaaacctttttctcataagcccatgagccagaatggctttccagaacctcatttttatcaaaaatagaaaccaatctgaccacgcacactttatatcagagtgaaatggaacatcccaaacttttatcaacatgcattttctgttcccggtatataataaagggtcccaatgtttatctaacatttttctgaaatcagtatgtaacactctccacttctgaatctgatggggcaccagtcagtttcatagtcatcactggagagactctgtgccagattttgtcttcagttgtaacacaggatcacatggtcactctactgagctattcccacccacactcttggttctagggatgatgaagggaaaaacaaaatggttctagcacctggatgcagaccgttgcatgttcgacgtccttttcttgtgctccatatgaaacatgtcccagatccttcacgagcaaccctccactgttcagtttcataggagcgcagaaaacaagtccagtttcaagtaggtagtaatttctgtttcatttcatgaacaaaatagagatgcagcaataaattacatgatttgagccctcattagtagacagtaaatgtcactgtttattaaaaagctaataatccattcaattttttaaattaagcaataagactctaatataataaatttgaataattaagcctaatattaatggagtgaaaacatgagggaagaaagaagttctaaaatctttatttttccctccacataaaacatgttaataatgatcccacaggtgaaagaagtttctatgtgcataccagtggagtacttatttgtcaaagcaagaactcacacgtatgcttagatggctggaaatctctagggaagtacagagaactctcctaactcagccctcactattgactcctagctctatttttacctgatctgtttttattgctggactccactctctttccattacatacagcctaagaattttctactccagctagaaagagctctgactaggacacaagtttacaaccaggatggttggtctgtacgtgctgtcttctccctgctcaataaaaggagagcatccttgtgttagaaatagcttggtatctgcggccataccaccctggacacacctgatcttgtctgatcttggcagctaagcagggtctggcccagttaatacttggatggaagaaacaactttgcacaacagttctaaacaaagcacagtttgaacttattcttcctgccacacagccttcccaccacgtgaggccgtagcatcatctctgcttggaaactctacaccaagattgcaccatcacgccctgaagaaggcaagaagccttttctcaggccactgaatataggcttatgtaaacaggcagtataactcagtaggcggagatgaaacatttgcacttctctccaagcattataatgagaaagcaaaactctttatacaagctaaacccttttctacattcttaagtgtccaaacaaacttttccccagcagcctgcacttctatggctttgcattattgggataagccaagagggagggaacaggagcctttcctcctaagctcagagagatcaaagaaaacaaagctagagagtgtgagggattctgcttggtgagcatttctcagcagagtggactttctgtgtctgggctgcgggcccctgagtgtccggtgctctgaggacaccttcagtggaatctgtggaaggtacacatcagatctgctcccagtaataatgccctgctttgcagaggctgttttgctttcccaggtgctttcatgtcttttattgatcaacaagcaaacacttactgagcgcctatcagatgcagggccccaggtggagttatctcaccgacagatcatctcacggccccagtcttcagatatatgtgccactctgaaaagaaaataaggcccagatctgccttcaagatgtttatagtttatttggagacataagcagagtcccacagaaagagaaataatactgcaaagcactctattttaagttagtcttcctcaaactttgatcataatcacaaccacattaggagcttattaaaagtcaaaggggcctggatcacatctttggagattctaattccatgggaatgaagcctgggtccctgtatttttaacaagcagccacaaagattaaaaatttaaaacctaagacagtgcctaagtggcaaatgagacagtcactcctgttggccgaggtcaaaggactccagcaaggtcagacataaaagagacctgcaagggcagacaggaggctgagagcagaaaggcagaaaggggcaaggtaggaagttaggagggagagggggatagggtcccaagaacaagtgcaatattcatgtaggggacagaatgcagaaaattctggatgtaggagaaggctgccctagaggattgagagatcaagacagacaggtaggtctggagtccagggccgtgggactgcagtctgggccctgatattttatcatatcaaagtaaggaggatcatgaatgacaggtgtttactttagcctggaggcaaagggtgcctcaggaatggcagggccatgagagcagagaattttagacagaggtcccgtgctaggcctggattgaaaccatcaggaagaccggaagctgggcccaaggttctagtaagatattttaatatcctgttctaccctcaccacagatcaacgaactcagcaagatagataatattatcttctttctgtagagagaaaactggagcacaaagtggccaaacagcaagaggaaacctggggaagccagaacagccatgtggctggcgctcatctttgacaaatcaatccactgcatttcaagcctattcaacatacatttattgagtgcctactaccagcaagaaacaagaagcagcaagataaacggagtgccgttcctgccctcagggagctcacctcccaggggaggagctggcaaacattttctgtgaagaaccggatagtgaatacttcagactgtgcaggccagttagtctctgtagcaaatgctcacctctgacatagcacaaaagtggccatgcacaatacacgaacaaatgagcatatctgtgttccaataaaactttatttacaaaacatgcagtgggccggattcgacctgtaatgtaccaatccctaatctagtgggtaaaacaaaccccttcatggctacttataaaacaagagaggtgtgttataaataaaacgactttgcagcccaaaggaaagatagagtaatttagtctggccatggatgactggggaggcagcactggagtaggacaagtacttagttttctaggtctcagttaaaacgatggggctgaatcagaagcacatggacggcccttcttgttcccgtgttctctgacttggatgtggtgctcctttcctgcccagagtcttccaactgcacaaacaacgtggcctctcccaagctccctgggcctctcctcacctctaccatcaagttttgaatgtcaattaaggaataaaaattcctaaatgatcctggaaggctgaacacacacacacacacgcacaaagtgtgtgtacatcctactgtgtccggaattggtgggttcttggtctgacttcaagaatgaagccgcagaccctcgcggtgagtgttacagctcttaaggtggcgcgtctggagtttgttccttctgatgttcggatgtgttcggagtttcttccttctggtgggttcatggtctcgctggctcaggcaggagtgaagctgcagaccttcgcggtgttacagctcataaaggcagcgtgggcccaaagagtgagcagcagcaggatttatcgcaaagagggaaagaacaaagcttccacagtgtggaaggggacccgggttgccactgctggctgcggcagcctgctttcattctcttatctggccccacccacatcttgctgattggtccattttacagagagccaagtggtctcttttgacagggtgctgattggtgcgttcacaatccctgagctagacacaaaggttctctaagtccccaccagagtagctagatacagagtgtccactggtgcattcacaaaccctgagctagacacagggtgctgattggtgtgtttacaaaccttgagctagatacagagtgccgactggtgtatttacaatctcttagctagacataaaggttttccaagtccccaccagactcaggagcccagctggcttcacccagtggatcccgcaccggggccgcaggtggagctgcctgccagtcccgcgccgtgcgcccgcactcctcagcccttgggtggtcgatgggactgggcgccgtggagcagggggcggcgctcctcggggaggctcgggcagcacaggagcccacggaggggcagggaggctcaggcatggcgggctgcaggtcctgagccctgccctgcgggaaggcagctaaggcccggtgagaaattgagcacagcagctgctggcccaagtgctaagcccgctgagcccacacccacccggaactcgcgctggcccgcaagcaccgctggcagcccctgttcccgcccgcgcctctccctccacacctccccgcaagctgagggagccggctccggccttggccaccccagaaaggggctcccacagtgcagcagcggtctgaagggctcctcaagtgccgccaaagtgggagcccaggcagaagaggcgcccagagcgagcgagggctgtgaggactgccagcacgctgtcacctctcactaccaccgccagatgctaagtctaaatttatttaaatttctaaaggttttctccctccttcccagaacctctccctcctgaaaaaggtccagctgcttctgtaccagacactctagcgagactcaaatgttcttcctgaccaaatgcccacctcaagaagaacctggagccaggaagaaaccaagggtggccacacacctcatctgccctgctgtgctggtgccaggcgagaaaacagaaatagagccacggagctcaacagcaacacctcatatggtgccagcagacagcgagcaaggcccaggcagataaacacattaaggcaggctgtgcagcgcaggccacgtccaggcctcagagggacttcatctcagccagccaaggtcaactccattctaaggcttagtcagcctcctcctctgggggctcagactcccctggccaagatcactcatgtaccaagaggattggacaaggccacgagtgaggccaggtgccagcagggcaaaggcaggcaaaaggcaccacagatcgcatgtggtggcagcaagccagctgtgtatagattcaagcctcagacccacctctgaaaatcctaccctactcaagcctgaccacctcctccaggaagccctcctggctcttgctaattagcagtaaattgtgtgttctcttaacatctagagtaatacttctcaacatagggttgcgagaccagcatcatcaataagcaccacctgggaagttgctggaactgctgttggaagttctcaggccccacccaggccaagcaacttagaaactctgagggtgggacccagcaattggtgttttaataatgtcctcctagtgattctaaagcaggctgtggtttgggagccactaatccaaagtctagattctaaaccactaactggacacctgtgttttacatgcaatccctgtgctcctggcttccctgggaatgtggttgcatttcagagcctggatcgcacatgcccatcaatcccccaccttgcccagcccaggatgccacagcaagtacttcctcagcaaacacctgtggaatttaattagcttgagttcagataccaccatcaggttacaaaatcacagaacctgaatgctgaaagaggctttagtgcccatccagcccaactgcccatcaaggctctgccaggacccagcttctccacgtttctctcaggtcaggtcagatgctccactaatgcctgggagttcagtctcattcgttcgcccagcaaatattgactgagcatgggtgcgaggcacacacagatgttcctgcacacaagtgaacgagaccaatgagaatccttgctcggagggagcagatattccagtggcaggagagacccaatcaatagcaataaataaataaaacaaaaaaaaacccatatgctttaaccattagaaaacatcagacacaccaaaatatacagaccgcctatgaaaataactaaccagcactcttcaccaatgtcaaagtcatgaaaggtaaggaaagacgagtcacaaaagcacactaaggagacatggtgggtacatgcaatgtgggaccctggactggatcctggaaaagaaaaacagcatcagtgggaaaagtgatgatatttgaggaaggcttaaagtttgacatgcagttttagaccaacatgaaacttgttcttttctatagtgatgtaagatgtgaacaattacgggaaactggctaacaggtagacaggaattctctgtactaatttgcaaattttctgtataatattttgatggcaaatccagttgggaaagatggtccaaataagaggtgaggtgcagttggcatccttaaatagagaagtgacatgtgggcaagatgacatttgggcaagacccagaggcaggaaaggggccaaccagtggcactgtgaatgacatgaggccaaactcagtcttgccaggatgtttacccgtttgtgcttgttcttctatccagatgaattctgaccacgctttgaacacttacaataatgctggaggaccctcagtcttctctttagaggaggcctcacagtcctgcagctgtgcccactgagtgtgccccggcagcctgagcccctggagtggacagtaagagagagcgcacaaaggcagtggggtccaataaagaccaaggttgagaccaggagcacctccaccttctttgttctggaattgccctggtctctttttcttgccagcaaaccactttagttcctactttctcctctctttgaccctgtgcccaagcttctcagcatgtgagcttctcctctaagcactgtccacatgcgcccagaaccttgagcagtggagctcagagcagggttgacgtgagtaagcagacatgagtcaggctgagactccacctaatgactaaggatcaacgtcccacccaaagttcccatgtctagcccttcagaaaggacagggaaccataatccaaagtaaaacagcctactccctaggaatgacagcccacagtcctgagttctagggacctcaaataagtctctcccttccaggcgccaggtcaccatctataaagcgatacatttggattagttaatcctcaagatgctttccagttctaacactgcataatcagtaatgtatcaaatgaaattgtgcaaggtaattgcagctttgaagtacaatgtggggtagtaatggtagcagtgatgagatctatgggctcctaccccaagtgaatcaccagaattggaaatggtaattgttactattaatataataatgtcttaaattgcagagtgcttttccatttacaaagcatttttatacacattatcttgtgtgatcctcataagaacccagtgaaagtggtaggaaaaatgttatttctttggcatagatgaggaaacaaagttcagtggccattcaattaggagtgacggtgctcagccctgagcgtaggactcaatgcctcatcttctttctgctgcttggtgctgtctttgctactccaacaacctgtgcaaccatctgtgattttgtctctctagtttttgaccaggttagttcaaggcatctgcacaataaggaaacccaggcattcccctggaggggaaagcatccaaattgtgcccagagctgccttggctcggtccatccattgggctcctgggagcacagtcctcgccaggaggggaggtagcagtattctccatttgtctccctgcagctcaaaatagaacagatgatgtatcacagctgatctcactgcagcatcagatgttttaaaataattaaataaagagaaatgggagtgtgaagaaaaaggccccaatttttcaacgctagtgtcccatgaaagtgaaaagaaagggacaatggtcaaagtcaaggtgagggggcagctcccccagaggtgccaggtttacagccgttctgtccctgccatccaagctttcctaccagtagcaatactgtcacccctcaccattcggttgcaatttgcaaaaggcaagagacaacttcctttcttgccacactctaggatagaagaagcactccagccagccaccaatttcccctcgctaagcagcccttttctcccatgcccactacatgcagagggtgacccaggcacacccagagtgggtgctcttgtgtcctgtcggatggggccagtcagcatgagagctctttgttcaaaccccgtctccctaccatttgtgtccctacctaagtgcctacccttgcccacgacacttatctccctagacctcagtctccacggttctgaactgggagttagaagcactcatcttacttcctcatagggttgtcagtgctatgaggatggagtgagatcacacttgagaagacacttcaaaaacttacaagtcccacagggcactaagagaccatggttcaccaagcacctggtcaggactgataacaatggcgtatggctggcctttcccagcctccctccagttagatggactggaagatcaagttctggccagcagaatgtgggcagagtatctgctctataaagccttcacacacgatcctgctccctctttttctcctctgccagctgaagacccagaggaggattctgggtacctagaaagggcagagccacagacacaccctttgattgtgttacatggctggagttgagggttgcttgctacagcagctaggccacctggactagcaaaatgtcccagtggagtagctgcctagaaaatctcacaatgaggttgtaaattcaagtgagtggaaaaaaaggttttagtggtcgggcgcagtagctcacgcccgtaatcccagcactttgggaggccaaggcgggcagatcacgtgaggtgaggagttcgagactagcctggccaatatagtgaaaccccatctctactaaaaaatccaaaaattagccgggcatggtggtgggcgcctgtattcccagctactggggagactgcggccagagaatcacttgaacctgggaagtggaggttgcagtgagccaagatcacgccactgcactccagcctgggttacagagcaagactctgtctcaaaaaaaaaaaaaaaaaaaaaaaaaggttttagtagcaaacagtcaagtttcctcataattcttccacccagtaataggataaaaatgagaccatataaaagatgtaccccggcacatggacttcggggccccatagttctgtgacgtctgtgttcaacctgtttgtggaacagtcagtacagcacacaccaaaatgcagctcccatctagattgttgctgaggtgctcttccttttctcaaacacctattaatagatttacactcctgacaataaagaagcgcggatcaacctctaactagccagacaggctagtttttgttttgttttgttttttgagatggactctcactctgttgcccaggctggagtgcagtggcgcaatctttgcctcccaggttcaagcgattcttctcctcagcctcccaagtagctgggactacaggtgcgcgccatcatgcccggctaatttttatatttttagtagagactgggtttctgacccatattggccaggctggtctcgaactcctgacctcgtgatccatccgcctcgacctcccaaagtgctgggattacaggcgtgagccactgcccccagcccagataggttagtttatccaatcacagtatcaaatgccctcctaatgtggacaggccatgctgggccacataagagactaataagccactagaaaaaaagtgggggacaaaggacatgaaagacaattcacaaacataaaacaaatggcccccaaacatgtaatgttcacccttactcatacaaaataaatcacgtctcacccattagactggcaaaaatcaaaaagggtggcaagatctcgaattgccgaagaagcagggaaaaggcactcacttgtactatctgtggacagggacactggttcctctccagagatcaatttcataatatctatcaacttgtaaatggcaagtccctttcaattcagcaattccacttctagaaatctatccaaaagaaatcctcatacatgcataaaaagactcatacacaagattattcattgtttgaagtgcaacagatgggacatggcctaaatgtccaacagtacaaatcacacaaatacatttggctactaaacagatgaaaagtctaccccaaagtttacacgatcctgctccataacatccggagattgggggttgggggaactggcaatcaagcgcatacccacagaggttgtaccaggatttacatgcgcacaagaagggatgctatggggaagcattatccttaagatgctacgggagcacaatccaatgttcgacaaggtgtgaatctgtttccatgcagttccttggtgttgtgcttattttaaacatatggaaaattagccataatgcaaataacacagcaacagctgtgttttcatcttcttggctattttgacgtcacagccatcaaatacaagctccaaaaaagagcgaatgatattgttcccagcagcacatgccaaaaggccacacaccttcccacgggatgaaggattccagggacatctctttttataggtgtgacttcccctctttgcagagtagctatttagcaactagagggcaaagccaggcaactgagacttaggaacagaattatatcagagaaattggcgacaacctttctggagcgaaatctaacagtgtctattaatattctatatagacatacaccttttgacttaggaattccgctctctcaacaccagcatgaaaggcaacatatatgagatgtagtggagaaagaaaccataccctgacaacaacctgaaagtccatcaaaagagaatgattgaaaaaattatggtacctctataccgtgaaaattctgtaattatattttaaaatgagatctatatctacaggaagatatagatctcatctctcctgcctcaggagagatgttcaggatgaaaaacgtagttatcaacaatgtattgtatatttctaatgcatatttcaaagtagctagaagagaaagaatttcagatgtccccaacacatagaaatgataaatactcaaggtgatggataccccaaattccctgacttgatcattatacattccacacatgtaacaaatatcacacataccccataaataggtaaaatattatgtatcaataaataataataaattgaaatttaaaaagaaaagcaagaggcaggggacaagaatgtaataagatcccattttcattaaacaactgaaaagccatatacaaggctcacaaggccctacccaatctgccctcctccaattccttcccctccttctgtgacttcatttcctgcctttattcctgtcacatgctctgctctgtcccattgacaggacacatttctaggtacatcctgccccagggcctttgcacttacccttggcctcagtgctccttccccagaaagccatatggctttctcccaagttccttttggtctctgtgcaaaactgaccttctcagtgaattctaccctgatccctcctttaaaattacaaaacagggaggaactttatcctgttttatttttctccatagcacttatcattggctgcattcacttctctgtaagatatttttgttttgttttgttttcatttttattgagactgagtctcactttgccacccaggctggagtgcagtggcgcgatctcggttcactgcaacctccgcctcccaggttcaagtgattctcctgcctcagcctccccagtagctggattacaggtgtgtgccaccacacctggctaatttttgtatttttagtagagacagggtttcaccatgttggccaggctggtcttgaattcatgacctcaagtgatccgcccaccttggcctcccaaagtgctgggattacaggcatgagccactgcacccggcccactgtaaaatattttaatcccctggactgtcagctccaagagggcaagggtttttccctgtcttgttccctgtggcatccccagcacctagcacacagtaaatatccagcaaatttttgctgaatgaatggaaaacctgtttgcctatcttgacccgggcctggggaaataagtggaagggtccaccctaggccctaagcacttggccaggaaagctgcaggagaggagtgcatggcatccgagagccatcaaacagtaaataagaaagactttctttttctccatattatgattccaccagttgctgtgaacatatgctatttttataacttttgaacacacattaaataaaacaaaaaagcaaagatgtaagtcagactcagaggagcagtgtggaggggaggggagacaacgcaaagagagagggacccaggccacgccaaacaaccgcctggctctctcctccctcagaagaacccatccctgccccgcatccagtgcagcaagcgtcctgggaaggtcaggctgtggctcatgaaagacactacagagtagatgctaacccaaatccgaacactcccagactctccctcccacccagctcagctggtactagaggcagacaacgaaaagctggcagaacaagacaaatggtggagaaagtaaggtctgaagaaggtggggtgggtagaaagcagcaaaaaggaatgagggttggtccagggggccaggccccagctcagcctcctagtcactgagtcagcttgggcaagggtgctctaacctctgagcctctggttcttcctccctaaaagtcaaaataaaggtatctgccttgccccagtgggctggatgtatacgatactgctttatcatgctgtacaaatatcattagaaagagaatcagcagcgtggatgcctcactggataatgcaaaaccccgccccacacggagccttggtttcctctattgtgttttccaattatttgctgttggtctatcaaaaatgcatttaatatgcattttaatatctgacctttggccacctggctcaactctgttgcttctaataatttatacattcggagtctacgatttcctccagccagatgatggctgcaccagaaaataatgatgccttcatctcttcctttccaagacttatgtctctattggttttctcttgtggtattgcgctggctctgacctagggtgcaaggttgaataagagaggtgatagtgggcgttcttgtcttctttttaacctgaagggattgcatctcatgtctatctatcaggaataaggtttgctagagatttcagtagctatctgtcttcagattaagtaagttcccactgcgcagagttgacgatgtgtgatcatgaagcacctactggatcatattgaatgtcatttcagcaattagagagatcattacatgattgttctcctttgttttaatagaggtctgcaaaacaaggggatgcctctacccaatactgcctttcagggtcaggaggaacaaggcctgggacccggaagataatgacaccactcccacctcagccgccagcctgagcccctgatggtccgtcctcctgtgtgccacccctcctctcctcaactctgtagctctctgggccaatctccttcacctccatcctgaactctcactagtccttaaaatgccacagacttgtccctgtgtgaagtcacaagagaaagctcactgccaaccatctccatgtcacaagaagtcaccctgagcatacgctgtgggaagcaggctgatcgcatcattttttcaggatgagcagttcaggattctgatgcaaagactccacatccaccttggcacatgctaagattcacatgaagctattccaaaatggaacaacatacctaggaggcagtgagctccctgctaccaaagatgagaatgtccccatgacatttgctacagaggtatttctacaaaagatgaagagtgacccagagtcatctgtaaaatgaaggtaatcagacctatcaaaaggtaatggaggaggaggaggtggcagcctagtggggagagcaggaggtgggatggactgacattccaagcacctgacatacacctcgtcacttagtcctcacagcagcccctgtggctatcaggacacagagaagttgctacaaaacacacacacagaggccgggcacagtggcttatgcctataattccagaactttgggatgccaaggcaggtggatcacctgaggtcggcagtttgagaccagcctgaccaacatggagaaaccccatctctactaaaaatacaaaattagccgggcttggtggcacatgcctgtaatcccagctactcaggaggctgaggcaggagaatcgcttgaacccaggaggagaggttgcggtgagctgaggtcacgccattgcactgcagcctgggtgacagagcgaaactccatctcaaacacacacacacacacacatgcacacacacatatgcgcacatgcacacacacacatacacagacacaccttgttcaaggtcacatagtcagtaggtgacagcgcccaggcatgcaccaagggcttctgttccagtccttaagctcactccactccaccactccccctcccaggctccagggtatgcttgtcaaactgcctaacacagtgacagccacataatgggcacttaatgattctccccagattcagatggtcagacatccctcccactgagcaaagtcaattttctcatctgcgaagcaaaagagagacttcatcttggcccttcacaggcaggaaggtctgactgcctggcttttacggtcagcccttgccacctttgcaaaatgtattcagaaacatgatctcctttgagcttcacacctctaagaggcagggtctcggcagagaaggtcactggggctcacgtggggaaggttctgcctgaggtcccatgctgaactagcacactcacatccagggacatcagccacctttactatctccaccccaaagcctcatgagtgaaaaggacggacgatctctaagatgtcatgaaaacacggagatacaattgaacctatcttcaaacccaaatgtgtgccattgactaatgtgtgatgtccactctctaaatggtgaagtgaagaagcagtcagcataagattccgccaatcaagcacaaataacaccatcgccttagactcggaccatgtgatgacctttatacccgtggattacatattgactctcctttcataatctaggcaccaaaatatctgctggcagcttattcccatcagctgcaggacaaagtagcttctgcatttggttccaagacaggagtcagcaagacactggaggccacagtccaatcccaatggtctgtttattgtctgaggtcattaccatggtgtctcctctccccgggccctggtaagcaccaaggccactttatttgtcagtgactcaaccaggaaccacatggacttcaaggcaacctcctggccctcaaggacacagagtagctaagccaaggatacagcaaattttttggaccaagagccaaagcaggtggcgcagactctgctaatgatcagatccaggcagtacagagttctgagcaagggatatagcaggagtccagctccagctcccttgatttcgagaagagccacaccacctaagaaactcaccttgctcctcatcaaaactgccctattctaaatggcactgagaatgagactgtcctttatacttttcaccatcccagttggtgggaggggtcttttgaatgtattcccacttgtgagggacacaaaactcaccaatgcctgacagcaaaatctgggggcaggcttcccaggtctcccatgtctgccctggcactgaagcctggtttgggggagacggggatgcgcttgtgataatgccaactcttcaggttctgagcactctcatgtctgtcatagaataggataggggttcactattgtagcatgacacgggctcagaaaggccacctattgtatgagcacatttagatggaatggccacaaggggcaaatccgtacagacagacagcagttcagtagcgtctgaggctggggaaggaggggtgtggggagtgactgctcatgggtatggggtttgtttcttttaggttgatgaaaatgttctggaattaaataatagcaatgattgcacaactctctgtatatactaaaaaccactgcaaatgagtaaattttatagcatgtgagtgatacctcaataaagctcggtttttaaaatttgatggtgtagaagaatatggaggtagcacactaggaggtgcttccctgccccacaagctgtctgtcatttgtcacctgggcactgggcacatatcagtcctacctagcagcccttgcaatcctaccataggagaccagcaccccacacgggcatttgttcagccctccagcagcccctcctgccagccaaccaccctcatccctcccgtggatttcggggttctgagtaaccaaagcaagcatgggaacattctcagagcatgtccaggggacacctccgggaatatgcattcatctcagaggggagctgagtgcttatttgacaagcacaatgtaaccaagccaagaatggggaagggtatgaaacaagagaggcggccctcttccttctcagggaagccggggctggcaggaagtggggctgcaagtccaacagctgacaccatcgtctatgttcctctgagctgtgtgcaaggaagagtacagtctggggctgcaggcatgacagacttcagagggaaacaaatcaggcataaaaactgctagaggttccattagcaagacagagcaaaaaataggattcccacatcccccctggtgccctcagggctccttgtaccactaaaaataaagcaacaggcaatggtgtttttaatgccagcgttcgcaggacttcctgcagagtcaggcttgcacagcttccttcggtcccccccacccatctccaccccctcagccatggatttctgcagcaccaggggccagcaaggagcccaggactgaatgagatgcgtccatggatcatgaggctgagatagatttccctctgttgtcccacttcaaggatgcagtctggagcttgcaatccaaacagggagacaggttctgtgtcccttcaggagaacagggtctgagcatttgtgtcataagcagggaaggagagggacctcagatccagtccatgattggacacacctccctctaacctctggcatcctggcaggcatctgggaggaggagttagaagaggaaacagctggggccgtaagtcaggcgagttcacacccaaccacctgccccattacacagcagaaagcacctcccttactccttccacagcccacaccccacaacccagcccccagggctgcccagtactagctcttgacagaggactctagtctctcagatcaagaacagccctcagaaaggcaatatggctctcagtgattctaagtgcagacactggcattgggctgcctgattcaaatcctgcctctgccacttgctacatgtgtggccttagacaagttacttaacctcagttcccctacctgcaacatgaggttaatgacatttcctgcctccaggactaatgtgaattgctcacaacggtgcctgacacataaaggtgtgtgataaaggccagatattactggggaccaactaacactatctttcctagggagccactggcatctgaggctggcagccttctcttgattctccaggttgccctgtgtgcagcaggatgccaacttgtcctggccccgaggaagtgaatgctaggagttgctcctctagtctaggtgacaatcaagtcagttcagtggtagggacaggattcaaaccaagctttgtctgaccctaagcccatggctttcactaccattctacactaaactatcacctgcaaaacccacagtgggcataaaaagcctcttttgtcaaggacagtgagggacatagtaacagaaactgaaagagaagaaaaaaagaagtctcaagaaaaaacaatcagcaggcatgatatttattttagtttttaaaagttgttggccaggcacagtggctcacttctataatcccagtactttgggaggctgaggcaggaggatcacttgaggccagcagttcaagaccagcctgggcaacagaatgagacctcatttctacccccaaaaaatttacttaattaaaaaaaattagctgggcatggtggtgtgcacctatgtcgcttgaactcaggaggtggaggctacagtgagctatgattgcaccactgcactccagcctgcacaacagagcaaaaccccatcccccgccccccaaaaaaaagagttgcctaattcttcatctcaggtcccttttagaaaaacttatgtcatatcccataaaccaggctatcattccttcctaaagattagtagacctaagtaggcaactagaaaaacaacacatccgtctgaggtctcaggctcacctggaaatgcaggtcctggcctccctgcctccaccctcccccaccccttccttgtcaggcagcttgggccacccaccatatgccgctgcagcccataaagactctggaacatttcaaaggccttggcccccatcaggtgtggctccaaaaaacacagggtcacctataaaaggttgagcacaaggaaacagccataaaacccgcagtcctaacagcagacacccagtggccagaacaaagcagccagctgccgggctttccaggaaccacagagggacatccctcccaaggaccgcgcccagccgcagcccaggggcacatggctgaaaggtcctcagaggccacctggtaagaagggccctgtgttgggtgcttgctagttgccagggactgtcccggatgccctccttgaagagggttaaggaggtaacacaggaaagagctggcatggtgcctgcagccctgagggcctctaaaagagatgcttcatctttcctgagcttcaaagcacccggcaagtgggacgtgattcccatcttttaggcggcaaaactgaggccctgaggagtaacacaactaggaagtgagcttcaagccaagtctgtctgttcatctcatgctttctcgtgggttcctggagaggtcagatgatgggctgtcagtgctcaaaggggcctggagacctcccagccctctgctgggtaccctccctacacagtgcagccaggcttccaaggcagcctccctcctctgctgggacagtcgtcaggggtgtttcagaaggagcaagccccgagcagcctccccacactctggcccagttgagggaggtgacagggcgccatctcctgctccctttctggaaagctttcccacatcccaggccaggccctgcaggccctcaggctggctgatacatggcaatgacaacagaaatggctcacacttggtaggtgcttcctaactgccacatcctttacacacaactgcacaaatgctctacatcagggatgcccatgttatagaaaactaggacttatggaggatgtgcaacttccccaaggtcatgcagctatcagcagccgagctggaactgaatccatggtcctcaccatgccacgctaccctgcttctgcctgaacgcaagcaggtgcagataagccgcaacacccatgactatacccacacactaccatcttcccagccgcatggcagtgctgcggcctagacccatggctcaggctctgccatccacccttggtgcagccctccagcctcccagacacccctgcatcagcctctctctaggtaacagataatactgctgaaataccaggctggctttaagttttgggtcccactgtcccactgtcctaagtcccactctgacctgtgggactaaaaggagggatgggacaatcattgctgtacaagcagctcctccagagaaatgcccagacccagagcagcaacccctcatggccctcaaaaaggcatctttggccaggcacagtggctcacacctgtaatcccagtgctttgggaggccaagaggggacgatcgcttgaggctgggagttcaagaccccatctctacaaaataattaaaaaattagctgggcacagtagtgcgcacctgtagtcctagctacttgggaggctgatgtgggaggatcacttgagctcaggagttcaaggctgcagtaagttatgaccatgccactgcactctagcctgggcaacagagtgagactatctcttaaagaaaagaaaaaaggcaccccttcctagagtccagaaagacgtctgtatctggcagtgcccgtcttcctaagtcctttctgagggtcctgagctgaggggagccaaggatgcagcttcactccatcactgggtggtctcctctgggaacttggagtattcccttcctgcagcaggaagagccaccaagagtttatcgtgttcagtccttttagtcacctaatgcccacaggcaccttgacaccatacaaagaacccctctggggaagccaacaaccccaaaacccgtgcaacccttgcaccctctgcagccagcccttggtagtggccttactgtactctccctctccatgactcagtttgcctccaataagccctggggcctcaagttcagactcacccaactagacagaccagaagtgagcctctgccctgacatcttcaggcactcttttgtcaactactcacaaggatttatcagataggaagggaaaaggacagaaagaactgtgggataaggaaggctctgaatgtcagaaaagggtctgagtaggatgatttgagactgaagaagctacgtggtatcacttaggagcaataaaggaaagattagggcaggtgaggaggataatggacagtggagcctggccagtgccagctgacggactagaccgatcttcctacctctgcttgcaaaaggcattgcttcctgcttagcatgcctcactgattcccataaaaatggcattcatctatatgctgaggtgggctgaatcatggccctagaagatgtccacgtcctcatccctggaatctgtgactgcgaccttaactggcacaagggactctacagacataatttaattaaggaccttgagatgaagagattagcctggatcatccaggtgggccctaaatgcaatcacaaaggtccttcaaagagggaggtagagggagatttgacacagaagagaaagtaagagatgtgatgatggaaactgagatggagcaatgtgctttggatacggagcagaaagccacaagactggggatgcaggtggctactggaagctgcaaaaggcaagaaaaacgacttgcccctcagagcctccagaaggaaccagccctgcagacgctttgactttaaaagcccagggaaactgatttccgacttctcgccttcagaactgtaggagtatatttgtgttatcttaaggcactatgtttgtggtcgttacagcagcaagggaaaactgacacccacactcagccactcgagaggtcccttctcctgctcaacactgctagccattaggggttaagtaattcacaaaagagacccatccctgccttcccgtaacatattgtcatcctctttcctccatcctctttcctagggtccctgtggcctggactatgctgctttctgcctaagtcctccccgtccttccagctctcattccttccatgaagctttgttccagcctcagagtcttcaaagacaccattcctctgcacgtccccctgcacccacccctggctaatgcctcttcatcctgtagatctcatttcttttttttggagacagggtctcactctgttgcccaggtaggagtgcaatgatacaatcttggttcactgcaacctccacctcccaggctcaagcaatcatcccatctcagcctcaagagtagctgggactacggggatgtgccaccacgcctggctaattttttgtatttttcgtagagatggagttttgccatgttgcccaggctggtctcaaactcctgggctcaagcgatccacccgccttgacctctgaaagtgctggggttacagtcatgagtcaccatgccgggcctgtaggtctcatttctgcagggaagccttccctgagccccggccaaggagaggatgcacccccacacacacacgcattatagtccatagtctctcatcacactccaggctgaagtgtgcatatacgtgtgtaagaggggattatctgttcaatctagtcactgatgatggaattgctcagacctctgagggcagggaccttggttgtcctgttcaccagtgaatcaactctcagcctgttatagacacttgcattgatctccctctgcccagaactgctttatttaacatctctatcaaaaagaaccgttgcatagacatttttccaaggaaggcatacaaatggcccacaggtatataaaaaggtgctcaacatcactaatcatcagggctacacaatcaaagccacgatgagttataacctcacacctgttaaaatggctataagcaaaaaaagagagagagagagagcaagtgctggtgtgggtataaagaaaagagaaccctgttacactgttggtgggactgtaaattgataaagtcattatggaaaacagtatggaggttcctcagaaaaatcaaaaatagaactaccatatgatccagcaatctcactactggttatatatccaaaggaaatgaaatcagtacgtcaaagagatgtctgcattccaatgttcacagcagcattattcacaatagccaagaaatcgaacctatctaagtgcccaccaacggatgatggataaagaaattgtggtacatgtacacagtggaacactattcagcctttaaaaaagaaggatatcctgccatttccaacaacatggatgaacctagaggacagtatgttaagtgaaataagccagggataggaagacaaatactacgtgatctaatttatatgtggactcttaaaaagttgagctcataggagcagaaagcagaacagtggttaccaggggctgggatgggagaggaatgctggtcaaagagtacaaactttcagttaaacaggaggaataaattcaagacatctattactgtacatcatggtgataacaattaataacaatgtattgtattcttgaaaactgctaagaaaagagattttcagtgttctcaccacaaaaaataggtatatgagataatgcatacgataattagctcaattcagccattccacaatgtatacatatttcaaaacaacatgttgtatacaataaacaagtacaatttttatttatccagagaaaattttaataataagtgttcattttaaaaaaaaaaatacagccaattggcactctcaggcctgcgtcaggaacaagaggaagtcagggctcaagtttcaaaaacacagactgaaaataaagccccaaacatactcaaggatggaactccccacagcctgtcagcagtggacaaaaccttccatagcagaagctgcaagtaaaagatgtctgtgtgggaggaaccatttagaaaaagcagtaacaaggcgatgaaaacagaaacaaggcggccagtcacccaccatccccaattcgcccaaaggccaggtcaccctgttcccaccctgcaccagctgctcctctgcctgcggctttctggcccaaatcctgtgtggccctcactttctcctcagtcctgcctctgccatatgaccatctcctcctcaaaagaggcttctctggctacccaccaaagcagcccctctaacacacacaatcccatcccctgttcagtggtctcatggtgccactgtaaattatctcattcattgatttactgaagtgttgattatctgcaccccccaccacacacactgaaacccaacccagccctttctgttgcagtttcccagggcttcagacagtccttggcacatagagggtgccggagaatccagaatgaccctcactgtgcatatccatagctgccctcactgagccgcagcctcgggctgccccaaaaggtaagcggagtacaagggtggaggctctctctctctctagcacagaatctctttcttccagagtcggccagcggtgctgtctcttttctgctgggaaagataggaatggagattccttgaggtcagacacagtagatcctagtcagaaactcccattggctaagtgagagaagccagacacaaaaggccacatattgtgtgattccacttatatgaagtgtccagatcaggcacatccagagagcccacacagagtagaccagccagggactgggagcagagggaatagggagtgactgcttaatggtacaggacttccttttggagtgatgaaaatgtagataataatgatggttacacaactttgcgaataagctaaaaaactaccgaactgtatgtacactttaaaagaaggaattttatctcaattaaaaaaacaaaaaagcacttattgaaaaatgccatggagtggttagcagagcaaagctctggagtccaactgtccaggctcaattcctggcttaagccatgagctatgtgaactgagccaaattacttggcctctctgtgcctctgcttccttgtctgtaaatgggggtgataatcatgccaatttcacagggatgctatgaggattaaatgcaaccacccatgtgtaggggactttggctaactcctttccaaacttccaccttccccattccttgcagaccttgttttccatttgagatccataaggttctgaggatactgacaataatccctggcttcagccagttcagttacagcaactctcagaacctgtgctaggaatgctggtgcaaaggtgatttatttcctgacaaggttgagcagatcagcatgtgccctccagagctgcagcagccatgtgtgaacccagaggcaaaccagcctcaggacaaggccaactgtaaggagagcagattagagtgacagaaagaaactgggtccatggagacatcgttgagccaccggatcaaggctcatctgaagtcatccacctttccaactatatgagtcaatggagtccctttaatgttaagcccattgaagtgagcatttctgctacatgcaatcaaaagcttatcactgattcagctacgtaaagtccctcatacccagcccggcacatagcgagttctccattaagtgtgacttattatcatttttttttccaagcttctctgctgttccccaaggccagtgttcacccagatgtctagatacagaaactgttctactggtttatctagatccaatcctatgtccctgtaatggcaagccacagacaactttaccaaaaacccttgctgtgtgcaaaatcagtgcacacagcaagcattcatggggcgaggtactgtgtgctcagacaagactaggtacgcaggggacagcacatcagggaaggacaaggcactctgatcataagtccaaagaggagttcataatctaatcagcaaggcaagatcaaggtccacaaaacagtaaagtatatatttgactagtgacatgatttaagaaatgcaacagtgcaagctaaaggagtccagagaagaaagagatgggaatcctggtggcattctggtttctcctggctcccaatgctcccaacacatggacctaaccagatccaaaaacatcctcccaagaacatatggaggccacaggacatcagagcccagcaccagaccttgctcctgcaaatcccaaagataatgtgcacatttcacggacatggccaaagacccaggcacattctaggtcatggtcacgaaactggctgaactagtcaagaagtcctatcatcttttcttctcccaatttattttctttttccctctttttctcccaatgcagtaaaaatgtgatgcatgaaacaattattcttcagaactcaggggcaggtggggagcctcaaatctggagaaagcaaaatgtaaatgatgcaaaaagagatcaagatccatgaatattcatcttcctctcccttctggtggaaactagatttggaggggttcattgcgctccatttcctctgaattcctaggagcgcttgtggtcggcatctcctcattctgcctgaagaccacatgcaactcatagggctcttgcctccaagaacaggcggctgcacaggcgcatacattgtaccaacctgtacaccttatgtctgtgcatgccctacatgtatgttagacttcaattttaaaaaatgaaagtcaaaagactggtcaattccttctggtcctcaaggcatatttccaatgtgggggtaccttcctctcttcacttcacggtggaggatgattctctactctacctcctcacctccctgacacacctccttgccccaaaacaaaacagtgaaaatgaacaatcccctctaagccatttgcttatggaagacaaagctggagctgactcctttctggattctctctccctactccccccacccccactgagcacaggcatgcaatagatgctcaataactgtttattttgggaataaattacaaatggtatggaactatctcacacacaataagtctgtaagttcctggatgtctgagcttgtcttctacctcttgggatgcctgtgtggccctccccaaaaccccaccaccaggtgatttcttaacctctatgagtctcagctcctgaaccacacttgtccttcaggatcactgtgagaattttaccagctaagatgtaaagtggccagctcagaatgtgatatattgtaagccctcaataaatagtagctccctggacccaaccttcccccacaaccttccccagttgcagcacagagtttaaaacctcccaggagccccataaactgtggccgaccaggactgaccagcttcagctctgggtgctctgtgcctctctccaatacacacagtgcttcattaaagaactcaaagcttatctggcccaaaagcaatgcttttatctaaaatcagaccacatgggcaacaagtgaagcaggaagcctatcaaggcatttgggccaactggttttggctgccaagggagccctccttataggaggcggttcagaccgcaggccggctcacatacaacactggtgtacacggaggggttaattagcagtaaacagatgccatgattcacctctgtgctgttatttccccgtgtgcagctaaaactataatcactctgttctccgacaggatgtttgcgttcaagccaaaactgcctcctctatccaacttgctgcagttcggttcagcacagggcaatgaggaacttggctcctctcacgatagctggtggctggcctgacagaggccccttcagacagggaaggaaagaggagatggatggggtagagaagaaaaaaatgaatttgtcattttatcaaacacaggtgaaggctgtctgctggtgggaactgctcctcaacacttaacacccacagagctcacaaaataccctttcttctgaggcagtcaggcatgagaggcttcaggagccctgtgacaagtcattggcaagaaggagctggggcaaatttgcaggccaatgcctgggtcacaccctccctaccactgcccaggcctgggtgggtgtctagtctacttggagcctgggacctggtaaaggtggcctgaaaggctcaacctcagcttccagaaaaaattaaataccctgagagagccagaaaacaaagagattcagtgcccaaaatataaatgtaaccagtgtggagtattagtcaattcatcagcaagaggttactgaatgctcgtttgttcattcattcgcccaccatctaccaaatgcccaccagagacatgccacgtgtttggtgctgggaatacagaaagaaatgaagaagatgtatgtcctgtctcagtggcccacagaccagagtgtgccaaatcctgaaggatccagttaggagcttacaatctagctggaaagctaaagaagggaagcatgcggaattctccggggctcatcgccatccctcacctaaccagtgctttgtgtaagatagactcaaaggtgagcttgaataaactgacttctgctaaatgccattattctacctggatacatcacaaaaatgggagccattacctactgagtatttttcatgtgctaggtggaactttctctgtggtcttcaccctacatgtaatggaaactgaggcatgaggagggtagacaacttgcccaagaccacacaggggaggcaagagaggaacccaggtccttgcaccccaaccccatgccctttccacctcactgcatgagcagaggaaggagcccccttgtccatccctcacccagccccagctcagcttgggctcccccaagcaagcaccacatgactgacactcttggaatcctcttcataacctggcccaggtatgggacaagttgccaatgagcaacatatttgcttaaccaaatgcctgtggcagaataagcttgagataaaagggagtgtgaagtggaaagaagacccggaagtcttcatgaaggaacttggtgtacagaaagatgttttgggtgcctcagaacacataatccctgatagagaaaagagtctggagacaaataccagatgttaagcaaccttaacacaggcgcctgggctgcctcagcctatcagagtagcacaggttcctaaataggggaaagtgccaactaaaaagcccaccaggcaggagggctgggtctggagcctggcctttcttctttgttcagagcccaaaaggtgcctctggtccattcaccattcaccaggccccagagcagccccaggatcaccagatgggtccaccaggtccgtcctgctctggctaccaggcttctaagcctcttttcagaccctcagccttctgggagaaaccattccatgccctccagcactttccaccccttctgttccttttgacatcatctccaactgcctgaggctgcagaaggtgggtggtgtaggggcagaacaggcaggagcacaatcacaattcttataaaaatgcaagggactgctggagccaccagggaccctcagaatggcctcatccaatcctccgttttacaggtggcaaactgaggcctcgcccctgagttaaccctttcaatgcctgacatctcgtactgcaaaattcttcctttcctctctctccattcccctctccctcgtccttcctatagtggtataggggtgtgccgtgggtgatgagaggcagagggaagggagcatttctcaccccattttcctccaaccctactttctgcctccatctttagcactacctcactgtccgtcttggtgctcactgttggcccctggctaccctgccccttccagtggtctcctgtccctcagttcagcacaatcctggttatattgacaaaggagagggatctaaaataaaggccaacttcatcataacagggccatttattgaggacttacaagatgctaaatgctattatactcacaaaacctttacgtggctggtatttttagtattcacagtttaccaatgaagaaagtgagctttgcaaggttaagtaaattggccacaaccaccaagctaatgcaaggtagagccaggactcaaacccgcctttgaccaattccaaactaggctaagagcctcacaagactgaatttaagagaccaaaatgaacattcaaaatgttgcactgtggatgcaaagatggaaggcacagagtcctaggcttcagagatgctacattccagcagggggtggacattccacagacgtgcaatccaacctggatggactagagtggagacttaccagaaacagagtgaccaatgacctaggaggttattgtcaatgcccacattaggggaaaatgtcacagtctcccaaagatgaccaaatgaaagtaacagtaataactaacactttcctagcccttggtttgtagcaagtgctaccctcagcatttaacacatgatcctcccaacaaccccaggcagcaggaggataatgtggggtgacatctcccagcatttgaaagtcaatttgaagaccgggtgcagtggcacatgcctgtaatcccagcactttgggaggctgaggcgggtggatcacttgagatcaggagttcgagaccagcctggccaacatggtgaaaccccgtctctactaaaaatacagaaattagccggacatggtggtgcgcacctgtaatcccagctactcgggaggctgaggcaagagaatcacttgaacctgataggtggaggttgcagtgagccgagactgcaccactgcactccagtctgggcacgagagtgaagctccatctcaaaaaaaaaaaaaagccaatttgatactaggaactgtttgagggcgttttcagtattattttattcccactttccaagtgagtgaactgaggcatgcagaggtgaagtggcttgcccaagatccaaaggtcagcaagcaacacaactatgatttaagcctgagtaggctggctccagagggcatgtccctgatgaccacactgaactatctagaatgagagacgttgctcattgagacattacaattctggtccattggattttagaaaggcaaccgtattacttatgttactactcacgtttgagaccctgttttctcagcagtgaactgttgaacttactttgctgagacataaaattggacatgggtagaaggggctacagtgaagtgcatttccaaggtgaagcacatcaccacaggagtgagacaagaaacccgggaagcagcctctgtcatccatgagccttccactctcaatgctccaggcaaagagccacgccaggtaagattcaaagtgggagagggcagactgggagatgatgcattcaaatcatgagggcaggctcaggtaactactgtcaattcaccacccctgaattagggccaacgtaaaccagtgacaatctctttgaaacatgaagcagggaggcagttatgccccttagtccctttatcctgaaggtgtttaagaagctgagtagctttcaagctgcagacagggataagaagaggcagagctgaaggcactccagagcagcataggaagagggtaagagttaacaatctgaagacagaaaaccctgggttctaatgctggtactgccacttattaaggatgcctcttgggcaagtgacatcacatagccattgcaagccccagtttttgtacatctgtaaaatgggaaaaatacagatagtatctacatcataggctgatttagaggattgagataatgcatataaagtgcttgacaccatgtctgacacctagcaaatacccagtaaacattcagttttctcattgggtcatgataatggttctggcagagccagctatggacagcagaagccctcagtgtgggactcgggagccccttcagcagtccaggtgttctccaaatctatttcaatctcctgggtgcagtgctacatttcccaggatcccttgcagttaaaataccatgtgatcaagttctggccaatgaactgtgtgggtagacgtgatgtgaatgacttccataactacccctacaaaactacccctcatgatccttacttctcatcccctatcatccggacagatgcagagggtccagcagagaccttcaggggcccctagaagatttcaggtccacaagtgaaaggagccggggtctttaatgactgtctgaagtgtgtcttcactgcaccctccacacacaccatcaatggtactttgtatgagcaatacgtaaacttctgctgtattaagtcattgacatgttgacctcttgttacagaggtggcctagctgactaatacacagtttatcaaacctcaagatggactcacaggtccctgttgcctcaatgattccatcgccactgcacacaccagagtctagataccataaatatggtccaggagagaaaccagcagcgtggtgtggtaactggcaactggccaggtatggtaagcataaggtaaagcctgcagcaactcaagaaatgcagagggaagactactcgtctagaagaaacaggatggcccagcagcaatattacctgtgctcatagctactggttcttcaggagaacaggaaagagcatggtctcaaaggccaagcatatcagaggccatatctgcctgggatctacccagaaaagtgactgaactgctctgggcttcagtttccacaactgccaatcatggataacaataccctatgttctgtgacatcacactggtatcttcaaaccagccagggcaggaatatttataccataggaattgacgaacaccgtacatagggactttcttctctagaaatcccgttgttaatcacttaccagcacatccctggataaacaggagtcagctaagtggaaggggagaaggaggacaagaaaagagaagtccggcagtgtgaacagcatgtgtgaaggcccagaggtaaaaatcaaaaggtttaacgaaatgaaggaagtcctaagtggctgggtgtggagagcttgggaagatgttaagaggaacctagaaagagggcaggagctggaccttgtgaaaggacttcactaaatagtaattatttgttccagtcatccatggctatgtaacaaattaccccaaaatgtagtggcttaaaacaatcatttcattttgtttatgacttttaagtaaggaattcatagagggatcagctggtgggttcatctccaatctatgtcaactggggttggaggatccacttccatgatggcatcttcacacatatgcgtggtgccccagtagtgtctctctgtctgtctgtctctctctctctctctctctctctctctctcgtatgcccacgcacatgcttcctctcactctcgctcttccccctgtagtggccaacttccctaagaagtagcattcccagataacaaatgaactgccagggttcttccaacatagcctcagaagtcacatagcatcatttccaccacaatccatgggttacaagcaacccatggattacaggggctagctctgccccaaagggtacaacccaagaggatgaacgtgaggagtcgtggttcactgagggcctgctttgatgaccagccaccacattgagcgacccctggtcactgccctctaggaccacctgccaggcacagatccagaaagaaaccaggaccagccctgtccacaaggagctgtctgcagaggagacaggatgcctgtatagaaaatagggctgcagcatcagacggctgctccccacccaggatggaaggacaaacagagaggacgcatcagggaagggagaggcagagaaagctgactagggtaggtagagaaggcttcccaggaaggcggcattcccagcaagatgagctaagacttggaggatggaggaggtggagggttggaagggaaggagtaggccatcactggggccacccccagccttctatcacatttggatcactatggaccacgccaggtcatctccgcttttcccagcagggatgttgatcagacctgggcactctgcagtgatgatcagcagctcaagagcaagggtggctcctgaccgtgaggggtcagcaccaggcccacaagcctgtctgttgcaccagtgcccaggaggggctgtcgactgcagaactgttttctctggctcgacctcacccagaaccagcggcagaaaggccagttatgcaaccatcctcaccacagcctgccagcctcagaggctgggcctggccgccgggcctggccgccaggcctggtaaggagactgctgtggcctgcacagcacaaggccatcctgggccccaactgccactttccatgcaggtgcaagacgctctgctgacaaatacctggggaaagcaggagctgtgggagggaggtaaaaatagcacagttggcaacagagaaggcttttctaagtcctcagggtcctattagtccttgtccatgggatacacatgagctggcactgagcattctctcttctccaaggctcatgcttagaacaggcacagaggcctgggaggcctcttgtatcatgtcaggagctgcacagtgatcagaagttagggagagcgcctgttgcagaggctggatttggaggatatgctggggctgccgtcataaccccacatccccagtgggttctctctggccactccctctacggccagttctgttttctccccatttttggaaacccaaattcttgatgtttctgttattcacattgccattaagaattatgggctttgcactgtgtttttaatttgttgtgtaagggttttacacaaacacagctagatgcctagaaaagacaatgtatatgggcatgcaggctgtgcactgcacaactccagagggcttcattcatgaccaggatgtgagtggcgccctggaatcatgcaatgtggttaccggtattgccagagaggaaatgatgtcttacatgaccccatatccccgggaaaaggccagccatgctaataaagatttgctaactaaccaatttgtctcctgcttccaaatattccatgcacggggtttggcaggcacacggccacaatgcgcaatggcctagaaagagagccatattgaaatataataatgtatttccaggccacggaggtggagaggcacaaggaattgatctttctaaggcaaggaagattcataaccactgaatgagttaaccactaccttcttctgagtgtgcagattaaattctctgtcgcaccaacatccaagtgcgctaaattttaacagacctggaatttggatatatttatttctctttcacagaattcccattcttttactaacacagtttcagagtttgagatatgagcatatctcatgtgggataataaggcatcattccacaccaggttgcacaggcccatggtttaatgatgagacttcgctggtgggtgcaaactttgctggtcccccatgctctcttgaatctgtgtgcatctcacacatacgtacatgtacacacacacacacacacacacacccctctctcaagtttttaaaaacctacttaaattctgcatcctacctccaatatactctgtgtacagtgtaagtgttaataccaaaaatagtgtttttctgctgggcacagtggctcacgcctgtaattccagcactttgggggccgaggcaggtggaccacttgagctcaagagttagagaccagcctgggcaacatggcgaaactccatctccaccaaaaatacaaaaaattagccaggcatgatggtgcatgcctgtagtcacatgcctgcaagtcccagctactcaggaggctgaggtgggagattgcttgagcccaggaggtggaggttttagagaaaaatagtgtttttctccaaaacttcatggaagactgttgacactcagaaaaatgacccaatattgattctgtgcctccacataccccccagcacagagatgtggcacatgtgctgtggttcataaaatacatttatatgtcatctgatgtgaatctcatagcagtcctggagttgtacattgagtaacctgcatgactgtatatagcccactgcctgtcaggtagagaaaaggtgattatcccattttccagcaagaaaaactaagactcagggaatgtaatagaactagacaacatttaaggttccttctcatcctgggaattgacatacctgagaattcagtagtacaaaactctctgaacttgtcaagggacctcacatctctccaggaacaacacaccactcctcttttcagtcctgtctatgtcatcagagtttccctcacactgtggccaggaagagctaaggaggtataaatgaggtgtacagtgtgggattaggtgcatgggatccacagcccacctgcctggatttaaactggctctgctcctcacctgtgtgtgaccctgagcagttactcaacctctctgtgcctcagttttctaatccataagtgaggataataataccaccgaattcactgggttgttgtgaggattatataatacatatagtttaaaaacaaccagacacacagtaatcactcaaagtttgttatccaaaaaaagaaaaacattctcattctctatgcatccattttctaacctgtaaaatgggaatttaaaaggggactacatcacaggattgttttgaggattaaataacagaataaacataaggagcttaaaacaatgcttaatgcatagaagccactcaaacaagtttgttctgattttttttcccctaagaaaatagtaactccaattcccacagaaagacttcccaaaacaaaagtaccaataagtctgaaaataaatgcaagacctgaggaggaatcattgctgttttctaaaaccagtgatagacaggctatcttagagaccggaggttcttgctttacattcattttctgaggtcaggaagtaaaaaggaacatgggtgaacaggcactggtgagatgaggaagaaagaacaggaacatctcagttgctagtttctgttttcaccatgaaaatcattttaaagccctgcctagaatttaaatagcatcatccctggagatagctgttttagtttcattacagtctgtgttcgtagagtacaaatagaaaccttcgtgattttattagtttccatgcaacttaggagagatttgcatgataacatttcatctcctgactttaaaaagggaccaattaaaaatacagcacttgcattgcctgtcacgggaaaatgaaaaggttcacagagttttaaaaacctctgccatatctagtccatggtcataaatcaagtattcagtactacggtggcaatcactattgtctaaatttttagtttattttgtaagaagtacttggaacagctgggtgcagtggctcacacctgtaatcccagcactctgggaggccgaggcaggtggagtacttgagatcaggagttcaagaccagcctggccaacacggtaaaaccccatctctactaaaaatacaaaaaaaaaaaattagctgttcatgatggtgcatgtctgtaatcccagttacgtgggaggctgaggcaggagaattgcttgaacccaggagacaaaggttgaggtgagccgagatcgtgacactgcaccctagcctggacgacagaccaagactccgtctcaaaaaaaaaaaaagaaagaaagaatatttgcaggatgtttgcacccctgaaaagagttaaactatagtacagaagaaacaaaatgtacaagtaagtatttttgcctggattgcagcaagtcctacacaattaccaacaccccaaagctacctggtactctgtggatttgtgaagtgttaatgtaatgtatctgtgacaagttaaaatttaatgcatggctccggtagcataatcgaatcgatgttatgtaacctaagagaactattccagtaagttctgatgtgctggctgcttacggttcagggggagtttttttcggaggttactgagtatttaggaatcatcccttcagacacttgctcttttgccacagaagctgcagttatcttatccctgctttcggcagctggaatgctccgtggaacagggctgagatgaacgttctatctccaaggctgcgttttggggcaagttaaggaaaaggatcaaagtaagttgatttgcatgaccttctctttaatcagatgtttctttttatgttcaacctcaacaaagccagcctatcatagcacactatttatagtctataatctaagatgttctgaaccattcccccacaccaaaaattaaaattaaaacctcaatagtggtgtggctatatcattagaagtaatagtagagtcacaaaaacctatttctgagactttttttttaaatgacaggtttgatggtatttccaatggggcctgtgtccctagattgtaattcttaaatatgtcatcaaagtcaatattgaagttctggggacaagtcaatcaaatttcactcttgtgttttatagtagaacaagaacttctccctggattcactgccctcaataacttaatctttggttctttatcaggtaaaaatgatagttttaaaatctgacttaagaaatggctttatattgaaatcatgaaatcagagaatttgttatatgcatgagaaaactaaggcctggagcctatgacttgtctaagacactgtagctagtcacttgtcatatgtcaaaatcaaaaatccggcgctcccttaacttcactctaagagtagacaccattaaaccagaccccacaggcagaaagagggttgttctcttcatttgtctgctctcaatgtgggcagggcctacatcaaagtcagcctgggtgcttctagaggggctgcaatctttagaggaagaatatcagctgcccaccgagaaaacaagaacgccaccgtaaagaacatgtcagggaaggaaatgtgcccaaagataatgctggtcatctcctggagggggaatttggaggaatgtttttcccttttctcaaatgtttatttataattgtggtgaaatacacagaagacaaaaatgtaccatcttaggctgggcacagtggctcacgcctgtaatcccagcactttgggaggctgaggcgggcggatcacgagatcaggagatccagaccatggtgaaaccccgtctctactaaaaatacaaaaagttagctgggcgtggtggtgggcgcctgtagtcccagctactccggaggctgaggcaggagaatggcttgaacctgggaggcggagcttgcagtgagccgagatcatgccactgcactccagcctgggcgacagagcgagactctgccaaaaaaaaaagtaccatctcaaccatttttaagtgtgtagtacttcacacttaaaaatgtgcatgtttcacattgttgtgcatcccatctccagaactttttcatcttacaaaactgaaaccctatacccattaaacacttccctccctctggccctggaaactacccttctactttctgtttctatgagtttggcaactctatgtacctcatgtaagtggaagttatccttttgtgactggcttatttcatttggctgatgtcctcgatgttcatctatgtggtagcacgtgtcagacttgccttcctttttaaagttgaataatactctgttgtatgtacctaccacaattcgctaatctattcatctgtgaatgaacccttgaattgcttccacctttggccattgtaaataatgctgctgtgaacatgggtgtacaaatatctccttaagaccctgcttttaagttttttggatatctaaccagaagtggaattgctggattatatgataattgaatgattaatttgttttgagaaactgccatactgctttccaccgcatctgtaccactttgcattcccacaaacactgcacaagggttccaatttctccacatcctcaccaacactggtgattttctatttttttttttttacagtagccatcctaacagatgtgactgtgtcctttttgtttaatgcccctgcacggcctacgttttctacaatgaacatgtagtatatttgggattaaggacaaaatataaaatactgaagttaaaaagtaaatcctatggagaaaacagggttgtgaaagaacttaagaaatgattgggttttttttttttagactgaggcaaactgttgagccctcttgtgggctcagctagagacatcattcctatactcttcaagaatctaccacctgatcggctgtggctgccacaagccacaggagaaacggccataattcatgggcagctgaaataattcctctaagctctgggaggaaagtgttcccagatgcaggaaggagaacaacaatgtatattaagctgttgccagctaatgttggtcataaaaatccctagcacttgggtaaggcctttcatcttccaaatctttcctccaagccttagaacacttatctctgagttctccatttgaataactggaggcccatttttccccttccagagccacaaagggtccactttccaaaaccacataaagagaaaacaacgtcaatgtggcaacttctcccaaagaggagcagaattctgctcttggttaacaagcacacaaagaacatctcccacaaacccttccaacgcttcacctctgagccacacaggccgcgtgctatcagttcattccacagaatgtctcgtttgaagagctaaaattttccaaacgtgaactcattctacccactggtagaatgctttactccttggaggtgaagtcatttgacatgatttattcattaagacaaaggtgaggtaactaaaaccaaaatccatccaattagctatttatccaacctctaactctcagaggagaaattcttttttccttggtgtcaacctctccctctacctcctgccctccctcaccttcttcctttgtgtgttttgctctcttttcttttctggtttctttctgttcagcaaaataggggagatgacagcagaggcatacaggagccccagaggaaaggagacccaatgagcaggtgggaaagaaacagcctcctattctaagaagcggctgtattcaagtgatgcaaaaagaggttcaagagcactgtctgtctccctaggtgaaaaagagtcaacacctagaaaatggaatccaactcgagtttcctaacaaaggctctgtaccctacatccaaattcttggcagggcccccaaattacaacccccacgtgaaactgagaagggggctaaaccttggagatacaaggcacgtgacattgataaggaggtgaatttatggcccagcaacagtcaaaagcctccagtcacagctgctgacaagaccgaagagacctcagaaggcaaacttcaagaaacaaccagaatgggtcgttttctgaactctgggcaaaggggcaaagggaaaccacactgtctcaggaggacgaagaacccagggaagccatcagggagaaaaataaagtggccttcatggaggaaacacaagttaaggttaaggtcattctacgtctcaacactgcggacatggaaacaccacccagctctgtcccttcctgaactggatttagaatttgaaatctaccatccaccaaggcttgttctgcatgtcccagacacagactagaagcaaacaaggactagtgcaaacagaaagatctttccaagttcatcgtaaggtgggtttgtccccagtggaatagtggcctcaggagatcataaacacactggtagggtgggcttccagcactggggaggaatcgcacagggcctgaggccccaaagcttccttccaccactgtgaatttatagttccatgcgcttctgcacttgttaaatcaggtcgctatttgttgtctactaatctacaaacctgaagcccccagccagcagaggccactctcgatcccaccccccagccccagttcactcccaaagatgaagacagagaggactgtccagtctctaaaagggaagaaggagcaagaacaagacatggaaccagaaaataaaataaatactcatcttatactcccaacttgaaatgcacatacaggcagcccaacagcctgtagataatttggtttacaatgatatgcaaagatgcagacccatcgtggctgaatagtttcgtacagttagaagtgaccctggaaagaatattactgacagtcttgccttaaaaactcttttgcaaaagacatcatggtcccagacttcagcagttaacagatggaaattaacttcacttcaagtcaaaaacctaaaatctcgccgggcgcggtggctcatgcctgtaatcccagcactttgggaggccaaggcgggtggatcatttgaggtcaggagttcaagaccagcctgactgacatggtgaaatcccgtctccattaaaaatacaaaaattagccaggcatggggcatgagaacctggaatgccaggtactcaggaggcactagaaccctggagggagaggttacagtgagccgagatcatgccactgcactccagcctgccagcctgggcaacacagcaagacggtatctcaaaaaaaaaaaaaaatctaaaatcctatttttcctttttaaaaaaacaccccttccccaagtaaaagtcaactctgataatggggagatctacataatgtttaccttaattacttcttccccaaattgaagtattcctccctattgtgctagaaaccaaaattaaacagcaccaactttccacagaaaccctcaggaatgacagccactaaggaaaaaaggatgtaaaagaaaggatggagcaagaggaggagggggagaaggctggaattcaggctttcctgtgaattcgctttgaaatgcctagaggccactggatctgagtccccaagaaaatctggtagagaggccagtgaaccagcataaagaatagaaaataaaggagatgtgttaaataattttgattttggccacgtgaagaagtattagtcatacaggtaacaagatcttacagggagatgattccaaggctcggcttgacaacgttaagtgtatatccattctgggcctggagtgccaattacatttccaaattggcaattagacacaatgtcccaagacaatcaccaaataatgccaaaaacaaagcaagttccatcttaaagcagccattcttttgaaactgcccttccctcccgtgcctgactcatccacctcacaaacaactgcccattatgaactaaatccttgttagctactgatcaagagaaaccaggtggcatgaataattaaaatccacgaatgattcaagcaccatgttgtcaacaaaccaagcccatctctttcaccaggagtttctccatagcatctaacaaattacccaaaaaagcaggaaaatatatttgccacccccaaccaatgcattctcgttcagcccccagctaactactggaaagagccttccaacatctacgtgtgtttacatttgcatgactcagttcctgccctcaaggagtttgcaggcaattcagagatcagatgttcatattccatgagaagataactgttttttcctctgctcagcctgtcaagtactaataaaagccctaacaagcagggagtcagaactgggtcttaattatttttcccccagcacctagcttggtttctggcacatcgtatacacttaatatgcaacaaaagcaaaaacaacaacaataattataaccagaagacttctttgagggcctactgtgtgcaggccgccacgatgctaggtccttcttcattctgcctgctgcagacactcatggtgctcccctctgatgatgaaacaacataaaaagcacatctcatggaaaaagtccctgacagtgtgagctgtgaaaaaccctggtatggtgagaaaaggagctactttcactttcatcttctggaattcttaagaagtgcattggagggccacacagcacggtgccacgcgtgtcccccagtcactccacgggcagctcttcagccaattctttgaggttgaaccctccatttgggaaggcccacccaggcccctacagaaaatcaggctggcagtcttaatgcccactgacttcaaacactccagagggagtggtccccagccagcctggggcatcaccgcagtgcagccctggtgacaccaccagcctttaattttgcaaggaggtagtttggctgggttgccctcctggacttcgggaagtcacaccctttgcagaatgaccaactggcacgaggaagagcccacacattggtgggtaacacacagaccacaccctgtaaacactgctctggccaccacaacccaaccctaaatccacaacgctgatgggttccttaggagcaggcacctggaccatcagttttcgcaaataagagcccagcccgaaccacagctaccctggtctgaaaggagttttctccacccaacgatctggcagagcaaaccttctgcttctcatcccttcccccttcaagagctgggaatttccacatttaaaaataagcctgtcttcagggatggactgcacggaggctgagggatggaccagatccttgatactcaaagtgtggtctgcacagcatcagtatagcctgtgtctcgccagaccagcataatctcaggtcccacactggatcttctgaatcacagcctgcattttaacagctctcggtgattcctgagcatattaaagtttgactaagccaggcacagtggctcacaccactgtgggagcactttgggagaccaagatgggaagatcacttgaacccaggagttcaagacaagcctgggcaacatagggagaccccatctctgtaaaaaatttaaaacctagccaggtgtggtggcacacacccataagtcttggctacttggggagctgaggcaagaggatcacttgagcctgggaggttgaagctgcagtgagcagtgatcatgccactgtactccagcctgggcaacagagtgagaccctgtcccaaaaaaaaaaaaaaaaaaaaaaagtttgagaagcccaggcctagagacactctccagtccttggagataaagatgtgatattcccactgaacattccccaggttttctgtccaaagtgctaggacacccttgcctccgagggtccctgggtttccttttctaggtgcctaatgcgtggggttccacccacccaagaagcagttctaaaagagacatccttggtctgctccctgactgtgcacagaaaggcatggccctgtctgatccccagggatgtctccaagggacccagtgttccccacacggcccagggcctggcatcacagcacaaacagccctttcactggaaccacaaaggcgaccttccaggggatctgcagcttggcaaggtggtattggctgctgtgattcacagattagcatggtcactgccagtgtgagccgggacgcccactttgggaaggaggtcctggcattgcaatcgaatgccaatgtaactgtttctgcaccaggcctctcatgccctgatgagagagagagaaagagagagacagccccaaagcaagcacttactcctggctatcagccaccaatgaatgtccccatccagggaacaaaatagctgtgaggcaaagagaaggtccatttggacttaccattggaatgctttatcccccaggccaaacagcagggggcaggcagctcttcttttcctcctgttgtatgtttggtcaagtttcctgggcacctagaagcagggctagcccaaggctcccaaagggaggccataggttctcagtgtcctcctaggaaatgctataaaatggggttggtgaaaaaaaccaccccatgaggctgtgctctatcacagacctcaatttgcaggtgaggaaactgaggcacaaaggcatgacgtctttgcccaggatcacaggctgaaccttgggcactgcacagcacccctgacactgaagcaagactgctcacaggtagcacatttgagggcattttaaccactttctctaccagcaggatgccgccaagcctgtgatgtggccctccaaaggggaagctcagccacgccatgcctgctgattttttttcacaaggtaatttaaaaggcaggtgtgccacagaacacacttggggaaacctggcctagggggtgtcttggaaaagctggtctgggtagacagtgagtgtcctggccaagagaccgtgacatcacttgggagacaggtctatgagttctggacttgggataacagggatggaatttgtccctcctcaagggtacaatgctggacaaccatacctgcccaccaaatgccacagtgtttcccttctgccagcccagcagctcctggtcccccatactgtcgatgttcgtccactgataccccaccatcaaaactgtaaccatcctgccaggaccccatccgtgaagcctacctctgctgccctgccctaactttccagccttgcaacagccaagagccataagcccatgtctcagtctgactctaaatggttttttgatctatgacagtatacttcaggatctaaagcctccttttggctcaaaaactttatttgttatagtctgcgcccttcaggggctataagttcaatgaatcaaagggaaaataaactcagcacttcatgaagctatgatagttaccacttacaagaggcctgctaagtgtctggcatttgcagggtgctatgtgcccattattcctgctccctataagaaccctacaaagtaagcatcagtatgctcttggtataggtgatgtaaccaaagctcaacatggttggcagtcaaagatgccctgctaataaatgtgagatccatgatttgaacttgggtttgcctgattgcagagtcttgtactaaagtgtgcatttccataaagagggccaggggctggacgccgtgcctcacgcctgtaatcccagcactttgggaggccaaggtgggcgaatcacaaggtcaggagatcaagacaatcctggccaatgtggtgaaaccccgtctctacttaaaatacaaaaattagccaggtgtggcagcgtgcgcctgtagtcccagctacttgggaggctgaggcaggagaattgcttgaacccaggaggcgcaggctgcagtgagccaagatcgtgccgctgcactccagcctgggtgacagagcgagactccatctcaaaaaaaaaaattaataaaaggagagagagagagagcaaggaatgaggagcacgagctctctggacaagggcaggtcagctggagctcccccgtgactaggacccaagaactcctccaaggccaccccaagtgatctgctcaaaaaggagtatctcaaggtcatctggtgcagccaatccccaggacaggatgagatgaggcacaagggccaatctggaatcaagagctccacggcactgaagctccagccctgattgactgcgtcaggccagaccctgggtaattaccaagctgtaatgggatctgatatttatattagtcacgagcctgacagagaaaacgtgttgttttctcaggcacagccatggagacaacatctcgataattcattacacgcagaccatccttgatcaagcccaagcttctacaaggccaacagctcaaactgagaatggaaataactctatgcccagccacactcaggcccctcaacaaaccacagctccaacaggaagttggcctcagtttccccagttatttaaagagaagtagaccacatgctggaagacgagcagaagatggaaataaagatatgtaactgtcccaaggctgaattcctaaaggaattgctagggaactgcaaaacacattctgagctagaaactttaaccctcattcctcaactcctccctctctcctatatcgaatcacagagcaggaagggacattagaactcacagaattcaatccccacattttatacacaaggaaagatagacaccagagaggttaaataacttcttcaaagtcatggctttattcaggctaccagagcagctccctattcaatatagtctatgacaggattgaacttcacaacgtcacacccaagtgaatagagagctctgatgaaatcccacaaggaaaaaaacaataatgtgaaaaagtacagcaaagaacacagtactggaatgactgtgaccaagttcccaacaggaggaaattgtaatgttttcttcttcactttctgaaaaagtccacatgccactcttttcaaaagactaaagtcattcactgtttgagattcagaggccaaaggtactaatgaagagatgtcccacgatgcatgtccacagtcttgggttcctttgatcaaaaaggtttggtgcgatcccagagaccaaacgctcatgaaattggagctccttgctgaattttatctcccacagaatttcagacctgctttcctctggactccagctcttgatcaaaccatcttggggctgaaggagggtgagggtgaacccatctgagggctggtagaattttctggaaaggcagcctatgttttcttgggaaatctagcacaaaaattattattctaagcttaagccaaatacatgcctgtgtatcgagtcttgacaaaactaccaaatacttggaaagaaaaaagaaaaaaagacaaacacacacacacacacacacacacacacacacacaattgcaataaaaatacagacctcaagcatagaaagaaaagcttttaaaaggcctaacttaccgttactgcatataatgagctggctacctatggcttaagtgagcaaatctaggggcaggtatcaagagattctaggtgtgctttaaaatggacttacggtatcaaaaggaacctgcactcattctatactggcctcacatcttccaaacaaaccaccatcacctctcatccctggcagatttcttacagcaactcacttccagttatgtccactcagcaggtcttggggctacaaaacatagccaaatatttacgaattgttttttctaatcgttgccaaaaacctattttcttgagtaaactgacagaagttatgcttgctcatcatttaggagatcctttgtgtgtgcgatgggattagcatttcattacagacactgcaattgcatttatgtaccccctaacataaaaagactttggaagctgtgtttaggaccccaggttcacaaaaacaccacaacttattttcaatcatggaaaaagttttcattatgataaaaattgccccctgcctgaaagaaagcaagctgttaaaaagttcacccagatcactctatctagggaacatttcagaggcacacaactatgagctatctttcccctaaagacagtcgctgaatctcagtaaaccggggaacaaaattcccgagactgttgggggaggtggaggagaaggatggagagagggaatgtgggaatttgaaggctccaggaataagctgttctcagcaggaaggctagtcagggatctggtgtatagggctttgcttaacctgagggcttctctggaaggtgggaggtttgcctccttaacaaataagaagaaacctctacggctgagaaggtaattccaaagaaaactctccgaccagcacctgcaggcctccggagaagccagagaatgacgaagagaatgatggttttcatatttctccctttgttccaatacaccagtattttccaaaacacaaatgtgctgccacaaaacacagctgagctccagcacccaacaggatgtataattaatgatcaggagagacaggctccttcccccctggtgttttcatagccagccttcacccatagccccaggcttccctacttctctcagccgccaaggaggctgctacaagttgctgtgccctgtagaagtttgaggggtcctcggtttaactttactagaaaagatgtgaacatgtggaggctgcaatgtgtatctaccctgcactattcccctggatttcccttccctccaaaacggttcgcgcgtgaagtcccctaggatgggaattactcagaaagaaggcagctggctcactctcttttttccagttctttcttttttattctgcagttttctatcagtgtcgggtcccccactccagccagtggctgtggggaagggaagacatctctagggacacgactacagaccaggcagtgagcctagcaaccatacatcgaaggtgtcgccagcctcagtgccggtgggcgtctgcaccaggaatagctaaagccgacgacatctagccacctcgagcgccagggaagacgctccgcgtaaaaccgcggcctcaggcggactcccgctccagctccgcgctgctggtggcatttccggggacccaaagtgggtggcctgggggcaaaggaacagaggccgaagaacttggggtatgttccactagagcacctaagggacggagtgggaggttacatcagatatgcgacctcgacacattccaaaagtggcagccccgtgggctacccccaatagtgggatggatctccccaacttctctcgcccctcgaagtccccctgttatctcgggccatgctcctcccccgggattcccttgtgcaaaattattctctcccttgcccaaaggatttttcccttctttctgaccccacgaactcatctccccaacaggttcctaaagtatgggcggatgtgctccctctcgcccaccgccaggagccgagccccggcaggtgagcggtgcaaaacacgcacccagctgcccccagcttcctccgtccccgctgagttggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccgcccgggggggagggggatggagtgcgcgggcagctccccctccccggcccgcgccccgctcgccccgggctgcgctggccccgagcgccgagagccagggggcgccgcgggccgcccgcgcccggggtctgcgccgcccccgggcccgccccggctccgcgcgcggtcccgggtgtcctcggcgccgcgccgcccgccgtgcgccacgggtgtgcgctgcgctcggccggtgacccccttccccgagcgcctcccgcgcggctaacgagccgctctccgcttattaggtggtaactcgttaataatggataatcggccccctccgcccgggcgcccctgcgccagccctcctcccccggctgcgctcggctccggctcgccgcgccagtgcgcgcccggccgcggcaggttcaccgcgtccggccgccggcccgtggccgcctgctagcccatgttctcgggaccccctagtcctgtcgccacgccgctgagcccctcggcctccgctcgctcttcctccttgccgcctccgactcctcctcgtccccgtcctcgccgcccaagcctcttcggcgcgcgccccgcgctccccgcagccgccagcagcagcagctgcagcaactggagcgggcgcggactcaggacgacccaggcgggaggggaggaggctcgccgcgctggctcgcctgggctccgggctgggcaggggtgggcagggcccctcggcagcggcccggcaagcgcccctgacccccagggcgcaaggtagagcgcccccagcccaggcgcggggccaggcgcctctctccaaggtgctgcgcccccagccgagagcggtggggtacactgggaggacggcggggcgccccggtcaggccgtttttttccccaaagagcccccagtggggaggggaggagtggccagctgtcaactggattccacaggctgagctccccaggaccctcgggcttcgggagtgaggaggaccccacgccaggatacacacagctacccacccctacttcgctcttcctgctacctatgtgcccagggtcccgcgtgtggctggagggtagagtcaggaaggccagcgggtggtctgtggcctctgacagcagcaggtggtttctctcctttttccttattagcaacagaggctgcccaacaaagagtaggcagaaatgatcaaggacgacctggcctggggatagtgcaggccccgatagacaatagagttccctgaagggttgctttcctctcatatagtctcagactccatccatcccgtgaggagggcagatgggggaagagggactccagacttcattctggctcaccgttccccatttagggtcttcccttctccccacttaagatgaagaaggagtccgtgtttgttccgtagcgtgtctccgtacaccaccaggggaatcccccttctgacactttcagaaactttgcgccccctgaacagcgtccgtcctcgtgctaccagctggaccccaagtttttccagcgctaattaaatcgaggatgatcacgctcttccctcattgctgcagtggtttccccaaagtttccagctcattagtttaagcctaattggaattctcaggttcctttcagctcttcccatggaaaaggcccaagttagcatccttagctttacacctgaggctgtctccgtgagagtcagatcagccctgcccttgtccttggaggtctctggaaggaagagcgagcaagggaggctgagctgggcagagaggctgaagaggatgtttgaagcttctctcttgcttgattcggaatacattcattgggtttagagtacacatccactaagaaagagtcaaggccaaagtcaaaggagaaaatggaatgaggtaagagttcttgagtatttggttctcaaaaagaagtgtatgtaaaagggagctgcagaaagtgtgctccagaaaatggaattgtctgagcctcctctccataccatcccatagtacctccaacctcggcctctgtgttcagccactctgaatgcatccctgccacaccagacccaagcatgcaaaggccctgggccttttctggtactgggttgggggagcgggacccagaagtgctgtggggatgcgcaggaaggtgactatggcattgaggttcctttattagcctctcaatggctgtagtttgctgcttttgtgcctcagcaatgccaagaaagttaaggacattccttaaatcaaggccaagatttgaaatttaaaaataaaacacccagaacataaaaagggcagcaaaggataggactgtctccccagtgggatatgaaacctccagaatggattccctcacccacaaaattgaaattttgcaaaccagcaaatcccctctggggccttcttagacattccctacagcctggattcccctgaaatgccagtctggggtctactggtaagcagccgatggccgtgacttctgtcaccccaactgcaggatctatagctttttctcctccatcatcaccttcatcacctcagcatctttggagagggtgcttggaggcccctcagatgccatctcctgctctcttcatcacccctgcctctgctgattgaagcttttagcaacttctgtgctgtccaaagcctcggcttagtcaggaatcatcagaaactctcagtgttgatgtcaatatcctttccttcctacaatccccagtctctcacctcctccctgaatggcctggctggtaagcactgagagagtgctaccatccaccagaaatagacattcccaggcctttgcccagttctctctggccatttccacattgttcacaaacttttgcaccacttccagaaaacttggcccctggcattacaaatttaggaaaaggctctgcacagacagaacctcaaacttaaaaggaaccttaggtatctttgatttgatgtgtttcttcatttatacaatcaaaataaagccagaaacttccctgcctacctcgaagggttatatgtgaggatgaaaaagaaggctgggcatggtagctcactcctgtaatcccagcactttgggaggctgaggcggtgggatcacctgaggtcaggagttcaagaccagcctggcaaacgtggtgaaaccccatctctactaataatacaaaaattaactgggcatggtggcacatgtctgtaatcccagctactcgggaggctgaggtataagaatcgcttgaactcgggaggcggaggttgcagtgagccgaaattgcaccactgcactccagtctggatgacagagtgaaactgtcagaaagaagaaagaaagaaaagaaagaaaaaagaaaaaggaaggaaggaaatattatacagatcttaactataattactgtgaccccaaaaatggacaggcaagtctaaccagatcttctgacccctgagctcgtaattgtatgtgcacatgcctgcatgtcatgctgtccacagcatgtccacagccagactgtggccagactccagggcacagcagagcccctccagcctaaatgagctctctgactacccaacaccactccttttcttgccagtccctggacagccttggaaatgggaaaggtatagagaagcactctaagcccagcacatcttcccctaatgtaggtgtgtctgcaggctggaaattgaggtccattgcacaagaactgaaagtctcaacagaagtagaaacttcaccctctgttctgaaaacaccacgagccttatttttatttctaaattcattcaaaagcttcccagagagaagggcagcctctgtaccatgtgcatgtgtgtctatggcagctctcaaagcaaatcagaggtttcaagcttaaatattctaatctgaacagtcctaactgatttaaaagaagtaaaaggaagtgcataaacatacatactaaaaaagcagagtgactaaggtaaaaggagaacaaaaaagattatttgctaaaatgttggccagcatcgcaattaatgtgcaatggattttcttttcctccaacctggacctagttccaatactctgacatcaatcttcgcgattttgcgatggagaagccaggtggtgactctttaaatgatctagcgccctctggtggattttcctggcacatgacattatttcatgaatgttcaaaaaagggacttaatttaacagtctgaaatttgagatatgaaaattccaagaggaaaaccctgctggaaaaaaaaaactacagggagtaggaaggaggcatggatcaggaagatgttggtccaaggatacaaaaattcagttatacaggaggaataatttcaagagatctaattgtgcaacatggtgactactgtggataaacaatgtttttttgtatacttgaaaaccactgagagattttaagtcttctcatcacaggtaaatgataagtatgtgaggtaatacatgtgttaatttacttaagttagccattccacaatgtatgtgtattttgaaacatcatgtacaccataaacacactttttgtcacttaaaaaaataagaaaaattgataaaaaaacaacaaaaccctacagcttcaacagtatgaattatctagttaccagtcctaccagcatataagctgttgtggataaaggcagctaacaaagttcatgttattactatgacttgatgtcagatctcaactgttactgccaccagtaaccctgcccttccttgaatcaccactgtgttttcttttaaagtcagcagtatccctctttctaaccacccttggtcttcacagtctctttgtgaagtaaaaaagtgcagtagtggccaggcgcggtggctcacgcctgtaatcccaacactttgggaggctgaggcgggcagatcacctgatgtcaggagttcgagaccagcctggccaacatggcaaaaccccatctccactaaaaatataaaaattggctgggcgcggtggctgacgcctgtaatcccagcactttgggaggccaaggcaggtggatcacgaggtcaggagatcaagaccatcctggctaacacagtgaaaccctgtctctactaaaaatacaaaaaattagccgggcgtggtggtggatgcctgtagtcccagctacttgggaggctgaggcaggagaatggtgtgaacccgggaggcagagcttgcagtgagccgagattgcgccactgcactccagcctgggcgacagagcgagactccatctcaaaaaaaaaaaaaaaaaatagctggatgtggtggcgcatgcctgtaagcccagctactcaggaggctgaggcaggagaattgcttgaactggggagatggaggttgcagtgagtcaagatcgcaccactgtactccaactggcaacagagcgagactctgtctcaaaaaaaaaaaaaaaaaaggctgtagctattttcccactttacaggtgagaaaactgaggcttagctctgccaggttacttggcacgacaaggaaagtctgttacctctgaagtgatttatctgtttgtaatttataatgctggagagtgggacttacagaacaagctttcacatgcttacatttttatagatatttattttatatttacttctgcttgtaagaataattcatatgtattataaactttggaatataaaagtttcatataagcttcaagtcagtgacaagaaaaaagaatatgtcacatagaatcttaccaccccaaaataaccactattaatatttttatatatttatctcataccttttccttgggtgtgtatttctgcaaaattagggttagattaaacatctaacttttatcctattttcccttaacatgaaactgttagcattttctctaagtcattaaatatcatggaaaacactattttaaaaaatgataattggataacatttcagtagatggcatactcctggcatttagatgattccaaagtttaatatgttttaaaataaattataaaactgtgtgcaaatgacttctagttgtcaaaaaagatgtccagaagatttccactgacatgcttccatcctgtctccagtgcctcgggagagcaggtgtgtgtaggaaagaggtgcctgtggcagtcagtctggccgtgggatacttcccagccctgccccaggtcactggcctcagatcagccaattgtgatgaagaagctttgagccagggcatgttacccgcaaagtaattctcttcttttctaacacatcaaagccagtgcattggaagaaaataatgctgtggtctcatcgtatcctcctcaatcattgcgccacctgcctgccaagatacaaacttgcaagaacatcatcttcattccccaaaggacatccatggctaggtcaaagaaggcacagctcaggcacaatgccctgcctagaattcacctttcaccaccattctgcaggatttccagaataacgattctgcagattcctgtgtccctttcctctctgtgatcagtgtcaccccccagcagaacaccactactgtgggccttgcctctgggaggtaggcagggcaaaaatcagtccacccatttttgctagtgggagaagaaggcaccaaaaggaaaaagattttcctcagtgctacagaacttgtcttcctgactgacagaccaaaaagctttctaatccttttcttagagtattcctgatttaatctttgcaaaagctctagttcaatgcctgggcagtccaggacttgacttcttactcctagtgctccaaaataatccaatgaccgcaatctaagggactgtgcagatgaagcagggacttactcctgcctcttcctggtagcttttgcaatatttgcaagtaagaacaatgctgagatcatccttcccacttacaaaccctcttgggaataaggagagaagtcaggaagtacaacatctctaagagtttcatttacttccaattctgacttgctttcctggtgtctgcttttgtcataatgttctccaaaacaaggtccctttgtttcaggaaaataagtcattgtaccaaaaaaatgcatgcacttttatgttcatcacagcactattcacaatggcaaaggcatggaatcaacctgaatgtctgtcgatggtgcactggataaagaaaatgtagtatgtgtacacagtggaatactatgcaaccaggaaaaaaaatcacattctttgcagcaacatggttgcagctggaggctgttatcctaagtgaattaacacagaaatagaaaaccaaatatcccatgttctcacttgtaagtgggaatcaactctcgggttcacacagacgtaaagatgagaacaatagactcacactggggactccacaaggaggagtgaggaaggggagcaaggactgaaaagctgcctattgggcactgtgttcactgtctggatggtgggatgaatagaagcactaacctcagcatcacacaatatacccttgtaacaaacctgtacgtgtaccctcaaatcaaaaataaaaatggaattttttttaaagccctttgtttcacagtggcctccctggaaggtgcatcccttcttcagccttgttatcccacagttgccaagcaccctgcttcccaaagatgatcatttgatggtttaaaaaattataaaccatgatgcttttatgaaaggtaaggctctttctgtgaaaccaggaaattctgcttttgctatatttttgcaaagataaacatttttttttttcagagcaggagtgaaagtttatttaaaagctttagaacagtaaggaaaggaaggaaaggaaagagaagaaggagagtacaacttggaagatggtcaagtgggcagcttgagaaaccaagtgcatagcttgacctcttgacttggggtttcatatggtttggctgtgtccccacccaaatctcctcttgaattgtagctccctcccgtaattcccacgtattgtgggaaggacccggtgggaggtaattgaatcatgagggtgtgtctttcccatgctgttctcatgacagtgaataagtcttatgagatctgatggttttataaaggggagttccgccacacaagccctcttgcctactgccatgtaagacatgaccctgctcctcattcgcattccgccatgattgtgaggcctccccagccatgtgaactgtgagttcattaaacctctttcctttataaattacccagtctcaggtatgtctttattagcagcgtgagaacaaactaacacagggttttatactttggcctacttccaagatcttgccttaaccctccccactcctgagatcttattgggaagctgctgatcagtttcagctgttttctatctgtcaggagactgctgttccctggctctggctgtgaccaattattactttagagaaacagttaaccccctgaccatcacctgatggttgcccaccactcctaagtgtgttgtggggagccctctcctgccttgctcatacctgactggctacctactataacacgtcccccctcaagagtccaagatcctaaacctttgggggaaaatggatgaaggtcagtcttctgcaacttcttcctgctgacagaggggcggtggtggttctgtgggtcttggcctcttgctagctgtcagggccgacttgggtccatgaattggtgaaagcggtatccagccaggtctaagggagacaggggcaggattttgcctctgtcgtgtcccactgatgaacaatctagaggttccctttagaaaggtgactcttgaatattgagaggacaatatctctcactgaggatcatctggagcttgatgtcctttccccttaaagaggaacctcagatctttcagggccttgcaagtgtattgaggagctgagggcattgcttccaactctggtgtcctgaagccttttcacggcttcactcgggtatgttgtatccagctggcaatctctagtactttaatggccctgggggtaaataataaaacagtgaaggggtccttccagaacaaaaacccaatctagcagtgtcctgcaaaaaagccataaatacagaccaataaactggtttctgggttcaagagggaagttcagtaaaggtcctagtagaaggtgcttaccatatttcagcagaatgctgttagagtcccagaatgtaagaatcaccattctaggaatgctgcctggagccaggaaggagaggtagatcctcacctttggctagaaactgagtctttgagtctcccaccagggaaatttccccagtggattttgcgtggacatctgactaatccagaaagagacctgaaggtgggagagaccctgccatcttcctggccattctagaaagtccaaacacaaagagaaatgacctcccgtttctctgagcactgcagccactacaatttcgtagcatccacagagtgcctcgccagctctttctctctgaggacctctgacatgggcttatttaagcgcaaactttagatgcttccagaaagatggcttgcctacagcactatgcagctggaacagggagactgttagaggcagacactgcccagcgtgtgtctcagacctcccttcagaaaaagcctctgtgagctccaggacactgtgctaaatgcattttctgcaagatgctacactgaattgaaagcgtgcaaaaacatccttttggttatctataaatttcattttgttcttctctcctaataacaaaattgaaagctgtaagttgaacaaagcaacctgcaaactgctctagcagccctgggaactccctgggtgatatatggtcatgggcttagagcttttcatttgacttgctcttggcttttctatcaagatctgtcttggtgacactctactgagatagatgagttggtatgcataagtggcttttatttcagaaggtaatacatattctatttaaagtacaatgacccagaagggaattccagcccctttatcattagtatagaaattcaatggttcataatctggtagctcattgaaatgacttttcattaacttcaatggttcataatgtggtggcccattgaaatgatgttccattaaattcaatgggggatattatttgagtcagaaccaatttacaaactaaacagaatgcaggcacacatcgcactgcccagagggctcgctcggctctctcttccctgggtcttccatgaagactggtgagatcagcactgcctgggagctgaggtggtaggcagagaaaaagcatgtaggcagggcatgcccttccttctaggggaataatagttgaggccagagaccataatgggcaatttacatgtcccaaaattcaatgcacatatttccctaatgcttagaccaccttcacaattttgaccatatcgtcatactgccttttcaattacttactaatatttgtcttcaatagactacttttatttacctaaatttatttcaaaaggaaattctataccactatcttcctggaaaaccaacatcactgtaagtagcaggtaaataaatacagtagtctctcacttttctgcagggcataccttcccagaacccctgtggatgcctgaagccacagatagcactgaactctacacacagtatatacaagtttttccatctgataaccgagaacactgctcaggtactaacaggcaggtggtgggtggtgcatacactggacaaaggaatgatttatatcccaggcaggatggagcatttggcaagagatttcatcatactactcagaatggcagcagtttaaaacttatgaattgtttatttctggaactttccattgaatatttttggactgtggttgaccacaggtaactgaaattgcagaaagcaaaacctcagataagagggggactactgtaataataaaataaaaataaataacaaatcaaaatataaatacattagaaataaatagaaggcaagtgtaaaagtaaatataataaatgcaaacaatgctgtaaaatcagagcttgctgttttcaggtgaaagccctccatctgaagcctagactgcctttgctaaaaggagaaattggtaagtgttgtagagatgttccaggcacaatgaccatctctgtggcaatcaggttagagagggaattgggcagggcatgactttcccactgagtgccaagaccggagtataagctcaaatcatcctttgtaccgcgtggggtcaagcagcctgcctttttggaagcactgctttcctactcgttttaattcttacacgaggctgggcacagtggctcacgcctgtaatcccagcactttgggaggcccaggcaggtggatcacctgaggtcaggagttcgtgaccagcctggccaacatggtgaaaccccatctctactaaaaaactacaaaaattagccaggtgtggtggtaggcacctgtaatcccagctactcaggaggttgaagcaggagaattgtttgaacccgggagatgaaggttacagtgagcaaagatcatgccactgcgctccagcctgggcgacagagcaaggctctgtctcaaaaaaaaaaaacttacaccatctcctaaagtatcacccccactatacagatgtggaaactgaggctcaagtaagttaagtaagcaacttgtccaaagtcacacacagagtgtcctcaaggtcagtgcacagcattatcaggggtcactcagccctctgaccctatcgccatctgggccattataattctagaaggaaaagcacattagagattttgtctgacttcctctttttagagtgagaaaagtgcagcctagaggtgtttaataacctgcccaaagcctctttgttccccagcgactgagctgaggttagaatccttatctggtgtgctttctgtcctctcaaagtccacccggccagcagatgagcctgttgggagccaggcaggtggtaaagtttcctcaccatcctcctttctgctcccagcaggcctaggaaatcctttcttgctgacctttctttcaaatgctaatctgggcctctgaggctggggtgggggggtgggagggggggcctttcccccattgggagccccactgccaggtgagcccatggctgtgagtcagcacagagagcttcagaagtccctcactgatggggggcatgcagggagtgtgccccatggcatctgggcctttgcaaagcctgtaggggccggggtgccccattagcccaggagatgcccctgcaggaggctttaaactcagcaggtgcacctcacagctcctcggtctcagacacagcctgaggtcaagacagaagctgtgaagaagctctgttgggtgagccctggggctgcaggcaagccaggacctttggaggccctgggaggctggcaggggtgagggagaatggcaggtgcaggtgccatactgcacctttgggaagagcaaaggtggtggggtgagcgggtcgagttatgagaaagttcacagaaacaaaagagggggtatgagagtagaagtgggaggacagagaaagagaaggaagaaaagaagtaaaaaataaaaggaaacagagagagaagaaaaagaaagagaagggagggagggaaggaaggaaggaaggaaggaaggaaggaaggaaggaaggaaggaaggaaggaaggaaggaaggaagaagaaataaataaatagagagacctaagaaacaaggcagagaaagggacatcacctgtcccagccagtggcctcttctgagttgctccacttccctaacaaagcacagagacattatgcctgtaatataagggggtccaaagtgcccacagtaagaaacaagtattctccccttaaaggaaaggcacaggatcctggtggcaaatttctgacaagtgagctccccacccccaacacacacacacagacagacacacacacacacacaatggactgtctcctttctcagagggatacatgcttgagatgctgggtgtacctgcaaagcacaggcctgggaagcccctccaacacagatggtcttgtcttataagtgtcagggtttgtgccagctgaaagggagcccggacttctgtataggaggtgaggacaagggcagaatctccttcattgtgtattcttttctcatcacccagaagaggattaatcatattaggactcagcagaaacaaacgagaagaagctgcacatggccaggcagtgcctcccatccccaggcagtgcctcccatccccattagtggcctgcgggaggaactttccatgggaatcccacccagcccagcctccttgcagggcaagggcccaggacactggtctctccagctgactgcacagggctttaaagccaaggatgaggcaggggaggagagggtctcagtgtaacacattctactctaccctccagggctcagttcctcaattctacaaaggaaaaaatattaggtgtttattaggtaaatatttattaagcacctaccatgtgctttgtgctattggcaatttctataaacagggttttcccatccacagcagctctccctaccacatgagagggtccctggaggagcaaccacatggattaaatatttcacaccatgagtcaatggaagtgctagctcagccctcaagttgctgcatgatcccactctggagttccatggagctgggttccaatttcagctctcctcctctctcaggctgcaggctgtgggttaggtttcttagcctcttgaatttcagtttctccatctatatagtagagagaataacagtgccttctcagtgagttggtgtgaggattgaatggaagaatcctggtaaagctcttagttagcacagtgcctggcacatggtgtccttttgttggcctttgctacaattaatgaaggcagaagtgtgattatataaacctgtacccactttctttgagtctccatcctctgatgtataccatgaggtactccctgcaacccctttagtttgaagccatgctattcttgtctttgctcccctatctcaacccaggaatggtgatattcttgtttactcgcctttgtttggtgttcaatgctgtctctccttcctgtgatggaaggattgttctgtccttttcccccttccagaacctgttctcatttccgttctcccaaggccagctgcagcctcttgtctcaagaatgtatatcttaacaacaatgaaaatcctcacagactcataatcaaaacatcttggagaggatatcttagagaaatgaggtacctttccaataaggggaatgaggatctttggtgtctttttgtgggtctttcatatcatcaacaaatacaagtgtttgttaagcatctattacacacacgcaaatatattaattaccatgatttaaaaagggagaagacacaaatcctcaactcaagatgaaaaagattcctaaagataaaggctcatttaatatgaattcacaattcaaaatttcaaaacccgtgaataaataatcacattatgagcaaatgtcaataaatagaaaaaaagcaaaatcagataagactgccaagaacttgaagtaaatgaataatatgatagagaccacaaaactagtaagtgtaaaattattagacataaaagaaggaatatgaaatgtaaaaaacacaacagaaaataaaacagatttggaaaagaaccaaatagaacttatggaaatccttttacggccacagaaattttacaactcagcaagtaggataaatagcagattagactcacttggactgtaacaattaggccaataaaaatagatctgagaaacataatcagaatgtagtatatacaaagaaaatgatagaaataagaacacaggcatggctcttatttctatcagagaacagaatgaaaatagggccaggcacagcagctcacacctgtaatcccagcactttgggaggccaagccaggcagatcacttgaggtcaggagtttgagaccagcctggccaacatggtgaaaccctgtctctactaaaaatacaaaaattaaccatgcatggtggtgggtgcctgtaatcccagctacttaggaggctgaggcaggagaattccttgaacctgggaggcagaggttgcagtgagctgagatcatgcccaccgcactccagcctaggtgacagagcacacctctgtctcaaaaaaaaaaaaaatgaatgaaaatagaatgagaaaatctaccatacacctaatgagagttccagatgaagatgatggagaatggggagaagcaataatcagagataatggctgggaagtaaaaaaaccagaattcatagattcataatgccacaaattttaagtaaaataaataaaaacccactttttcatgccttatagagaaatcataattcaccaaagccaaagaataaaatttttaaagtaacaagagagaaaggagagactacctacagaggaatgacaattagacagccaacttctcaacagaaacaactgaaacaagaaacaatggaacaagatcttcaaagaactaagtgaaaattactgtcaacctagaattgtaggctgaacacaaagtgtttttagacaaataaaaactaacagaatctgtcaccaacagactctccctgaaagaatttctaaaggataaacttcaggagaaaagaaactgaacccagaagagtaataaagaagcactgaagagcaaagatgatgattaccatatagataatactaaacaagcattgatttctaaaacagaaaaaatattaatgataattttgatcattaccaaaacaagatggaactaaaatattagaaaacaataacatgctagacagggactgttacatcagagttaaagcatatcaagattcctagattgtttgtaaggcaatagaggtatgaattaacttgatactgttaagtcaagtaaacattaaaagtttaggggtaaccactgaaagaataaaaatgaaatatatagcttccaaaccagggagggatggaaagggagataaagatagaaaagaagagtcagccaggcatggtggcttacacctgtaatcccaacactttgggagactgaggcaggcagatcatctgaggtcaggagtttgagaccagcctgaccaacatggagaaactcatctcttattttttttttctaaaaataaaaaattagctgggtgtggtggcgcatgcctgtaatcccagctactccggaggcagaggcaggagaatcacttggacctgggaggcagaggttgcggtgagccaagatcgcaccattgcaatccagcctgggcaacaagagtgaaactctgtctcaaaaaaaaaaaaaaaaaaagaaaagaaaagaaaagaagagtcagggaaagcagtataaagtaaagtaaacagaactaataaaagaaaatgctatacaataaataaatacaatatattcaaacatctgaagctgtagtaattgtaaatagattcaactcaccaatcaaatgaagaatttaattgcttagcaatgtgctatttcacagaaccatatctatacattaaagactctgaaaaggactgaggaaagatgtaccaaattgtaacgaaaagaaagcagtgtaactgttttaataccagacaaaatagactttaggagtaactagaagtgacctaagtacaatggcaggtggagaaggagagttattgaaagcagagagaactgcatgagcaaagacatcaagggaggactatccctaacaaatttcaatagctcaagttcaaatataggttaaaatagagaagcttcttcattgtaacattatgctctgttatttttaatgtatatttttgagcatgtaggcaccagacaccatgctataaattatttctataaattatttctactcctcgaaaaatctcacaatgcagatgctttgttattcagtacaattttggttatagaaaactgaaacccaatttgaatcagtctgagttaaaagtaagaatagatggatctctcactagaaaaaccccacagaaggaaggacactgtttgggccaactttggatcccatgcccactctccagctcattactgagttcaggaggacaggccaagcttgggtcaagtgcctgcccagcctgaagtgtggggtgttacaataaaaaataaaaaataaataaaagaaaacacgattgatgtacagaaggactgcttctctgaaagtaggggtctgacaaaaacaaacaattccacaagagtagattgtattatcctcattttataaatgaagtctcagactcagaggccaagggacttgtccaaagccccaagcacctacatggcagagctgatgggaaaccaggttttttcctctaaaaggctgaactttttctccaagcaatgaacataggactttgcacagagttaagttctcaagatatatactaattcattattttaaaggacctacagaatataaagaaaattgatcattttctttataatcattaaaagatttggaatgaggaacttgtttctagggccaacaaccctacagcatatgggccctcccaaggaccctccacagacaccaatgaacttggcatcatagatcctcatgcttagaactcctttgcactgataatttgtactgtgcagttcagccctaaaaccatctttaattatttcacagcttgtccaggtctagcacctccctttctcctccacaacacccaaaagagccactagtagatgtttaaatgattggctccaacactttttaactcatgaacccatctggaaaactgatgaaacctatgggctcccaccccgaggaaaagggggaatcaatgcctatttgcacatacacacacactttcagcaactttgcaggcccctgaaatgtatccaggaatccctgggagttaagaactgcctcaacaagaagggaataaaacttagtacccccaagagacagcattgggaggctattcaatcaactcaaaaagattggggccaattcacatgtgactatcttaaatggacaagaagtgctaacccataaaagcacatttcatagttagctgttgactgcaatggatcccattcagctccaattttaaaataccagctgagtgccactatgtgccaggtactctgctggatacaaactagagtaagaccctgtcctgaatccctagaagctcaagacagatgcataagcaacaatttcacttcagtgtggtgaatgctaaggtagagctgtgctaaaatcctatgggaacactggcaggaggtggaaagtaagggaaggttccaggagagaaagtctcagcggaaggaggatcaggtgttttctggcaaagaactgagggaggaggggagcattgctggtggtagaaacatgagacccacatgcatgtagagtgacatgtgtgggaacatcaagcatattggtatcactaaggcagtggttgtcaatgagggtgatttgccaccccactcgcgacatcccattaaggacatttgacaatgtctgagtgttatccaacagaactgaggtccacttgcccagcacagttaagaccaaacatccacatctatgttttcagcaagagaaataatggcatttatttgcagggcaccaagcaaggagaattgagcagctcacacttaagacccagcctccccaatggctggcaggtaagggttttcaaaggcatgggtaaatttcatgaaagcagaagttacaggcaaaatcctaaatcaatacatagaggttacacagtgggttggcttgaaaaggtgggatatctggaagcagggccttagaggtcacaggtgggtttaaagattttctgatttgcaattggttaaggaagataagctttgtttaaaaaaagaagtagagaatgttgcctatttcatgggcataacttccttcaggcccctcaggaagaactttagaacaaagaccagcaaaagcggtaagagttcagtcctcagttcccccttatctgaggtctatgtgccagtagatccatctggtaggggtctgggtttctgaagaaccactcagggacatgtgttaaagtgttacctttagtttctatagggaaccaaacacctcatggctctaacgtccttggctattgtttaagctaccatttccttttaggttatgcacttgctcactttcttctcagagccagctcggtgcctcgaatttcccttgaaggaacttaagatttccctttatttccatgtttagggtacattcagcaacctgagaggggtccctgctccatctcacgaggatagctttggttgtcttatctcgggtgggagtggagttgcttatgggtatctagtaggtagaagccaggtctgctgcgaaatatccttcaatgcacaaaaagcccctgacaacaaagaattttctggtccaaaatatcgatagtgttgagaaagcccacatcagaggatcaagtgtggatagggagttgttgcctgaattgagaaaccaatattcctgtagctttggggctgctgccatcagaccctctcttccctaaagcaatgataccagctctgcacctcatcagcaggaggaaagaatgagagtggtttgtctctgtacagtgaaaacataggttagttattgaagctaacttgacttctgcactcatgtatcagttgtgattatagaagaaggctcggctgcacccagcctgctatggtctggatatttgtgtccaccatccccgaaatttatatgttgaaacctaatccctgttgacaaaaagagtcaaactctgtaaaatattttaagagatttattctgagccaaatatgagtgaccttggcccctgacacagccctcaagaggtcctcagaacatgtgcccaaggtgatgggggtacagcttggtttcatatattttagggaggcatgagacatcaatcaaatacatttaagaaatacattggttcggttcagaaaggtgggacaacttaaagtgggggcttccaggctacaggtaaatttaaatactttctggcagataattggctgagtttgtctgaagacctgagatcaatggaaagggatgttcaggttaaggtaaagggttgtgcataccaagttttattgtgcagaggaagctctccgatagcagacttcagagacagcaggttgtaaattgtttcttatcagacttaaaagggtccctggatcatagttgattatctcctggatctgggaaggaaggaaggaaaacagaggggcaaaggtattctctgtagaatgtggctttttcccacaagagactttgcagggcaatttcaaggtatggcaaggaaatatattttggggtaaaacatttcaaattttcttccttgttatgccagagtcagattggaaagtaagtcatgatacacagggttaaataaacccatctgatgagaatttatgatttgtagggcatgactccccacaccccttaggaatttgggcaagataaaaaaaatcagagcttagtcctcatccccagtgtgatagttttaggaagtagggcctttgggaggtgaatgggattagtgcccttataaaagagtactgagagagactcctcaccccttctaccacgtgaggacacagcaagaaggaacatcgatgaaccaggaagcaggccctcaccagacactgaatctgctggcaccttggccttgggcttttccagcctccatatctgtgagaaaaaaagctctgtggtctataagtcacccagtctggtatttttttaaagcaccccaagcaaactaagacatggctccacctgaaagtaacctgtggatgacttgtgtgaaccccaaacatttgagacaggtcttagctaatttagaaagtttatttttgccaaggttgagtacgcgtgcccctgagacagcctcaggaagtcctgacaacaagtgcccaaggtggttggggcacacctttggttttatacattttagggaaacatgagacatcaatcaatatatgtaagaagtacattgattccacccagaaagacggggacaacttgaagcaaggaggggtcttcctggtcacaggtatgtgagagacaaatggttgcattcttttgagtttctcataagcctttccaaaggaggcaatcagaatatgcatctatgttagaaataccaaaattgttagaaatagataatcggtgccatgaagaaaagtcagcacgtagacataagatctctcagcaaggcaatctttactttctgcagaaagggtgctcaatcacagatggaacaatggtgagaatatacctgaacaaaggaaaagcagacatatttatcccttactcatttgggtcatccttactgctgtgtcctgcatccatttgctggagaaggacctcactgatatccgatttgctaataacctgaaactttcctaaataggtaagtgcagggaaggacaaagaaggagaggaagttgcttatgaaaggtttaaggaagcaataacatttccaaataaggaaggggcataagctatgagctaagatttgcctgggcctgtccagacatgcctgagtaagccaaagcaactaactgggctaaagtgtaagaactaatagttgataggagggtttagagtaaggaactattattcctagtgtctattattttatttttaaacaagacaagctttgaagaggaagttttctactttctacaatctcagtgagcggagggattactttgaacagaatgggaggcagatttgccctgagcagttcccagcttgaattttccctttagcttagtgatttcgggaacccaagatattttcctttcacatttgcatacccatcttcgggagtagcaggtaacccaggttattcacgggatttggtttgcctggttagcccacagtgggacacaggaaggagaattcagagctgttaccaagtgctacctgagatcacacacagttactaaggtctggagaattctctccccaaagctccagatgtaactgtgactctacagtgacttcctgactctagggacatcagaacaagttccttaagagagctttcaggaaatagcctgggaactctgtaagcagggtcaagaatccatacagtcacaggggcagcatcttgctgaggggtttgcagagggttaccacaggaaagagaaaccacccatagcagaggggcagcaggaacaaccgccaccaagtgggtcactagccatgggagcctctgagtcctgctgacagccagtggctggaacagcaaccgagacctgcacaggagccagggcttccaaagcttatgatgaaaactcccactgacatggtcagagagagggtctagttccaggaacttatttatcagagtgctctctccccatcttggcatgtgttactggatattgtgatttttttttttttcgaggcagagtcttgctgtgttgcccaggctggagtgtagtggtgcgatcttgctgcaacctctgcctcctgggttcaagttattctcatgcctcagcctccaagtagctgggactacaggcatgcgccaccacccccactaattttttgtattttcagcagagacagggtttcaccatgtggggcaggctggcaaaacttggtctcaagtgatctgcccaccttggcctttgaaagtgctgggattacaagtgtgaccaaccacactcagtagatattgtgatttttaataagaaatatatatttggtcttcatccaagcacaagtgctaggaaactaggaggtttcctagcacacacctcctaaaacccttagagtagcagaagtgatttgtccttttgtatactaatgggttgactgttggctgggggcccctggatagcctcagaatggggactggttgccagtggaaccaaccttgtgattggaggattgggatattcaactcttccccctgacctccagggagggggagggctgaaggctgaggtgatcatcaatgtccaatgatataatcaattgtgcctacacaaagaagactccataaaaacccaaaaggctgaggctcaggaagcttctggattgctgaacacatggaggaactgggagggtggcgtgcccctagagggaagctctgcaccccttcctttataccttgccctatctgtcttttcttcaagctgtacctgagttgtatccttttataatgaatgggtaaaattaagtcaagtatttccgtgaggtctgggagcaatcctacctcataatcaaccaagaggaggggggcgtggaaacctccaatttacagccacttggtcagaagcacaggtcacagcctgggatttatgactggcttccgaatgggggcagtcttgcagtcttgtgggactgaatctttaaccctgtgagatctgactctaacttcaggtggatggtgtcaggattgaattgaattagaggacacccaactggtatcaaagatctggttgcatgagaaaaaataacccacacacattttgttgaccagaggggaagtattctgtgttgagtgtgaatgtagaagggaaaactgttcttttcttcctattatacagtcatccttaacatctttgtagaaagcatcattgattttcaacatatccatcactgaaaggaaaagccagctccccaccagcaaacctcaccaggaaaaggtccaaacagcctgagagggaacttaattcactgtaactagtactcagatcctggggggaggctatggcctgggggaggatgatatacaggtatacctcagctgctggtcacaacaaaaacaaaccctgaatactacacccaaacatgctaagctgactgtgggaaatcggctgagataaggcaaacagaacacaataagaccatttatcctgaaacaaactggcccttcagtttccaagagacacccataactcagccctccaggaagaacttgcacgtcagttgcctcgttctctgggcacagaacaccattaactttaaaaatacaccaacggttgtacgagagacaagtcatcaagcatggtgctgggaacagggcggtttgggctccatttaaggaaaagcactgggcacttgcaggccacagacttctgcaacggaatcttttgaaaaagcttctccttccgtctggtgatcccgtcagcagcaggcctgtcccctaggtcaggtagcctggaatttcaatcccccaggtgccagcacttctgcttctcaacttgcggtccctttactaaagtcaaaggaggatggaggctgtgcctctacttctggaccctacttttataaatatcctgcaatgtaattatttttatgaccaaattttcttttgactgttaggcctcctctgggaccatgtaattacccagccctatttgcaagtttaagtgcatggctctgcggtcatctgaacacaggaaaaggctttgccgtgcatctgtacgcatattgccttcatagccaagttattcctaaatcgttcaccagtttaaagatgtgtcccataaaaaccttcttctgggctccatccaaggcggtggagccagcatggccctggacggatatttcagggaggctgagagcgaccgcaaggaagcattgtgcctaatcgtggcactcgtccggatatcgtaggaaaattatgaccgaaaatacctcctgaagacagaatgaccacacggcctgcggcagactggcggtgtcaaggtgttcagctttttccaagaatggcacagagaagaagaccacagaagagctaagcttcttggaaaatgggtgtgtcatgctagggaaagcactggcagcgcaggaaataaagaaagctccccacgtaagccatctagcacaagggaatgtatggcagagagtcaacagccacgtcttggcagtggaggatctaggttcaaaaggcagctctgcacctttctagaaatatgaccttaaacaatttggttaactactccgattgccaggttccccatctatagtactgaaaatcattctatccataggttgtgtaaggatcaaagaagataacagacataaaatatttagcattgcacctgataaatagtaaatatttcacaaatgagagtattgagagtattattaccctcaatggtaattattattattattaagagtattatcattttctcattattaactccttatagctgcatagtgttttagaatttgcaacaggctgctctattcattcctttttttgtctgagaaaaatctgactaggtaatgtattaattcatataattaaaaataaaaatgatatacaagtacatgatgaaagcctagctcccaccccgtctctatccaccttctcccctcctccacagctgcccttgaaggtaacactttccttaggtcctacatatgcaccagtgtttctttctacaaatacatatattcagcttccccccattttttacacaaaagtagcattctattcacactattctgctatttgctatttttactttatattaataaatcttactatggagagatcctactttccatattagtatataggaagcttgctggatctctttctctcatacacacacacacacacacacacacacacacacacacacacagagagagagagagagagagagagagagagctacattgtattcctttgcatagctctatcacagtttatttaaccagctccctctgaacggacacctgggctgtttccaattccagtcgtgtattgctcttgacactgccacagtgaggccccttgttcatcgtcatcttgtacaagtgcaggcacatccttagaatgaatccccagcagtgagatcattggtcaaagggcacaagcatctgtgactgtggctggttattgctgagggctccccattgggattgtgccattttgcacctccccaagcaatgtacaagagggagcaatccttttaactcttttcattgtttcttctgctagctgcccccatgtctccaaatgttatgctcagccagtttcttttcttctcttttttttttaccatcttaaccttatttaagcacacaattcaatggcagtaagtgcataatgtttaagtgtcaccaaagcatttatcccaaactgaaactatgtgcccattaacaagaaccccccattccctcatccattcttgtttatgctggcacttgcccatatagcatagttggagggaaataaaccttcctgacaaatcccccaaaacactcccacttgctctctgaaccatcgtactcgtttaataatagaggaacaaaggctttcattgtatgataagagattagccttgtagaaaaaaattctcctggaagaagaaatcaaaatctttaaatttcacataaacttgtgaatggctcctttctatatgcagctctctgtgtgggtcaggtagaggatgctggaaagggcagtggggatggtatatcccatggtatgtggggtcaggggactcagaaaaagaatgctatattttatctacttcttagtctaaggactaagttgcctagctgtcggatagaggagagtgaatttggctttgcacccagcaagtacttggttttctaagacatgcagttctgtgggcacctccctaatgccatcgccctctccccagatttcccagctgtgtcaatattcctcttcccaagctccaagccacctgaggaccacatgccagggggcattgagagataggtaggatgaggctgagagagcaaaggaagtaacagtaagtagaaaggacgctgcacataaagtgacaagctatgtggacaagatgatgtatgtaaagtgcttagtagggggtctgtatccagctactgttcagtgaatggtgatgatgatgcagatgaccgaaaatgataatggtaatgatgacaaattcctcaaaaatcagctgcctgagtagtggctcagctcctaaatattggagcagctaacctccttatactgatctgaaatccaatccctccaacttccaatgggtcttaattctacattgggccacccacaatctgattacacttcccattacacacacgtcagtgggttaaagacagcaatggttcctcctggtatctcctcttcttcaatctgaatatctcatcattcttcaaacatccttcagaaaacttggtttctagaccctcatgaagcattttgacagattgaaacaagggagacatgaggagaggagctccattccatgaaagtgagatgggccacagatgagaggcaggtagaatttgagacccagggacagaggaaacagggtgagaaaggagtgactccttgggtcagaggcccaaagaagtgactcttcagaacttagttcagagcagtgatccgtgagagcaccaatacaggactatcagccgggttagccctggaccaaggaatgccaggatttgatagggctccatggctgagtccctgggaattctgctatttcattactaaatctctgaggttcacctccatgtgagcccatctaagtagggtattaagaaggttcttaacacccccccaaagtcaccctttccatctttaggtggaaagttatgctatgaagactttggcctccacattccaggggctaagtcccacccttgaacagaaaatgtctccctcatttccctgtaataacttggtggcattgcaggacagagtagagggacaatgtatagtagaacaggcaggggatactgagtggctttgttcccctccctggaaatccctgtggacccaaagactatacaggagcagtggcattatcactgagatctactaattgatagtggttaatagtgataatctgattaatctattaacctagttaataggttggcagatccctggtgtttacttcaattagatcccatgcatttgcacatttttttagtcctaggtgatttttttcatctcaagttatccaagtatttgtcctctgctgcaactcaaaggcttgttttcctaaacattcattcatcactttccattgagaaaatctccatccattattcttcctccttacatcactctttagttctaaaaacctccccagtgcaaataccacatcaacactccctttttcttttctgttttttaaaattattttttattatactttatgttctgggatacatgtgcagaatgtgcaggtttgttacataggtatgcacttgccatggtagtttgctacacccatcaacccatcatctacattaggtatttctcctaatgttctccctcctcaagccccccaccccctgacaggccccagtatgtgatattcccctccctgtgtccatgtgttctcattgttcaactcccacttatgagtgagaacatgcgtcaacatcccctttttctattaagcctagcagcattccaaaaaggaaggtagatgtagtctttcatacagagaataaagcactgagaaagaaagttcatgcccatctggtgtcctctcttaaggaagccaccaccacaacagtgaacagatgagcaatcattggctccctacttctcccagctcactggactcagggccacatagccaagtacaagatgcctggttggtataaagagttcccaattatatcaccaggcctggttatttctgcatgccaggacagatccaggtggcccacactggggggcctgggagctaccttcatttttggattcaccttcacagtgtatggatgtgaagctcaagttcaggctctgtttctgccttggccccagggagaagatatgtgcagtggcacgtagccaccattgccacctcccaagttgtggctacaagttcttcctggcaaagtccatcttcattgatgctctccaatttccctctccacccaccatctcttttcttttttggatgataatgactgcctgagttagctcttatgagtcaattccacctatttttggtcaaactccactcctggtttggtcctcttccaagacaaatccagaagccacagggggctggagagttgccctggcagagagttgcccaacagaacttcaattaatttcccaggttgccatcaggacctccgacatgggagtggagctcagcgtccaagcctggcagggaagttggctggcatttggggaagacatttaggatgctgggtcctccttacttatgcctttaaatatgaggaccagttcctgactccaatgctctcccaaacacaatggggcccaatattagaattccacatattttctaaattcaaaagtcagaatgaaggagaggtggagaaagacagcgacaccaacgaagacacagaagcagacagaaagctgagagaggcagagaggcagactacaggaacagagggagcctcgttccaagttgcctagcccatttctcacactcagacacttaactgtgctcacccctcatgttcaaactcatgcccctcttgttccccagcacctgcagtggttctagaatttttatgtaagaagttgaccatctagttggaagaggggctaaggaactagctttgaggctgcatttgcatactgggcacacttttggttttgactaagtgctcacttggtgtggccaatgggaactgtcagggggtttccactgcccagtacaatttctgttccatcaatcctgccacgtggtccagtcattctcttgcccctcaactcatgatgtccagactcatgtgcctagttgtgctcatttcacttccttccttttacccagactctgcaaagaccttcccaggctccatgtctcaatgagacccaattaaataccatattgctcacttatgtggcagctgggtacagtatctggctggatgccagggactgcctacaagccttgcatctgtacaggactttgcagtctgcaaagtgcttttgcatccagcatcttatccaactctcacaacagccttacatggtagctaggagagtaagggtcattgttccatcttaaagatgaggagagacaagaatggtagcaggtacaccaacttcagacacacagacccgcatggaaaccccatctctgatgtctattgctttgggtgagctgggacagttctgagtctcagttttctcatctctaaaatgggcccatagttacctaccttgcaaaattgtgttagatctagaggtaacatatttaaggtgcctagcaaagtacatggaatcgggtataagctaaatggtagcaattttgaagattgatgatgatgatagtggtggtggtggtgatcatagtgactgtactaaccaagatgttagtagtggttttattgtttacctatactttctatcttttctatagttaatcatgactagcatgatttatgaaaaaatggtttaaatatttctcttttttttgagacagagtctaactccatcacccaggctggagtgcaatggcatgaccttggctcactgcaacctccatctcccaggtttgagtgattctcgtgcctcagccatccaagtagctgggattacaggtgtgcgccaccacaccctgctaaatttttttgtattttttctagagacagggtttcaccatgttggccaggctggtctcgaactcctgacctcaagtgatccgcccgctttggcctcccaaagtgttgaacttacatgtgtgagccaccacactctgccagtctttcaagtattcctgataagaactttattcttcttctccagagcaacatgttagttctgcaaaaactccaccaggaagctggcagccctgggcaggtgctgtctgaatgcctggccaaagcctcattccccacgctccatctcactcaccacgtattcaagtccaggtaattgtgcccagcagctaccagttcccatgtaattgtccccaaattgctccgggtggcctttccaggcagaagctctccacaattagtcctttcatcaagatgttgaaagacaagtgattattttggggaattacgtgtcagcaagaagatgcagctttaatagggcactatagggccctcatgttaattacaatctggaagatactatcacatcatttcttcatccacagctcattaggcattccagcctcagctccctgacacgactgtggatttgttacaatgtgcgaaggaaaaaaagtatctcaaatgaggacagtgtaaggattctgtggatgcacccatatgcaggtggtcagcaaacatcttaataagcctaatcttgtcttggattcaaagtaacatgtatacctatgagagcaagcatatccatgcacacaacacacacacacacacacacacacacacacacacgcagcactcttagaacatcttgcgaaaaatatccaaatgcttcctgattacattcttctgcttcactttctttagctttttttaagcaatgaggagttattttttgaaataggaaaccaaaatcttcaattaagtattcagtatttcttgagggcctacatatggccaagtctggtgtgggtaccccaggggataacagagaaaaacacatgtcctcatggagtttataatctcattagggagaaagaatcagtgcccacaaaacaaagcactaaagaaacaacaggcctggcacagtggctcatgcctgtaatcctagcaatttgggaagccaaggctggtggatgacttgaggtcaagagttcgagaccagcctggccaacatggtgaaaccctaactctactaaaaatacaaaaattagccaggcgtgatggcgcacctgtaatcccagctactcgggaggctgacgctcgagaattgcttgaacccaggaggcagagtttgcagtgagccgagatcgtgccactctactccagcctggcaacagagcgaaactgtcttaaaaaagaaaaaaaaaagaaaagaaaagacaaaaagaaaaagaaaagaaagaaagaaatgacagcaggaaaaaaggagggtattgtcatcttttaaatgcctctggcactctgagagaaaggtctgggcataagggatctcaggaaaaagtaaaaaccaaactgggcttagcctggagggatgagtcatgttgtacaggcatgagacaaacatatagaatggtctttcttgagaagaggggatagaaggcagaagacaatgagagagacagagaaagaggcaaaggagagagagaaagagaaaatgagagagggagggggaaagggagggagagaatcagggagggagagaatgagagagggaaaggaagagagggagggagagaatgagagaggaaggcggagggagggagagaatgagagaggaagggggagggagagaatgagagaggaagggggagggagggagagaatgagagaggaaagggggagagagggagggagagaatgagagaggaaggggaagagagggagggaaagaatgagagagggaggggaagagaggaagggggagaatgagagagggagggggagagagaaagagggagagaatgagagaggaagggggagggagggagagaatgagagaggaaagggagagagagggagggagagaatgagagaggaaggggaagacagggagggagagaatgagagaggaaggggaagaaagggagggaaagaatgagagacggaggggaagagaggaagggggagaatgagagagggagggggagagagaaagagggaaagaatgagacaggaaggggaggagagaatgagagaagggagagagaaaggaagagagagaaaagagagacagactaggggagagaaagaaaaagggggaagaaatacgaagagcagtggggacagagggggaacagagagacagagagaatgagggggagacagggagactggcagagacagggagaaagagagtaacagggagacagagaaagagagagacacagggagaaacagaaagagagaggagagagcaatagggagagagagggacagggagagagagacagagggagagacagaaagagagaggggagagggacagggagagacagagaagagaaagagagacttgggggagagaaagaggggcagaaatatgagaggaggagggaggagaggtggggaagggaggacagggagacagaatgagggagggggagaaagagaggtagagagagatggacagaggggagagggaggaagacagtcagggagagagagagaatgagggcatgagagaatgggagagggagggagggacggcacacaaacacgtaaaggagaggagggaaattgccaagcaatggagacccggagagtgatcttgaatagcagacagaaggttggggtgactgaagagagcactatttcacattcttaggcagagtgtaaggtggtaacagaagtgagctaagtatttgtgaaggtcactggggacgctgtgtccagatctttggaaccctgctcttttggaggaacttcatggagctagctgagctcgttgagcctctcaggttgtcaatttctcttagaagtaaaagagcgctgactgcggaagtgagaggcagggggtgtgtgcatgtgcgtgagtgtgtgtgtgtgtgtgtgtatgtgtgcaagtgcgctacatgctgccttgatgagaccatctgataggtccctgccatgccaacctggcactcttgttctttgggcacagatgaaagagctgggataaaaccagctgggattagggagttaatgatgtgcttggccttgggaaagtttgaggggatctggcttcctcaatcttgttacgcaatttataaccccgtcttccaactcggcagcccctccttccatgtcagtattattcttgactaagaattgctcttgcttgctgagggtgtacctatttgtggattgcttgtcacctacagttgaagggaactcagattcctaaagggcagtgtcctcagatttagtccatttttgtccagcctgtaagtatgagctgccatgttcattttccccctaccacccaagccaagtcattttagggtctggccgcaggaggccagtgctgggtcagctttgagccacggcaggaggtttacagggattaaggcaaagcgagggacaccagatttggtttcaaagtgatattcaccaggatattggattgcattttaaggagctactaatggagatgtgggtgagtgggggccagcccctgaagattttccattccgatagtgaaatcgagtcgcccagtgcaggctgtcatatggggctgctgctctactttgcttgtttagaggggagtcaatgacagtggaaggccttgtaccagggccagggatgggaaaagccaccacaggcctctctgtcttcctgaacctgtggaccaccagtgtaggctcaggagtagatagagccaataaggggtgctgggagatcctcctaccagaatttccccattaatgactcctctgcagacagccaggaaggctttgggggtctctgagaaccccttacatagcatcaataatcacagagacacaggagggggaacctgacatggtgtgaggggagaataagagaagggataaggagcaaagagtggacctgtagctgaatacaaagcctaacaggatcagaattcagtctgggctctgggagggggtgaaacactagctaaacgttactgacatcactatttcgccaaggtcagccttcagggacacaagaccttcagtgttgctgactcagaagttaccttttaatgcaaagcctatgcttaatccctctcatctctccttaccaccaggccaaactgtttacccatccctcttggagcctgcggtctccggcctccctgccttccccaggggccattcacagcacctcctccaagtcaccttctaggcactgtggaagaagctttagcctgggggtccccagggctggaattctagctgtgacactggtggtggttggaccttgtgaccctccaccttgctgagagtcaattcatggatgtcattatctctaactcttgagtcctagtgcagattaaaggaaataatgaatgcatgtgagggggccaagcaccaggcttggcaccacagtaggtactaaattatttctctcccttcagaactgaacccctgaggttgaggactgggtgttcttggtctgtgctttgggccatcccgaagtggctggaaaggagtgatgtgttcagggagggctaccaagtagccagtggccaaggccccagggctctgagtcaccctccacagggtcaccaaccaagagatctagcctccgcctctaaaccaaagttgagtgactgttcccagcagttccaagaagcaacagccaaggcctgtggatctggataaagagctgagaaacaccctggccactgtacattctgctcctcccacactgctaccctccccacccccaaccctgccccaccttcccactgtcctactctttgctggcaggggcaaaatcaatcgcatcttcagggggatgaaattctcccattcactctcctcttccccttcagctagcaactaaaaaagtcacattttattatcaagatggaagatcttaagggtggtcagtgaaaagcagcacagcccaacagaaagaaccagaagactacgacatcatcctgctctgcatttattagctgggcaatcttgagccagttgctgaacctctctgaaccgccttttccatatctgtgaaatgacaatgaaaaaggaaatctttgcagggcttttatgaagaagggaaagcaagacagtgtatatgaaacggctttgttaacaggaagtgctgtgaaaatatgaggcggttatcagaaagaacatgcgttgtaggaggtcacctaaggatatctgtgattgtgtcacctcctagaacacatcttgattcctgtgtttgtttcctgtgtgataggcagggccctaagctagagggaagctgcagtgaacaaaaggccacatccctgccctggaagagcttacattctagtcggggaaacagacagtgaatgaatagcatgacatagcatagagttatgggcaggagataagcaggtgaggctcaggaagtgtggggtggccagagtcactattgtaaagagaagggccagggaggaaccttctaaagagggttactggctctcctaagaggcttctcatagcaaactccccctccttccgctgagagggtttgatggcaggcaacagatgacttaggactcctctaatggtctttaggaacaggaaggcaccaccaccattatcatgcaacattgttctggaagtgcaagccaatgcaattagataaggagaaaaataagaggtaaatgtattagaaaggaggaagcaaatttaatatgatttacaaatgatatgattatatatctaaatcaactaaaaaactttagaaacaaaaagataattgactttggtggcttcttcttatataaacaaccaccagttaagagaatatactggaagaaaaagtaccatttataatatgaagaaaaagaaaaacacatccaagaataaatttcacaagaactgtgcaggatctctataaaaaaaaaaaaaaaaaaaaaaaactttaaactgccacttaggaattttaatcacacttgaataaaagacatattcttgaatacaaaatttcagtgttgtagaaattttggttttccttattcaaagcaatccttgttaaagtatcagcataatttcttttggctatacaaacttattctaaagtttatctggaaaagcaaatatatgagaatagctaggaaaaatgatggagaaaaatgaaagtgggcagatggacttcctcatcagatatttaaatgtatttattgtaaatctacaacaaaacaattcggtaaagtgcaatttggcacagacagatttacaagagagagtccagatataaacccaaatgcatattggaattgggtataccataaaggtataattcaaatcagcaataaataaattactcaataaataaaatgggaaaactgcttaaccattggggttgggaaagaactaagctggaaacccatttcacaccttatactaaaacaaaattacagatgaagcaaaaatttaaacgtaaaacgtacaccttaaaagttccagaaagatacacagatgactttaaaaataatcttaggctagagagagtctctgtatgcataacacaaaacccaaaagtcattaaaaatattgaccatgtaaagttgtgtaagtctgtaggtttagaaaaatagcatgtaaaaggtcaaaaaacgaatactaaacatatttagcatataagttaaatagactacttcttgggtattttgtgtactagttaggataggggaactactattatatttaaaaaaaaaaaagacctaaagtgtatgatggttcaagtcaagtggtttcagttaaccacagaaaagggaaccctctcctctaaatcattcaaagaccaggctgacaggtcttaccagctctaaccccgggtgtcatggaggcgagttggtgggaagttcccatgggctaggcttggcagtagcatatgtcatctgtacgcacagtcccttggctagaactcattcacatagccatatctaccctaaacagggctgagaaatgtagtccctcgctagatgcttcttcccagggacaattctacacaccagaatgcagagcacacatttctgatgagcagttagccatctcagccgcatcgttcatgcatgtcacacgtagaaaggcagagggcaaatattgctaaattaaaaagagttccagaaatctattcaaaaagacaagcagagcagaggctatgaactcacagttcatagaacagaaaatgcagatactcattaagcaaatgaaaaatcctaaagtttgtaataattaagcacattaaaataaaagcaacaggaagatgccactttttatttatcagactggtaatgatgaaaacgtttggtaagagttgataagtgtgtgtaccatacacaccttcaaatactgttggtgggagtatacattagtgtaacacttttggagaacgatttggtaatatcaataataattttaaatacatgtatcttttgtttaacccaacaattccacactaataaatgtgtcctatactggttaaagtacactaagtcatatgaataagaaagctcattgatgcattgtatatattagcaaaaaagcaaagtagacagacaaaaactaggaacaatttgtatatctaccagtaagaaacatatgtctatataatggacgtggtacagtctgttaagagaataatgtggatccatttgtcctaacagaaagatctccaaaatacccagaagatgctcacttaatgggtcttcacttaacagacttaccacatcgtgtgatgcttagtccctacagaaaatacaccacgtgatgaacatggcctactctctggcattccaggacccttctcctacaagttgagtagggggcttagcaggagcaattgtgtttgtcgccaggcctggttactcaagttgcatttgttattttttattcataactaaatactacgaaagaactaattgagcatgagtacaaaataagagtcagttctctgaaagctaagggaaatgctttgaaaatactcaacataagtgagtttttaccaaaaaccaaaatgatgttaaaatagatgtgaggtgactgtgaaagacggcaggcaggagtgatctggggaggtttctactctcagatatcttgcaaaatatctttaaattctcattccaacttcgggaaagaaacgtaaaccacaaattgtagattacgcattactcattacaggtatggttttgactgacagtaatatgggactccaattagctgatgcatcctcataaaagaagagccttaatatcacattaaaagttcatccacagatacctatgagcttaaagatggattttgtaggtgcaataatattgttattacgttcatttgtttgaatttttaccttttagagatgcaggctgaaatattagggaatgagtaaaattacatctgagattggcttcaaagtaataatgcaggccaggtgaggtggctcacacctgtaatcccagcactttgagaggccaaggtgggatcacttgaggtcaggagttcaagaccagcctgaccaacatggtgaaaccccatctttactaaaaaaatacaaaattagctgggcgtggtggtgcacacctgtaatccctgctatttgggaggctgaggcaggagaatcgcttgaacctgggaagcggaggttgcagtgagccaagatcacaccactgccctctagcctgggtgacaagagtggaacaccacctcaaaaataaaagtgataacagtgggagggcagatacagatgaaacaaacttggctgtgatttggtaatttttgaagctgaatgatgggcccatgagggtttattatactattctgcctaatttttgtatatgtttaatattttccataataaaaagtagaaaaaaagtcagaataatatgtgtttatatatcataaattagaataaaatgtttaaagtatgcatatataatttttataactactctcttaacctgctctttaaaattaaccagcagtgacagcatcagataaaagggttttggctatatcatttttttaagggtatagatacagtatgattgtattatacttaaatatgctggtagatgtatctgtagtgatgtcagttttaccccaacacaaggaaacatcacagcacttttctaaaatcaaatttaatttactccaagtccccatcccaccagtgataaaagtgttcatctcaagcattccagagtttcttctcactccatctagtgggcattcactaagggaaattatcattgctctcttcctcttcctcctcctcctcctcctcttcctggtcaagatagtaacaaaacaacaaaactctaccatagaaacagaccccattcctttatcctggtgccagaagtcaccactgcccctccacaactcaagctcccaaataactgcctccctgctcccttctctctgtccccagccttcacgccaggcacatacagggatgtaactgacctccgtgaggctgacaaaggcaggtcagggcattctgtccaggcacttctcaagcatctccatggacctcaatctccctgtacaagagtccagccctgccctgccacagagagaagcggaggacagcccaccttcttctgaaaaaagatacagcaactgaacctgcctttacatccatcctggctggatggtacatcttctctaacaccctgctgatatagtttggctctgtgtccccacccaaatctcatgtcgaattgtaatccctacatgttgcaggagggacctggagggaggtgactggatcataagattggatttccaccatgctgttctcatgatagtgagtgagttctcacaagatctggttgtttaaaagtgtgtagcacatcccccttcactctctctcttctactgccatgtgaatacatgcttgcttcccctttgcccttctgctatgattgtatgtttcctgaggcctccccagccatgcctcctgtacagcctgtggaactgtgagtcaactaaaccacttttctttttaaattacccagtctcagatagttctttatagcagtgtgagaatgaactaatacacctgcctcatcccaagtttgcccttctccagaaaaggtggctaactcagaaagctcttgtcactttgaagtaagtgaagctcttccatttctggagtcttgagggccctcccttctgaaagcttgtctgtccctaagcatctctcctaattacctttttttagtcaaattttggtggggttttttttttttatcattgatagtttagagaagttcctttcagcttcacaatttattatcagtattatcatccacaccttcagaatgtcagaagcatctgaaccagagtgactccatctagaataggggctgtgaaaatgaggctgagacctgctgggttgcaatccccagagattaggcattcttagccacagaatgacataggaggtcagcacaagatagttcataaacactctgctaacaaaacaggatacggtaaagaagtcacccaaaaccatctccaagatgattaggaaaatgacctctggttgtccttactgctcgttatacactaattataatgcattagcatgccaaaagacactcccaccagcgccatgacagtttacaaatgccttggcaacatcgggaagttagcctatatgatctaaaaaaggaccctcagttccatgaattgcctgcccctttcctggaaaactcatgaataatccaccccttgtttagcatatgaccatgaaataaccacaaaaatagccaaccagcagcccttggggctgctctgccaatggagtagccactcttttgtttctttacttactcaataaatttgctttcattttactctatggactcgccccaagttctttcttgtgcgatatccaagaaccctcttttggagtctggatcaagacccctttccagcaacaagaattgttagcaaactggggaaaacttttattcagattctttcatatatcagcagaaaaatgtcaagacatttcaatttttcttaagtgtaccattcagtggtttttattatattccctaattatctttgaaatgcatttctttgaggctttgggctatgatttctaagactcttcaattaaattgctaattccctgggagaagaagatgcaaggccatcatctttcttggaagtagactttggtttggggagtaggggcagaaagggaactcccatgtgctgaatgtctgctgtgtgccatgctaaggagaccctttcatcacatttcaattaactatagaccggggcactctcctcctctaaatcattcaaagaccaggctgacagagaccttatcagctttaaccctgggtgtcatggaggtgagttggtgggaggttcccatgggtggtttacagtgctgggaggtagctctcacttatccacctggtttggagtatgagaggaagctacttagttgcatgtggtgtggctgtacaggtcaggtgctccctttcacgggaggctttccagggccaccagcttgtgctgtggctgtgtgccccaggaccatggacagcccatgattcaggcagtgggagctttgctagccactgctacgcagagcactagacagctgaggtcatgtctggggttcctggacccacttatatattttttaaaaatctatttagaaagtttccaggccaggcatggtggctcacacctgtaatcctagtactttgggaggccgaggtgggcagatcacttgatgtcaggagatcgagaccatcgtggccaacacggtgaaaccccatctctactaaaaatacaaaaaaaattagccgtgcctggtggcaggtgcctgtaatcccagctacttgggaggctgaggcaggagaattgcttgaaccctggaggtggaggttgcagtgagctgagatcacgccactgcactgtagcctgggtgacagagcaagactgtctaaaaaaaaaaagaaagaaagaaaaagaaagttccccttatttgctttgtttatttgcaggacttggctagaagtaggtccccaaaaatatcatagctgttactattactgctgctgttattcccccttttccactcttctttcccctcctctcatgaaagcccttctaaccgcaaaggtgaactggctcctctctgccttcccactattcatttaggctgcgaatcagcagatgttcctggagatcaagggtggggacagggactttgaacatggatgccagcaggagaggcatcccgccgacctccaccgcctggggccaccacctggtgccatggaaagaaccatgcttttaaagcgcacagcggtggcctggcctggttctctggttctcctatttattgtctacaaatgctagcttagccgagtcacttctccttgctagatttcagtttctccttcctggaaaagaagaagattggactagataggatctacttttcagccttttcattcagcaggtattttgagagggcctgttgtgtgcatggccccggtctaagcagtaggttgggtagagccgtgagtgaggcacaccaagtcttaccagctttctgattagcagaacattctagcagcctaggttcttggatttctgagggtccttggtgcatttctccagctcctgaggcctcgctcctggtttctgcttgggggtacttccagcttctgagccaaagatactgagaccagccttgggtggtctgccctttgcaaagaaattcacagctcaccagggtcagggggtaaatgtgaccaaaccccagtcactcactgcctacctccctctctgccccacaatggggatgctgacggggctgggcacaatgtagtgaattcttataatttatgctgcctcaggatccattttggtttttgttgttggttttgtttttgtttgtttgtttgtttgttgagatggagtctcgctctgtcacccaggctagagtgcagtggtgcaatcttggctcactgcaacctccatttcctgggttcaagtgattctcctgcctcagcctcccgagtagctgggattacaggtgcccgtcaccatgcctggctaatttttgtatttttagtagacacagggtttcaccatgttgcccaggctggtctcgaactcctgacctcaagtgacccaccctcggcatccattttaaatataagcttacttttctcacaccagaagcagggctcagttatccttgacacagtctctcctgctacacctccccgccgtccttcaatgtcatacacagctgctccctggtgctcacctccccacgggacagctagagacaacctattcagcccgctaactttcaccccctacacagactgcagatatgccacagtgaccccctctcagtcacagcatgacctcctggaactcatgcctgcttgctcttttgcatttaaacccaccaattaaaattccctatgggaaatgtgcatggataatgccctgggcttcaataaaagccctgatgcatagggggccccccactttctctttctttgtgcaccccctgatcattccctctctgttgtggaggaggggctctaggcatgccgtgaacttcccaagacctgtaagtaataaaacctttatttctatcttgtgtctctcctaatcgttgaaggggcaacctctattataaagacctgaaattaaaacacatgggaagcagtggctctgagcttggggagccaggttcctgactgtcaagcccttgccacagccaagaggttgctcaggggctgccaggggtgggtgcagattcccacacagttacctaggagaaaggcatcaagagggatagaaggaatgtactccgggaaggccagcttcaagggcatgaggtcatgagccacccagactgaggacagccctatggggacagacagatgacagagtgggtcctgaaaaactgttcttgtatccactgtaatgggctggctagcttgtggccaacccaaatttctcaggcatgcaccaagaagaatggacccaatgaataaaagctgtggcagccagatctcagagcacaaaatccaactcatgccaaattcatatccgctgtacatttagaaggaccatagcatcgcagtcaagatcataagcattgcggccgcttgcctgggttcagattctggctttaccacctgctagctgtgtgattctggacaagttacttaacctctctgtgcctcagttttctcatctacaaaacagagataataataataactcccacctaatagggttgacagaagagagacagaccctctcatattgtcttatattgttttatactcagtacctgttttaagaaaaaacaacaaggaagtaaaaccaaagacaggcagcccggcgccaggcccgaaacctggcttgggcctgcctggcctaaagccagtagttaaaaatcaactcataacttagaaaccgatgttattcatagattccagacattgtatagaagaacattatgaaactccctgccctgttctgtttctgtctgaccacctgtgcatgcagcccctgtcacataccgcctgcttactcaaatcaatcacgaccctttcatgtgaaatctttagtgttgtgagcccttaaaagggacagaaattgtgcattcagggagctcggattttgaggcagtagcttgccgatgctcccagctgaataaagcccttccttctacaactcagtgtctgagaggttttgtctgtggctcgtcctgctccagggttatggtgagaatcaaattgctattatattgtattagaacagtgaacagcacatagtcaacgccaccacataagtggtgttgctacttctttgtgacaatcaccccttattttatgtagcatataaagcttacaaattccctccaaattcattgtttgaaacacaaacttgttgactttgttcattcatccactagattgtaagtgttatgcaggtagggaaatgttagttgttttattcactactgtgtccttgaagcccatgacagtgcctgacacaaagtagttgctcaataaatatttgttgattagatggatagatagatgggtggatgaattcaacaaacatttatagaagcctattatatgccaggcactgaggattcaaaggttaaaaaccgtggtacttgccctttgaaaaagacttgaattgactcataattcacttctataatgatgaaatgcattactctggaattatcagccatgagagtggtggtactcagtgctgattttgcccccataacctgaggaactagacacaactcaagcagggatagtggccctacatcagggagccttcccccaaaaggctggagggagggaatggtaggcacgtgccctgaaaatcactgtcttgttggctctgttggcgatatgaatgtctatcatctatctggtactatgatggttttttgtttttttttttttgaggcagagtctcgctctcgcccaggctggagtgcagtggcgtgatcttggctcactgcaagctccgcctcctgggttcacgccattctcctgcctcaccctcccaagtagctgggactacaggcgcccgctactatgcccagctaattattttgtatttttagtagagacggggtttcaccatgttagccaggatggtcttgatctcctgacctcgtgatctgcccgcctcggcctcccaaagtgctgggattacaggcgtgagccaccacgcccagccctatgatggattttgttttgttttttactattgtgtcttaaatgaactggttccacatttccatgtcatcctctctgccctcatcttttaaagtctatttaaaaaacagacttcccaaaaagctgtggcctgagctttttgtatcatctataacacactgtcccatactgtcattatgtccaatagagttttcatacagtgaatctgaacaaatccctctctccctagacacagtaggagggaatggtagaagattccctttccccacatcattgctcctcttgttttttggcattgtgggtaaagcagggacttgggaattgaggcttgagtttaaattccaggtgtgcattaagtaaataaaaatcaaaactacaaggagataccacttcacagtctctaggatgactgaaacaaaaagacagacgatgagtgttcgcaaggatgtagagaagctggaaccctcagacattgtttgtgggaatgtacaatgctacagctgcatggaaaccaatctgacagtttctcaaaaagttaaacatgaagttaccgtaggacccaggtatataccactcctaggtatatacccaagagaaatgagaacatgtacttccacacagaaatctatacacaaatgttcatagcagtgttattcataatagccaaaaagtggaaacaatccaaatgtcaatcaactgaggaatggataattaaaacttggtatatccatacgacagaagataatcattcatccctaaaaaggaatgaagttctgatacatggattgaccttgaaaatattatgctaagtgaaagaagccagacacaaaaggccacatgtgattccatttctatgagatgcccagaataggccaattcacagagacagaaaggagatagtggtttccagaaggaaagccatccccaaaatgcatctggtttaaacatggtcatcttattaagttcttaccatagcctggaaaaaaaaatacaattctatttaaaactcaccagggattgcctggttaaaggattcattatagaaactcttcctgtgttaagagcataattacctactaatttaccttccactcctccggcctaattttcccatcatgaacttgtttcaagccagctgttgctgtattctgacataggtgctgtgcttagtatgagtgggcatcatgctgctgaccgcctgctggtgaaaacgtttcaaagcattctgccaagttttaaacaaagcctcaaatgaaacctgcctctctgactgtatcactctcagtgataaattggcttcccccacccccccccaccttcttttgaaggtgtccctgaacgaaatcaaataataacaggctccatctcaaaagcccaagtaaggaggcagacaataatctttcatcagaatcctatttttcaaaccaacatttagcctgcataaagctctcaatggggcaagacccggaagcagggtgatggggagaagagcaaggcccagaggacagtttggaggcagaagctcaatagtggagtgtactcctcctgccaggccgacaggtgcttcccgtggaaggagctgatgccagcatgaaccccttcccttccctggatgatggctggtgaaaggcaacgcctgacaaatcctccaggaatagaagaatcctgtaggggccaatggattgaatggaaggaatgctacagcaccaaggagcctagcaattgttctccaaccagaaaacttgttttacaaattggggaacagcatttgtggtgaggaaagggagagtcttccccccaggccacaggagatggcagggaaagaaacaatcaagagctaagccacctgtggggatttgtagtggggcccacaagggccattagcgggaaacacagtgcgaggctgtttacctctcagttcatccccaagccttctgattgtcttaaagaaaaagccttatttggaggtggtctctctttaggattgaacatttgctatctcaattttgacatggaccacgacaccggcagtagttccaagctaggatgaacactggttgagtttgctgtggtgggtgtagtgattgttaagggttatcctctatttatgattcatgattattctttctttcccttatgatattgatttcaagttttccttaatcatatagctatttgtgtccaaaacgtggtcacagataggtcaaaaatctgaaagaggagtgagaaacactaatctagtcgaaacctatactaatggtgtgaatcgccaatccattcctcttttgaaacacacacacacacacacacacacacacacacgcacgcacgctctcaaggggcctttacccagtgaaccaaaaaggtttccctttccacatgtgttccatgaggagattccctgcctatcactttcttgccttgccaaggtgcattttcatggatccctgtgttctccctgctgccagaagtgtccctggtcccctcccatactgagcctgcttcctccccatcagcttcaggaacgctgctccctcctgcaactctgggggtcagctcccagttgcatccttcctgagtcccatcctcccagctgcagtgtcctcagccgcccactctcccgcttcctgggatccaggtcacaaggccctttgctttcatctgggtttagctgcctatcagtacacactgaagtgatcacaaccagcaggcattgggaagtaatagttcccaagctgagcagacaagtcccctcctgctgggcactggagtcatcccccaccctttgatggctcaggaagactccagcactgcactgcgacacttatccctctctgctccttcctcccacctcactccagtggggcccctttcttcacccaggaaaagtcagttcaggtccttccccaccagctcaaaagtccctagaatcgcagttcctttcctcctggttggctctcagcacacaggtgccttctctggccacccccagggatggtaggactgggaggggctggcctgggggcagctgggagcacttaggattttccaagctttggtgtagcatctctgcaaacaggtgggttgggcttttccttctagaaacttttttcatctccactgaagcataaaggtaaagtgtgattctttacccctttccagaattttaagccaaaagctcagagctcccactttgcagcttacatttgattcaaatcatgcaatccccactccaggatcaggaccaccagtcaccaagcagcctgggtggatatggccttagactgtatcctcagggccaactccagctcggaggacagtccttagaaggtggcagcctctctctcctgccccctgccatccacctggctaccctgcaaacagtggctgaaagcctgcattgagaatgccagtcatacactcctagaaagggacacagtggggactatggcctgaatatctgtgtctctctaaaattcccatgttgaaacctaatcaccaaggtgttggaattagtattcgaacatagggctttggagaggtgactaggtcctgagggcttctccttcatgaatgggattaattaccttatagaagaggttcgaggttgttcacccctttgccttttgcccttttgccttgtgcagacacagcaagggggaagcagggggcagcccttgccagacacctaatctgctggggccctggtctttataaattacccagtctcagacattttgttattttgttatagcagcaggaacacactaagacagagagaaatatgtccagccctttcccaatgggtcagatctaaacagaggaaagtggaatagtgtagaggaaagtggctccccaaaggcaggccatcttcaagccccaaagactggctgaagcctaggttgccttttagatgtaggaacacccagtgaactgaggagagaggctggaaattgttagtcccaagactctctggtgaaaaatggtgcaagctttcaggggacccttagaaatgccaatcaaagtctttcacatacacagaaagctaatttatggctaaaagaatgatcaaaacagcagtttcctctggaaatgggggtagagactgaattagaatgggacatgaaagaactttccagggtgatggcaagattctgtaccttgattttgtgtgttgcattgtaagttttatctcaaaagaaaaaaaactgtaaacaaatattaaattatagagcagtgcagtctaatagaatgttctgcagcaatgaaaatgttctacgtctgttttgtccaaaggctagccactagccacctgtggccatggagcactggaaatctggcaactgaattcagtgctatttcacacagactctcaccctatggcttgggcagggccatggtgatttctcataaatacaaaggggcattcttgggcacacagtggttaagggactcaaccaaagtcacacacagcagcaagatggccaaagctggaagtctctgaacctcccacttctcaggagtgagcttgttcccctcacctcccagggagagaccccttagaactgaagtaaagagagctcactgaagggtagaaaagcctgagagcctcggcagatgctagaaatcccgaactctcggctcagagagggcacacttcccttcctgaaagaggacagctttggtctaacaatgatactctagtccgtttttacactttatattttagaaagctctttcacacgcccacagtctctcacttcatcctcacagcctggaagagatcctcccttcctcccttcccacctccctccctccctcctttcttccaagtggtgggcaacaagtaacgactaagggtaaaacgtttaggctttggagttggacttccagggcttgatttcgagttcccaagcagatgactttataaaatggtgcattttaacctttctgtgtctctgtcaacttgcaaaataggaataataatagtatttgccttgctgggatggcaagagaattaaataaaataatccataccaaaccccctatcatcatcatcatcatcatcatcatcatcatcaacttatttattgagctatgtacatgtcaaagttggagcaggagctgaggcgaggggcaagttcagaagcccacaggaggcagagtcctgatgaactgaactgagctggggtggctgagacttcacactaagggagggcgggttgccaacacgctctcccctcagccagagcaagcacctcagctccaaattgtttgctctcaaagagggattgccttttgctcacaaatctctcacctgcaaaaggtctgcttcctgagccaactaggagataaatcactaggatcatcatcatctttcatgttccatctccctttgcccagcaagccccacaatggcctcttctatttagaggctgcagccgaagacagaaggaagatgcacaggatcaaattaatgttgggaaaaaggacttctggcctcctatcttctactagcctattaggttgagagatggaaaaaccaaaactgtgtgtgtgtgtgtgtgtgtgtgtgtgtgtgtgtgagagagagagagagagagagcatttacatttgcagaacattatacttacaagctaagttgatccttataaatgcctagaagggcagatattttttcttcctactttttgagataaagaattgagtcagagaggggtaaacaaactacccaggagcagctgtattaaaactcgttgtgagttagcatcatcccatcaattattagatgtctgaaatgttgcttggaaagaaagcaccacctttgatcaggaaggtcattgctgaagtcacagccaggcatctgtccaacagggtcccactggcctctttttctttggtcccatcctcaggcattgccgatctgccatcccttctagaacaacctcccccaattgatgcatggcatattaaatgctggcgggcagaccattaggtagaacccactgtgctgagcctgaggcgggatggcagcaggctagggagggcagcaggctggggagggcaggagcggggagaattcagagccacacaaaatgcagaggctggcttcatgaaggtaggagacatctgtgagctcagaaaccaaggctccagtctcagccagcattcaagtccacagctgggaagaacaatgtgttcatactttggctgtcaaggatagagctttgtaagtttaactgagactttgtgtcttaattatgataatagctatgatcatggagctcatcttgtttgccaggccctgtgctaaatgccttatctagcttagattctgttgagccccatttccattgatagatcccctgtgaaatagacaccactctcagcaccatcttgcacatgaggaagctgaagtgtgccagaaggctacccagctcctggtatagaggtgtagccagaatttgaacctaagcagtttccagagcctcatgctgaactgtctgtgtaagtctcgcaccacaaaagacccttttctgagcctgggtacatctaacatatatgtggaagtttagatgcattttctgaggcactgcataacaagtggaacatctcatttaaaacccgtatgattcattttagccatggagatgcaaataaagcttctctttattcagtttactaagcccctgctcacctctaactgaagactccgaagacttcggtcacatttctgtccataacattgatgtaaatcaaataaaccaaattcttgtctatctgaacttatagaaatcacaggctgacttctgagtcttgaacttcactgtttcattttatggcacttcagaggctggacatcacaccatagtggggacatatttcctaaggtagaggccactgggcttgaaaaaagggctctgtccttttagcagccatgtgtcagagggtaggagcttcacctcctgcagcccagtcccctggtcctgcctgcccagagcagcatcaccctcagtgtgccaggcacctgtcctgccttatctaatttgacccacacaacaaccatttaagttaggtactaattacaacttgcattttacagatgaggatgcagaggctgtgtattagtccattctcacgctactataaagaactgcctgaaactgggtaaattgaaaagattcacagttctgcagggctggagaagtctcaggaaacttaaaatcatggcagaaggagaagcaaacacatccttcttcacatggcagcaggagggagaagaatgagagcagagttaagggggaggccccttataaaaccatcagatctcgtgagaacttactcactatcatgggaatagcatgggggaaaatgcccctatgattcaattacctgccacacacatgggagataattgaatggtccttcccaggacatgtggggattatggggactacaattcaagatgagatttgggtagggacacagccaaaccatatcaggcccaaagggaaaaatgttttgtctggggttggatggctaatcagtgatttggccatgttcattctatacaagctctgtccttgaactaccaacatgcctgtggatattctacaaatggaggagctctgcagaaggtaagggcctatcagaagcatgtaagcacgtccaagctccaagcactcgagctcactgagctgcctgggttcctgcctaatcctgttctctccgtctattggtctgtctaataagtatagaagaaataagagctggttcaatagatcaggagggtgactacattttacaataatttattgtgcacttcaaaatagctagaagtgaataatttgaatgtttctagcataaagaaaagacaaatatttaaggcaatggatatcccatatacacagatttggtctttaaaaattatatgaatgggctgggcgtggtggctcacgcctgtaatcccagcactttgggaggctgaggcaggcggatcacgaggtcaggagatagacaccatcctggctaatacagtgaaaccccgtctctactaaaaatacaaaaaattagccgggcgtggtggcaggcacctgttgtcccagctattcgggaggctgaggcaggagaatggcgtgaacctggcaggcagagcttgcagtgagccgagatcgcgccactgcactccagcctgggcaacagagcaagactccgtctcaaaaaaaaaaaaaaactatattaatatattaaattaccatatgtaccccctccaaaaaagtaaaattttaaaaatgaatttaaaaataattttttaaagaaatatagaaggatccatctcctctggctttaacagctcacttctgcctgatggtggtggtgtctggaaacacatactttcccaattcatcagccagctgcatgcagccctcaacacagggcaaggatttgatgagtgttcattcaggaacttatcaatgttccactcctgtggaggtgaggtcctgcagctggcaatgcatagaggctcggatcattggcggctgtccaggcacccaggcagaatgtttcacatccccagcccacgctggcagatccatgcaactgcccagaatgaagtgagtcctgaaccacaacagacaggcccattgttgagctaccatggatggagctcattgaggacttgcctcttccaggactgtgagagagctcctcctccacaaccctcagcccatctcagcttctgttaaccaccttcaccccccaatacccttataagtgcacttacatggcactaggccctatcctaaatgcttgacatgtgttaatccattaatcctaatgacccttacctgccatgctaggtttactggaaaaagctctggtttatattgtatcagattatatcacatcacattgttcaaattggtaatacaattgcatggtgaaaaatacaagagggataaaagaatataagtcagtccatatccaggtgggccattcttccatggctttaaatggagaaccaaaggggcttctcctttcttccttcagtccagccagctctgcactgactttctgccagactgtcagcccttggggcaggacagtggagcctgggctaaactgatatttcccaaagttggatcttttgaggacctctgtctcaatttttatgcatccacatagtacctttactttttattctttacttaagaattagcttcaggctgggtgcagtggctcatgcctgtaatcccaacactttgggaggccaaggcaggaggatcgcttgagaccaggagtttgagaccaacctgggtaacacagcaaggctctgtctctaaaaaaatttaaataaaaaaaatagctgggcatagtggctcatacttgtaatcccagctacttgggaggctgaggtgggaggatcacttgatcccaggagttcgaggccagcctcagcaacatctctactaaaaaagaaagaaatgattcacaacacggcttagtacttggtaagtgttagctactacttacggcatatcccttgccataagtaggagataactgaaaaaaaaaacacaatgaaaaccaaactattaattaaaaaattaactaaagactacctgcccaaagacaagttttctccttgtcaaaattcgagatgaaccaaagttagagaagtcatcagcagtggtgaggagaattgaaaggggaacagcaatcttgcctcatgatacactcttattcactgcccttcctgccttccatctagatccacctttcatggcatttgtgccccttggtccacactctggggaatgctgggccaagcagtagtttcatgggagatggaggaagaaccgtctctccagggagaaggctgttgattccacaagaggcttttacaaactagctgtcccaactccttccccacctacctctccctggttttgctgtgtctatcttccctgtgtgggaattatagtgtctaatgaaagctgttatttatggaagagtgttctcacatgaagagtctagaggcaaaaagggcttgagaccagtgtatgaagaggaactttggcccatagggattgagatggcatcttaagggttccttttaagcctggaaactggactttgaaaaaaaaaaagtgggaggtggggggttccttgcacattctgcagtatttcagaaagatttcatgttcactttcttattaagttcttgatcaacccagtgaaaaatttgggcagatgatgatgaaaccaaaacccaagatgtcacagctcccaaagtttgagctgaggcaagaatccaggtttcaccaccttctgctctttgttccaaactaagaagtcccctcttgaacacttgttcagtggtaaaggccatcagagtataccataaaacaccttgagaattgcttttatgcaataaatatttgaatgaatgaatgtattcattcagttggtgatgatcaaagtgatgatcaataagtagcttatcattgcatttttattacatgccaagtaatggttgctaaggaacttacatacattatctcattaaacctacacaacaatcctataacataaagattatagtttatcatttaggaatcatgttcagctgatggtgtatgaagtagactccagtggcttcaaacaatagttttattagggtatgtgtgtccttgggtctgtgagcactttccaaaataattcaggtaaaatggatctaagagaatccatttccagaactaaacttccacatttactctttcccaatgtctcctttcctatggctcctttaataattttccttctcctagtttacaaaagaaaagtgtatctctcgcctgtcttgaatcatagtatggtgcattgctcatggatgtcaaacaaaggaaccattcaaaatcttggtgtcacaaagcctcccttaatcaaggtaccataaatcaatgctctcattgctacccaatagctcattatttttcccttaaacacatttcagttaagggtgaaacatgctgttagaaatggggtattttggactatactgggatgttttgaattcagacatattgtagagtgatgtttaggagtgatgacaatttttatttaatgatatctcacctcttccaaactctaagtattgtcaaagaatacattgcttctgaaggaaagctcaatgagtaaagggggaaaaaaacctgtcagtgaaaaatattgaatgaagcagcatcttatttcatttggtgacacattcatggcaccttatcttttttacttagaattaaaattcagaagtgaggtttgcatgggattttatattaatatatctacttgagataataataactgattacatgtatatataaatatggagaaatttattgagttatacacttaggatttttgtattttatttatataaattagacttcaattttagaatataaattaaatctgatgctaatggcaaattgagaatatttaaccaatctcttaaggatggcttaattgaaatagaaaatggggacgtagtatttttaaaatcccctttaagccataggagaactactaaaacagtaagaaacaaaaaacaggtaaacaaaaaagctggccaagatctaggacaagacagaaattcagagatgcaactggtgccatagaggtcggtctgcttttctcctggggacgtttgataattctgcctggaaaagccaactataagaatgagaggcgaagaggctgaagagtgcttctttgttgtttgtttgtttggttttttttttttttttgagacagagtctcactctgtcacccaggctggagtacagtggcgcaatctcggctcactgcaacctccgcctcctgggttcaagcaattctcctgcctcagcctcccaagtagctgggattacaggcgcacgccaccatgactggctaattttttttatatttttagtagagacggggtttcaccatgttggccagactggtcttgaactcctgacctcgtgatccgtccgcctcagcctcccaaagtgctgggattacaggcgtgagctaccgtgcccgacctgaagagtgcttctattacttcacaagacaaaagggacacaagttggataccaaggcccaccatagcagtggtacctaggagtaaaagagaaacaaaatagtccctgaagcaacataaaactttttctttgagacagtctcacgctatcacccaggcacaagggcagtggcacgatcgtggctcactgcaacctctgacagtcagattcgagtgactctcgtgcctcagcctcccgagaagctgggactacaggtgcatgccatcacacccagctaatttttgtattattagtagaaagagggtttcaccatgtgggccaggctggtcttgaactcctggcctcaaatgatcccgccgtcttggcctcccaaagtgctgggattacaggcgtgagctaccgtacccagtctaaaccagctttaactaatttcagtctttacatctggaataaggtgatgcaggatagctggtgcccccaaacatctggcagaagcaaaaacaaatcctctctagaaaaagaaaacatcctcctagattaaacattatcttttaaaaaacaacttttcaaatacaattcaagcacacaataaaagataaccagccacataagacaagacaatatgaaagaaaagaagcagaaacaggccaagcccagtggcttagcctgtaatcccagcaacttgggaggccaaggcggacagatcacctgaggtcaggagttcgagaccagcctgggcaacatggtgaaagcccatgtctactaaaaatacaaaaattagccagatgtggtggtgggcacctgtaatcccagctactcaggaggctgaggcaggagaatagcttgcacccaggagacggaaggagcagtaagctgagattgtgccactgcacttcagcctgggtgacagagcaagactctgtctcaacaacaacaacaacaacaacaacaacaacaacaaaagcagcagcagaaacaataaacactagaaacagacccacaggggctccaaatactggcattatcatatatagactttaaaacaactatactgtggaaggagaattgtgccaccatgaccaaatacaatgtgtagaccctgtctggagcccgggttgaaaaaaaattaaattgttaaagagttgtaaagctaatctgggaatactgaaaattgaaggtgaacaaggtagtaggtgacattaaggaatcagtattaatatcacttagtgtgattttgtggttatatatatatatatatatataaatgtatatatgtatatacgttttgtgtggggggggggggtgttttttttgtttgtttgtttttttgttttttgagatggaatcttgctctgtcacccaggctggagtgcagtagggcaatctcggctcaccgcaacctccacctcttgagttcaagtgattctcctgtctcagcctcccaagtagctgggattacaggcacatgccaccaaacaagctcatttttgtatttttagtagagatggggttttaccatgttggccaggctggtcttgaactcctgacctcaaacaatccacccacctcagcctcccaaagttctgggattacaggcatgagccactgtacccaaccagttatatattttttaaagttcatattggttaaagaaatacgctaacatcttgggtttgctttttttaattatatatatttttagatgggggtctatgttgcccggggtggactcaaactccgggactcaagtgatcttcccatctcagcctcccaagtagctagaactacaagcacacaccagcatgcctggctctttgaatttgctttaaactacaattcaaatttaaagctttagattgctttaaagtaaagaaggaagcggaagtgaaagaggaagaagaaaaggaagaagaggaagatgatgaaggaggagaaggaggggagcagaagcagcagcaatgggggagggagtaaggaatacattttgtaaaggaattaaagaatattgatcgttattgaagcagagtgaatacacagaaattcattatactattttttccgcctgtgcatatttaatacacagatccatacacaaattgttcataatttaaaagttttaaaaattctgtgcttcctgtgtatatgcagataaaaggaaaaaaaaaacaatgtcagcaaaatccagaaactatacaaaaagacacaccagatttgggggaaaaaaatgggaattctagaattgaaaaacacagcaagtaaaaattgcttaaaattgtgttcattgagattctagaagataatatgagaaactaccttcatagccccagtgtagggaaaaatttcctcatcaggacacaagaagaactaccaatgaggaaaagcttgttactcagaccccattaaaaaaagaagttcttgttcatcaaaaacaaccatttaaaagtaaaaagacaaatcacagagtgggagaaaacattgtaatacatgtaagtattaatgggatcatatccaaaatataaaaaagaactcctacaaaacagcaagaaataaagattgcaacagataaatggcaaagtcttaacaggcaactcacaggaagaactaagtctcattcattatcagagaaatgcaaattaaaaccatggtgagctacctccatgtgccctccagaagctacataaaatgcaaaggtatatgcaggagttacaaagaaggtacaaatgtgtggtctttgagctgatgaacctaagtgtgggtgaggacgtgaagcaacaagcagtctcctatgagtaggagtgcaatttgggtacaaccactttgaaaaacattggcactatatactgtaattgaagacagacatgttctagaattcagcaattctacttctaggtagaacagaaatgcatattcatagcaacatgattcattgtagtaccaaactggaaataacctaaatgcccattaacagcagaatgggtaaatttattgtactaattttatacaatggacaactgtagcaaaatgaaaatgaacacatgtaagtatatgtatgaatttctcaaacacaatgttgcaacacaaaaggaaacatacagtaagatttccatttataaaaaattcaaaattaagcaaaaactaactgtattgtttagggataagtacatgcatggtaaaattataaagaagaaaagcacgcttaccataaagtcaggatagtggtatcctctagcaggaagggagggaagtgtgagtgggaaaggagaggagctgcgctttctaggatgccagaaaagagtgatagttacatgcaatgagaacacatggacacaggaagaggaacatcacactctggggactgttgtggggtcggaggaggcgggagggatagcattaggagatatacctaatgctaaatgacgagttaatgggtgcagcacaccaacatggcatatgtatacatatgtaacaaacctgcacgttgtgcacatgtaccctaaaacttaaagtataatattaataaaataataataataaaaaagagtgatagttacatggatgttggcttttgattatttgttgacttgtaaaagtttgcttagtgcaattttctgaatgtgtgtcatatttcaaaataaataatcttgactcattggtttggcaataagaactagctttaccatctaggatatttggtggacattttccaatgtttggatgaaaatatgtttaaagctggcactcagacaaaagcattccatcaaaaatattatgctgataaaggtaaattgaaatttatgtttggatatctcccaacacgttttgtgaatagcagtttaaacaagtgcccctgtgtaaaggaatgagaaggtaattaatagtcatttgataggttttggtgcatagcctttttgatacaattcccagaaactgagaacgtgaattactctaacgattgggttgcaaatcctatgaagccaatgatttctaattccttgctttcaagaaaattaaaggaaggcttaatcaaactattagctgacagaatattaaaaatggttttgatgatatatcattatgcaattttagcatgcaattcataaaaagttcaaagaatcatgacagtgctataataaaacatattccatttttatttacttatttacatgaacaaggtttctgagtgctaacatctacaaaaacaattaataggaagactagctgaatcctgtttcattctagcagtatgtaatattcaaccatgaatgaacaaaccaattagttgaagaaaaatactccattcatctcattaagaaatgcatttctcaatttatgtttatgtttattatttataaaattttaaaatacttttttctcaattgtatattcattaaaattgtaatgtagcttaatttggacaaaattttaatcctcagagatgtatggtcgcacaaaataagaaaggattttaatgtatgtgttcctgtgtatggaattttattgtagaaacattggcaaatgtaatctataaaagactttcaagcataaaagtatgttaggttgaattcctataagatacacaaaatgaaaataagagttcaagcagaaaaatgaacgatctaaaattaaaccgttaaaggaggttttgttcatggttttgttttttgtgttttttctttgtttgtttttgttttttttgagacagcatcttgctctgtcacccaggctggagtgcagtggcatgatcttggctcactgtaacctctgcctcccgggttcaagcgattctcctgcctcagcctcctgagtacctgggactacaggcgtgcaccaccatgcccagctactttttgtatttttagtagagacgaggtttcaccatgttggccaggatggtctcaatctcttgacctcgtgatccacccgcctcggcctcccaaagtgctgggattacaggcgtgagccactgtgcccggccttattcatgtatttttaagtagatgatagtgaatatcagattattataaaatttatatttctttgaatacactttgttttttgagacagggtctcgctctgtcacctacgctggagtgcagtggtacaatcagggctcactgcagcctcgagctcctgggctcaagcgatcctcccatctcagcctcctgagtagctgggactacaggtgtgagctgccacacccagctaatttttatattttttggtagagacagggttgcccatgttgtccaggctagtctcgaactcctgagctcaagcaatcctcctgcctcggcctcgaaaagtgctgggattacaggcatgaaccactgcgcccagcctcctctgaatgcactttaaagaatgatgtgacagttttagaatgttaacagtttcagtaagtcagaattacattatttgaaactatttaaacttattaagaattttagatttcaactttaaaatgtgcataaggtacatagtttttaaagcctaatggctgaaacagactaatggtttattctctgacataaaagaagttggagatagacaggttatgcttgtgtggcagctccttgaaactatgagaggctcaggatccttcagtccttctattctgccatccttagaaggtggcttctaccctcaaggctacattatggctactggagcttcagccatcatgtcatgtctggggatcccagagaagggacacaatagcttttaccaggactcctactgagccacgtcccactcctatctgtcagggagcctagaaaagaactttttctactgggcatgtggccaagagccctgttaccacaggagaagatgagaatatacacttggcaggcaattcgcagtcttagtcatgtagaatatgactccatttttattaagttgtacacttacatgtgattttatgcagtgttacatttggaaggatgtttaccaatgtatttgtggtttatcatcggataggagatctcagtttacttttacttacttctctgaacttttctacattgaattttttgatagacatggtcatcctttttttctttacctttaaacaacatgggtttgaacatggtcattcttacaaaaacattacagatatgctcatattttaaaaagaggtaaactgggaaaaagaaaaattagagactttgcagtcaacaacctgagtttaaattccactctgcaatataatttaggcatataacttaatctctatggacctcaatttccactgtataactaggttatagcctccaacagtattagaagtagaggtcatattttcttcttttgttttatatatcaaaatttagaagtcccatttactgggagtgtcttcagagagcacaacagatatatgtcccaattcgggcccatgagatacaagggtaggtttggtggatgcttcggggaaactgctcctccttctcaagagtctctcttaccggggttgttgtgagaacctatgaatcctgaagccaccacagctcaagcctcaggatgaagccagcaccaggagaaggacagagctgagagacacacagagaaaccatagtgtcaatgtgtccagtctggacttttcacttataggacccaataaatctcctttattatttaagccagtgctatggtttgaatgtttgtctcccccaaaatgcatgttgaaatttaattgtaacagtattaagaggggaggcctttgagaggtgattaggctgtgagggctctgccctcatgggtggaattaatgtccttatgacagggcatatttggtcccttttgtgtttctgtcttgccctgtctttgtcctcccaccttctgccatgtggtcacacagcaagaaggtcctcgtcagaggccagcaccttgatcttggacttcccagccttcagaactatgagccaataaatttctgttcattataaattatccagtctcaggtattctgttagagcagtgtaaaacagactaagacagccagtcttggttttgttttattttgcctgtttgctgcaagcatcctaatcgctattcagcttaaaattatgtaaaattacttttatttatattatcttatttgatcctgacaaaaaacctctcaaagtggtcaagagttataatagctgaggaaattgagagccaggatgttgaatgctcaacatcacatgatagaaaaatggtgacaaggatgggactcaaacccaagtttccttggtctgagttcagtttccttctcattgggccataatgcctgcaaggataggcaagcagaaggtgttctgatgactgaaaaggagttgtccacactacagatgcaccatggtctgaatgtttgtatcctccccaaatacatatgctgaaactaatccctaatgtggtggtatgcggcaatgaggcctttggtaggtggttaggtcatgagggtggagcccttccaaatgggattagtgcccttataaaagagaccccagaaagacctcttgccccttccactatgtgaggacacagccagaaggtgccatctatgaaccagcaagcaggtcctcaccagacaccagatctgccagtgccttgatcttagacttcccaacctccagaactgtgaggaataaatttatgctgtttataagccactcagtctatggtattttgttacatcagtctaaagccaccctgggatgtagtcaaagctttggggatgacattaaaagggcggtgcccatggcctcccgaaatcataccaggggatcttgggcttatcaggctagtggcactcaaaaccaagcacccaacagttggatttttatggggattccacctgctaagtggaatccctggagggagacacctggaggaaactaatgagctgttttcagagtgcatagaccaaggagactgggagtgagtctggtgagaacccattgaatatgggcctgaaggttggcatttgtaaattaaacctaaaagctaaaaaaaaaaaaaaaaaaaaaaaaaggtcgagaatactttgtgactactagcagcatcagcatccaacctaggatatcctttccccaagccactcactgacatttgaagttccagaagttatggtaattccttcaactttacaattgagatgcagctcctgtctcacccctcaccacccctcgggagcagggagctactcaacattgatagtcacttattctttattattactgagttattgctcctttcctagaagacagggaagtgagattattgttggcaggggggcagtgggcaagacaggaaggatccccaaaagaaagggtgttgtcagccgggcgcggtggctcacacctgtaatcccagcactttgggaggctgaggcacgtggatcacctgagtttgagaccagcctggccaacatggagaaaccctgtctctactaaaaatacaaaaattagccgggcatggtggcgggcacctgtaatctcagctactcaggaggctgaggcaggagaatcgcttgaacccgggaggcggaggttgcagtcagccgagatagcgccattgcactccagcctggggaacaagagcgagacttcatgtcaaaaaaaataataaaataaaaacataaaaataaaaaaagaaagggtgttgtcaccatgactttgggaacagctgctccctggatgtccttgggcctccctcttgtctgacctggcacagggcaatcaccactggactgaagaagtggcaaagaagcccactaaaccagtctgatgctagaaagaatgaatccttcacctcccacaattcctccctaaggcctgccgcccagaaaataaacgccaaagggaagaaacatttccatttccgtctattgacctcagagcctcttccaacccaatgttttgatgtcactgcctgtaggtgggctgagtcctgctatgactgagaggggctgaccctgagccaaaagtggaggccacagcagttgacttgcctgcagcttttttggggacacttaggtttcccaaagtttattaggcagaaggacaggaggaacaaaacacaaactggccagctttttggggagaacagtatggtcaacgtaaagtcaggtgaacaatcctagccacatcggatcaatacaagggacaataaaaaaccaaaaaatatctccttactttgtggaacacaattcagtggagtctaacagacctggttttgaatcaggctctggatgtaacctaacaatgtaacctcagacacgctacttatgttctctgtataccagattcctcatctctaaagaggaggtgatgatagcaaatgaggagaaactgaaagcttttcctctaagatctggaacaagacaaggatgcccactttcaccactgttattcaacatagtactggaagtcttagctagagcaatcagacaagagaaagaaaaaacaggcatccaaattggaaaagaagaagtcaaattatcattatttgcagatgacatgatcttatagtcagaaaaatctaaagactccaccaaaatactattacaactgattagcaaattcagtaaagttgcaggatacaaaatcaacatacaaaaatcaatagcatttctatatgccaacagcaaacaatctgaaaaagaagttaagaaaatcatcccatttacaatagcgacaaataattaaccaaagaaataaaagatctgtacagtgaaaactataaaacactgattaaagaaattgaagaggacacaaaaaaatggaaaaatattccatgttcatggattggaagagtcaatattactaaaaggttcatactacccaaagcagtctacagacacaatgcaatccctatcaaaacaccaatgacattcttcacagaaatagaaaaacaatcttaaaacttacatggaaccacaaaagacacacaacaatcaaagctatcctaagcaaaaagaacaaaactggaggaatcacattatctgacttcaaattttactacagagctatagtaaccaaaacggcatggtactggcatcaaaacagacacataaaccagtggaacagaatagagaacccagaaataaattcacatatctacagtgaactcatttttgacaaaagtgccaagaatatacattggggaaagggcagtctcttcaataaatagtgctgggaaaggtggatatccatgtgcagaagaatgaaactagacctctaagtctcatcatatacaaaagcaaatcaaaatggattaaagacttaaatctatgacctcaaactatgaaactactaaaggaaaacattggggaaactctcctggacattgtaatggacaaagatttcttgagcaataccccacaagcacaggcaaccaaagcgaaaatggacaaatgggatcacatcaagttaaaaagattctgagaaggaaaggaaacaataaagaaagtgaagagacaacccacaaaatgggagaaaatattttcaaactacccatctgataagagattagtaaccagaatatataaggagctcaaacaactttataggaaaaaataaaataaaataatccaatttgaaaatgggcaaaagatctgaatagacatttttcaaaagaagacatacaaatggcaaacaggcatatgaaaaggtgctcaacatcactgatcatcagagaaatgcaaatgaaaactataatgaaatatcatctcacactagttaaaatggcttttatccaaaagacaggcaataacaaatgctggcgaggatgtggagaaaagagaacccttgtccactgttggtaggaatataaattagtacaaccactatggagaacagtctggaggtttctcaaaaaactaaaaatagagctaccatatgatccagcaatcccactcctaggtatttacccaaaagaaaggatatcagtatatcaaagatcagtatatctgcactctcatgtttactgcagcactgtttacaatagtgaaaatttggaaatagtcaaaattcatctgttgttcatcaacagatgaatggataaagaaaatgtacagatacacaatggagtaccattcagctacaaaaaaagaatgagatcctataatttgcaacaacatggatggaactgaaggtcgttatgttaagtgaaataagccaggcacagaaagacaaacatatgttctcacttatgtgtgggagctaaaaattaaaacaatgaaactcatggacacagagagtggaaggatagttaccagaagctgggaaaggtagtgggggagtgaggggaagtggggatggttaatagacccaaaaatattattagaatgaataagacatagtatttgctagcacaatatggtggctatagtcaaaaataatttaatacatttaaaaataactaaaagattataattggattgtaacacaaaagataaatgcttgaggtaataaataccccattctccatgctgtgattagtattcagttcatgcctgtatcaaaatatctcatgcagcccgtaaatatatagacttgctatataccaacaaaaatcaacaatcaaaaattcattaaaaaataaataaaaaggaagtgattataatgatgctacctcacagaaatcttaaatgaaataatgctcataaagtacttaatacagggcctggcacacaatacatcgtattcgtccattttcacactgctataaagaaatactggagactgagtaatttataaaggaaagaggcttaactgactcacagttccacgtggctagggaggcctcaggaaacttacaatcatggtgcaaggcaaaggggaagcaaggtccttcacatggcggcaggagagagaagagtgaggattagggggaagagtcccttataaaaccatcagatctcatgagaactcactctatcactacaacagcatgggggaaaccgcccccatgatccaatcagctcccaccaggtatccccctagggattatggggattacaattcaagaagacatttgggtagggacacagccaaaccatattatacatgttcattaaacggtggctcttatttttgtcttgggtcagagagaatggaggcagatggaaaatattgcaaagagaagaaaagtataaattgtgggggcaatggggatggcactggcatttttttgaactttaataataacattgcaaacccagtaaatggttaccagacctaagtttgaacaggcaaggtgtttaatacagcttgttgattggatttacgggtccttccgggcctttcatggagcttgggcctgctttctacctttattgcttctgatgcctaaggctaactccccagggcagcttgactcccaacagggaagtctcatttaccaaaaagtctcagtgattctgttttccctgtcttttttgcttttattattgtttttatttttttagagacaagatctcgttctgttgcccaagccggagtacagtggtatgatcatagctcgctgcaaccttaaactcctgggctcaaaggatcctcctgtctcagcctcctgagtagctgagagtacaggcacacaccaccacatctggctaatttttaaattttctgtagaaatatgagtctcatgatgttgcccaggctggtctctgactcctaggttcaagcgatcctcccaccttggtctcccaaagtgctgggatgacaaagcctccatgccccactgtcatgatgattccgaatcacctccagcaagggacaccctcttcttagggctgagaataactgccaatgaggaaccatggatttggaggcccttcaagggtcagatcttggttccaccaggttcccatcctcacctgtcatcaataaccagcaccttggtctccttgtcccctgccttcagcatccctggcagattcctgatggtgacactcccaaggccacttcacaggatggaccctcatgggtcatctgggccaaacgcctccatgataaagcataagcaccagagaggaggtggacttgtctaggttacacaggaggcctggggttgctattgggctcacccaggtctagggagcccaggacagcagtcatcaccaccccactctcagtaacactgtgctcttcagtatgtagacagctcacatctatgccccatgcatgatttacaaatgtaaagaccatgcacaggagctggcttagcaaaaattgataagcagcagccctggttatcattactgtcactgtccttgtatctcatagcttcatactacacccaagtcaccataggcatgggcatctttgttttatagtaggaaaccaaggttcacaccttagcctgcaggactttgtaaaaaccctgctgtgggtaaagagcccaaaatggccagcccctcagccttttgctcccaacccccaagccctttctcctccagggcactgcctcccaccctcgtctggtcaggggaggccaccagaggaggagtactggcctggcagggaacactggcagtctcggcccttcaccaaacagcaggggaaaggcagcaagccccgccccggtggccccaagatatgggtgccaggaacccgtcattcagagaccacaaatgaagaaagcagggaggccagcccagccaggcacagctcaccccaccctgctgggaaaacccattgtgtttcaccgggcatcctggggtgctgttgtgggccaagaatgacacttgcctcacgccatcaaaaccagaagggtatcctaaggggagtaggctcgccccgcagagccacactagatggaagcaaggcgagtagccagggcagagcccaccccccgcacctccctccccacagcctgtgtagacacacaggccggcagagtcaccggggcagcaggtaggaagggcggttcaggaagccaggtacttaccacaggggagcatggtctcttcagcctcaccctcaggttctcaccgtgggctccactgggcatccataggaccctgcagttgtgggcaaaaccggggagacccatacagacatcgttttcctggggagaaagaaaattcgatttcatcagagtcctaaccctgtgcatgccttgcacagggacagacggaaataagcttcctccctacccaggtcatgggcctctgcactcagtgacaaaaatgggagagcacagagccagctccccacacccgctgaaaaaacaaggagtccctgaggcctcatgttcaatcccacccccacccccctttttaagccctgtcaactctttctcgccttcagtcatcagcttaggtgcctcttcctccaggaagctcgccttcatcttcccgggctggtttaagggcactttccgtgccatgtgctcaattccttgtgtccccactaaacctcagatcccacaggagcagtggcggtgtctgccgggttctcgctctgtcttctgctctgctaaggtgcctggcacaccatgctctcgatcccagatgagtgaatgaactaatgaatgaatgaatagcagcaccacatcaggctgctctcacataacccacatggctaaggagaggtctacgttttattttttaagaaggcagagctcgagggggccttgaagtcacatcgccggctgctgagtctacgaacagggaagcagccgcagtccccgaaaggacccgtcccagcgagccagggcctggttttccttccgcagaaggcggagggaccggagcgggcgcgggcacccctgggctctgaggggcgcgctctgaagggcggcggacttcagggccatgctggctgtccccagaaagcaggagcccgaaaccgcggggccaacgaacgcccacattctctgctacaacctcgccactcccctgcgcctctccccttgccccctgcccccacaggtaacgcccagaacgagtgcttctcccggtggggtactgaggagcctgggctgcagctgccgagccgccacagccacgctgagcccggcctggcctgcacactggcgccaccgcctggcggggagcgggactgacgcgctcctctccctctcctccagcccagatcacggaggcgcggagctccatctcctgccctgggcgaggggagtgagggagacaaagactttgggcacaacacccaccacatagaacctattctctagttgggaaacaagtcaaggcaaaggcgcacagagtgaaagtcagtgtgtgagcaaacaaaacaccagccagcagaggttaagcttctatgcaaacaggcctgcctgactcagggagcaggggagactgaggcagatgagaagctcccgccgaggccaccaggatgcccaggccttggggctccaggaaacgtggtctccacgctcaatctcggctcagccttccccagaagatgcctctagccggacagagctgggttttaatcatgccgccttcataagccaggtgcatgatctctggctagttaactacaggtgcatttccttaacctatttaaaaaaggggtggggggatggttaggaactcttgcctggttgtgttgttgttacaattaaatcatgaatatggagcatttgatgcagtgctcagaatagaagctactcttaaaagcaatccactcataatagggaacgaaggttctagaatggctactttttaaaactataaatcagaacagattcaatataagaacatcactctcaattcttactcacttccattctggagtagcagagaaagaagcagaggggccactggctgcagagggaatggcccagagctcacagcctgtcctggttaagtggcagccatggggaggccctagagaaatgtcaccaagaactgtggagacagcaaggagtaaatgctagcactgattgtctgccaaatgccattcaatgaactacattctttacaagcattgactcatttacttctcacaccacccctacaaataggtgtcattatcatccccattattttagagatgagaaagctgggacattcacagattggggacccagaccaaagtcacactgcatctaagcagcaaaactgaaattgtagccaggtgttctggctccagagcctctgctcccaaccaccagccaatacctgcctctctgatctgggagctatattcattcccacttctcaggcgagaaaactgctgttcagagcgatgaactcttgcaaggtcacacagatagtcactggcagagctgtgatttttagtcttgagctttctccctaattcaacttgggatagagaaagtaaaagctggccaggcgcggtggctcacgcctgtaatcccagtactttgggaggccaaggcgggcggatcacgaggccaggagattgagaccatcctggctaacacggtgaaaccccgtctctactaaaaatacaaaaaattagccgggcgtggtggccggcgcctgtagtcccagctactcgggaggctgaggcaggagaatggcgggaacccaggaggcggagcttgcagtgagccgagatagcgccactgcagtctggcctgggcgaaagagcaagattccgtctcaaaaaaaaaaaaaaagaaaagaaaagaaagtaaaagccagcccctctccagccgtcagaattacaaaaggtgaaccggggacctgttggcaatcacatttccgaccgtgtagcagaagctggtctatggtaagagacgataaaaccaccacacagagagaagcaaagatgaggctccgccaacagagttcaagtcccagttccggccattcctgaaatccagctgcaaccttccctttctaaaacttggttgttcaaattcagggtttgactccaggtgtcaataaagccccactgtgtccccaagttgttacaagttggggaatagtcagttgcaaccaaaatgtgctctgccacagaaggtgacatatggaaacaagaggcagaaacccagaagtccagaggatctggaaaaatgagaggaaagagaagccgagagcagcagaaagaacaaagggtgcaaagctataaagagccttttgcccatcttgccaaaccatcagctctctcacttgtccctgagcttgctgcttctgcccacagactgcttcccaaacagctgtgaaaatatcgtgaactggtgcttttgaacatttcctcttccaaatgcatgcaagtttcacagccccctgagtcccacacgtagacaatcacttataccaattcctccttccgataaatgttcatgccagctaaaataactccccatccttcagatccccccacaccaagtagtctccctaagtgcgtgttcttcctgccccccactcccccgcacccctccagcagggtgcttctggaaaggcagatggcatgagtggagagctgacccccagctcagtcttcaggaaggcagggctgttgatgagtcagcggggtctgcactgaagcatctggcccaaattaccaggatgaagactttttcggcaaattgctcacagcccaacaggcagcactccacgcagaccaccccagcgctgctgttagtcacgcgtgcattttaatttagctacagaagaggaaggagcaaagagcacagaataatcctctccttagagaggaaaatgggacctcgggagcttgcatggcttccctcaggtcactcagccagtcagaaaagaagcgctcagcaggggcaggctccctgagcgtgtcctaatcctagtcctcgcagaactctggtcattctgggatcagcatctgcagtggtcacattcctcaccttccccctgcctcccaccaccgtcacttgactttctctcagagctcaaactagaagggatctggttcagttccatcaaccattcattcattcactcatccattcaaagtggcgaggctggaaggggccttagggctcatctggccaaatccttcccatccggtgttcactgggctgtttgactctaagccacaaacattgactctagctaactgaagcaaaagaagactcagagtttatttaaagtaaaagaagaagctcaaagaattggaaaattttttaaaaagctgaagacttgtgtcctaataggacaggctccagggaccttaaaagcatgaatttaatgatctatagagtgcatcttctagcacttttccactggtgtcttctgagtgggctcgttcatgaacaaaacgttttcccctttctctctctcccttgcctcacccatggctgcttctaggtggtgtagcaggcagggaatgggcagggaatgtaaaataaaatacatggcctcttgagggctcatgcagacagattgctggaccctacagagttcctgattctggggtagaactccagaattgtgcatttttaacaagttcccaggcgatgccaatgtcgctgttctgggcaccatactttgagaatcaccactctaaggaaacttcacttaagttttgtgtcacacttagctggggagcatggggcacgctgagaaatagtccccaccacaactgtactcagtgggatcaccaagtcccacaaggctgaaatcaatgggattttcaaatgaaaaacaggatactatgactaaaagagaggatagatgttaggcaggaaaaaacacagaggtacactgtgcccctccccaggtgacatttgaatgttcgtgacatctccaccaggtggccccctggcttaggcttgagttcctccagtgacagaaggctcaccattccaccatacccaatctatttgtggatgctccgataattactaagttctgagtcttgtgacacaagactcagagttacaattcccctctatgtagcaactcttcaaataattgggggtaactctcaggcttcctggggtcagtgggttaaatctctccagctacttctgcagttcttcatgagacatgtggaggatcctccttgcaatcttgaaggagcccaagatctctctttgttgggcaggtgacacctttattgcaagcctggtatctgacaggcccagtgcttcttctggcaacacagtagcaaaaaaggcaaacactgtgcctactctcatggagcattagtgagtaatcaaaatggaactgtgttctacagataagttctcttcagcatgcaacagtgaggctatcacctccctcattctaattaacatgcttctattaatgcaacctgagatgacatcaggtttctcagcagccacatcctaccattgacttcttaccattcttcagaaatctttagaaacatttacagtgcgcccaaccctatgctggatgtcacaggagtgcaacagaagcaagaggcctggtctcagcctctttagaagccactgttagtctcactgaaatgttggttaactggcaactggacaagatcttcaggtcccaaaggagatcctcaaggagtcatcgtcactgattccaaatccagggtctcattaggagcacatggaccctctgcatcagcagagcctctactgggggccaggcctccaggctgagaagtctggccattatatgtcttgaacttcctccaactgcagcagacgggggctccctgtgccaccccctctaaggggtttcctgaatggtcagctctaaggcaggaatcaggagagaagctgagaagcatcaaagaataatgagctggaaggagccttggcaatcccaagtccaaccttctcattccacagaagaccctgggccccaagaagtgaaggggtggttcgagtgcccactgttgacagatgaatcctaggatccagctcctctcttgccatgaaaccccattccctgcccaccacacaccacccagaaacagccgtgagtgaggcaagggagagagaaaaaagcagacacattttgctcatgaacgagcccactcaggagacaccgatggaaaagtgctagaaaatgcactctacagatcattaatcaattgatgcaacttaagcaatatatcagggggaaaaacctttgttgccaataatggaagcgcctaagacagaacattcttcagtgccggctgggcaacagaaacagcaggcggccataactcaaagcccagaaagcttttgtttttaaacttgcaatgccaaggaggtgagacaagggagccaattctcagggagacaggccatgcggagccaaatgcgttcaggtgatatactgatcagatggtccagatacagttattctcagaggaatgatggctcattaacgagccaagctgttgaccacagctctccaggagaagggaaatgagggctacgtgttttcaaaaccagagctacactcgatgtgacacaagaactagacatgcatgagtgtggagaatcacagtgaatggaaggaagcaagacccttctctcccagacaccttgatgttgtgggttagccttcattagaataggactgattcctggatgggtgacatcatgagctaacacgtgtgtgctgcttactacttgccagacacagtttgctatagttgggatgtttttgctccaaatcacatgttgaaattcgatccccagggctggtggtgatgggcctgatgggaggtgtttggatcttgggagtggatccctcatgaatagattaatgccctccctgggggatggtggagggataagtgagttctcactctgttctcgcaagagctttttgtttagaggagtgtggcacctcctccctcctctctctcttcctctcaccagcgatctctgcacccataggctccctttcaccttccaccatgggtggaagcagcctggagctctcaccaggagcagatgctggtgccatgcttcctgcacagcctgccaaactgtgagcccaataaacctcttttctttataagttatccggccttgggctttcctttatagcaacagaaatggactaagacactgtgccaagcactttgtaaatattaactcctcacaataacactgggtgtgctatgactaccccattttacatatgagtcaactttgtcacagagaggctgaggaacttatccaaggtcacacagctagtagcacagccaggttaggattgaatccaagtagctcagttaggaatgcctgacttcgctgctgtaccactaacagctagaagaataaggagttgctgctgatgctcccagcgtgcccccataaatatacagactactctagtactctggtcttctaacctgccatttgggacctgcctaagctttccaatttgaggtgctgttctctgatatcacaagaaagtacctctataaattctggccatgataatatcttttcttccacttgttgattacagatctctgatgtacagccaaactgcattatttgagttttcttagcatatatagaattgacacattgatataatgtgtaatggccatttacttttttccccctttttttttacttccccgtaatataaagaagagctgcatttgatcctaaactcgagtggccacctctgtatactaaatgagccccaaggataatctgccccattcatcaacactttctagtttgcaccatgttggtgactaaggggacaccaggggagcagatatgatctctactggcaatgaattcagtctcctgggaagattcggtgcaaacgatagttgcaataaaacatggtgagtgctattgtaggactgtgcctaaatgcttcaggaacaaaaagaaagagaacccagctcttgagatagcagcagaaaaagaggttcagcagggagacggggtcagattgaacacagctaaggaggctgtgcagtgttacaggagttgtgggggggcggtctctggaaggatctaggtagggggatattttagttaggaaaaccaccccacccttctacatgcatggagggcaggctagagggcagcagtgctgggagaaagacaactaagtaggagatgacggggccaggcatggtgactcacgcctgtaatcctagcactgtgggaggccaaggcaggtggatcacctgaggtcaggagtttgagaccagcctggccaacatggtgaaacccgtctctactaaaaatacaaaaaactagccgggcatggtggtaggtgcctgtaatctcagctgctccggaggctgaggggggacaatcacttgaacctgggaggcagaggttgcagtgagccgagatcccaccactgcactccagcctaggcaacaagagtgaaactccgtctcaaaataataataataataagaagaagatgatgatgatgatgacgcatagaccaggcaggagatgagagttaaactcaagcagaagcactgaggatggaaaaagagaatggattaaataaaaagaaatcagaggtaataaaaatgaaggttttttcccctgtgtggttcacttggacttcacattcatttgccataaaattttgcatctgacttgatcctgactgaagcatcgtggagatctggtttttaggttaagttcaaacttctgggaaacacaagtcagaccggaagatcagagtttccatgcagatatgatctctactggcaataaattcagtttctggaaaacatttggtgctatcagtcctgtttgcttttgagcaaattatttgcattttctgaaactcagtctcatcatttgtaaagtgagaattatgatatctacctctgcatcttatggcataagctaacttgggtgccaatattgtctcatcccttttcatcttttctaataatgataacaacagcaacctccaacatttactgggcacctaatatgtaccaggcactattcaacatgcactaattcatttgatcctcacaaccaccttaggagatagattctattattgtcaccattctgcaaataaagaaacggaggcagaaagatgcagtaacttgccaactccccaggctgtggcagagcaaagatgtgagctcgccttctctcataattgcctcagcactcgcctaccctgatgcacaggaagtccaacgcctcctttctgggccctccctcctcccctgtattgtccaagaatccttcttcttcagtcctgctccctggcaccagatggacaaagaacaactccagccctatgctgccattgctggatgctgccacacggtgtcgctatggaaggtgtagcctgcaattggcgctggtggtctgttgatgggatgttcttgctggttctggtccctgtccaagctacaatggggtcccaagcagaggctctgagacttcacttccttttttttttttttttttttttgagacagagtctcgctctgttgcccagggtgaagtgcagcagtgcaatctctgcttactacaacctccacctcccaggttcaaacgattctcctgcctcagtctcccgagtagctgggattacaggcatgcaccagcacgcctggctaattttttgtatttttagtgaagacagggtttccccatgttgccaaggctggtcttgaactcctaggctcaagtgatcctccctccttggccttacaagcatcacagagcttgcaagatagtgaaaaattatctggccaagttccaaaagaggcccagaatctagagaggttagtaaaacaattgggcttctgttgttccaagtttagctgcgcttctgggctttggtggcctcaagatactatgggaaaaaagttggcatccagggcccaccacgtgtcagacccaatatatgatctggctctgggatgtgaccccagaatgctgcacacttgaagtaagaataacaagaaacaaaccagtcctcgcatagatgaaaatgtgcttcaaaaatctgagtgctggagaaaacaacaaggcctgaacttgaattaaggtaatcctgtgttggtagtgctcccagtctcctggcaaaacgaataaagaacctacttttagaagacaagggcacagtataggccttaaattatgttttccaagcacaatgtctaacacagagtcaaggataaccaagtacacgtgaagataaaatgctatggatgaggccaggtgccgtggctcacgcctgtaatcccagcactttgggaggctgaggcgggcggatcacgaggtcaggagtttgagaccagcctgactaacatggcgaaaccccatctctactaaaaatacaaaaattagccgggcgtggtggggggcccctataattccagctactcagaaagctgaggcaggagaatcacttgagatcgtgccactgcactccagcctgggcgacagagcgaaactccgtctcaaagaaaaaaaaaaaaaaaagataaaaaaatgctatggatgagaataaacagaaacagcaaacagacacacccacaggaactgcaaataatggaatcatcagcagataccataaaataaataggtctgctatgttcaaggagataaaagtttatttaaaccattttggcagaaaactggaaatcataaaaagtgacataacagatatgtaaggaaactgtgaaccctgaacatctgagatggtctcaattaatttagaaagtatattttgccaagattgaggacatgtgcctgtgatacaccctcaggaggtcctgacaacatgtgcccaaggtggtcagagcccagtttggttttatacattctagggagacatgagacatcaatcaacataatgcaagatgaacacaggtttgctctggaaaggtgggacaactcgaagcaaagatgggaagactcgaagcagggcaaggtttccaggtcataggtaaataagagacaaatggttgcactcttctgagttcccgattagtctctccaaaggaggcaatcagatatacattcatctcagtgagcagaggggtgactttgggtagaatgggaggcaggttgactctaagcagttctcagcttcacttttgcctttaacttagcaatttgggggccccaagatttattttcctttcacaaaaccaaatagattttttagaattgaaaaatacaatactattaaaattaaaaattcaataactttttttctgcctgattttatctttttaacagctttattgaggtatggtttacataaataaaatccacctatttaaagtgcttagttcgatgagcctgcctatgcagaggactttttgaaggagagaaattctgaaattatgaatctaacagtttaaattaggaacgtaattcatatagactacaccattcccagctacaatcctctttcagagagagaagcacctttgctctccagtcatttacaatccttcagaatggaagcaactggctccatggttccaggttttatacccctttgaagtgtaaattaatagtctcagaaagaaaaatgggaacgtctttactacagaatgcaagcatttggcctgaggtggggtgggtgggagttagaagatgataaatcttattgccctttgaatgggagcagatggctttagtcctaacaccctctaaccttaactcagatgtcaataacatttgctcagaaagccctaattgtgaagagacatgaaaataattgcttattgacagatcgagatgcagaggatatggtgagacagtcttaacgcatatgttttattggtgtccctaaagaaaaaaataatgggaacagaggcaaatgtgaataaatcattactaaagagtgttcaaaactaataaaaggccaagcacagtggctcaggcctgtaattccagcactttgggaggctgaggcaggtggatcatgaggtcaggaatcgagaccagcctggccaatatggtgaaaccccgtctctactaaaaatacaaaaatgagctgggcatggtggcgcatgcctgtaaccccagctacttgggaggctgaggcaggagaattgctagaacctgggaggtggaggtcgcagtgggccgagatcataccactgcactccagcctgggcaacagtgcaagactccatctcagaaaaaaaaaaaacaaaaaaacccactaattaaagacacaaaaccacgtgtttaagaagccaaataaatctcaaggcagaaaattttaaaaataaatcaacatgtagatacattatagtgaaactgcaaaaaaacaaagacaaagagaaaccttaaaagatgtctttacagaggcagcagttagagtaacagctaaattctcaaaagaaacaatggaagctagaagacagtagaatgaccatctcaatgcactgaaagaaaattgttggggtgatcagacccaacaccaagtcgtgggggtacaaagtctggcagagtcaaaggattgagaaaaagacagtttgagagagaaaaacctgggaccagggggacatcactagtgtatggaggctgcgaaggccctgagctctaggagcccatgctatttattggtaatccaacaaagaaacaggtgatgagaatgtggaggtcaaaagggcatgttgcattaagcacatgatttacagctgtgatggtttagcatttgctctgctacttgagataatggagagcagattcttttaactcaagatacaatcgatcctgagagagcaaggagcaagaagccagcaagtctagacacattccagagcctcgagccctggattctatccaagccatgagggattttatgccctgggtttaagttatggtgcatcagggtagccttctaccctttagcacagagcttggtgttccaaaggccacaaggggctttagaccctggaccccgcacatattccaagacttttttatattatgtcagacatgcaaaccctgcctcagcttctgtcaacactcagcttttcccaacagaaaataactgcttatattgtttggatatttgtcccacccagatctcatattgaattgtgatgtccaacgatggaggtggggcctggtgggaggtgtttgggtcatggaggcagctccctcgtggcttggtgttgtcttcatgatagtgagttctcacaagatctggtcatttaaaactgtgtgtcacttccccccaactctctctctcttgctcctgcttttactatgtgaagtgcctgctcctgcttcaccttccaccatcagtaaaagctccctgacgcctcccgagaagcagataccagtactatgcttccggtacagcctgaagaattgtgagccaattaaacctcctttcatataaatacctagtctcaagtatttctttataaatgcaaaaacagcctaatgtagaaaattggtacctagcatggggcattgctataaagatacctggaaatgtgaaagcagctttgcaattgggtaatgagcagaggtttgaaaagtttggagagctcaaaagaagacaggaagatgaggggaaatttggaacttcttagagactggttaaatagttgtgaccaaaatgctgatagtgatatggacagtgaagtccaggctgatgaggtctcagatggaaatcagaaacttattgggaactggagcaaaggtcacccttgttatactttagcaaagatcttgactgcattctgctcttgccctagaggtctgtggaaatttgaagtgattattgacagtatctggcagaagaaatttctaagcagcaaagtgttcaagatgtacctgactgcttctaacagtccacattcagatgcaggagcaaagaaataaagttgaaatttatatatgaacaggaagcagaacttaaatgtttggaaaatttgcagctggaccatgtgacagagaaagaaaaagcttttttgggagaggaattcaagcaggctgtggaataaccacttgtacgagatatttgtgtaactaaatggagccaagtacctttatctaagacatgaggaaaaggccatgacattttgaagacaaccttcgtgcctgtccctcccctcccaggtccagaggcttagaaggaaagaatggtttcatgggccaggcccagggcccagtggccctgcacagcttcaggacactgctccccacatcccagctgctccagctccaactgtggctcaaaagggcccaggtacagctcaggctgtcactttggggaatgcaagccataagccttggtggctttcatgtgatgttaaacctgtagatgtgcagaatgcaagagtgaagaatgctaggcagcctctgcctagattttagaggctgtatgagaatgcccaggtgcccatgcaaaaacctgattcagggacagagtccttatagaaaacctctactaggaaagtaccaaggggaaatgtgaggttggagcccccacacggagtccccccactgggccactgcctagtggagctgtgaaaaggagaccacctttctccagaccccagaatggtagatccactggcagcttgtaccctgcacctgcaaaagccacaagcactaaactgagagcagccacaggggatgtaccctgcaaagccacagaggtggagctgcccgagacctagggagcccaccccttgcaccagtgtccccttgttacaggacatagagtcaaaaaagtttatttttggagctttaagattgaatgactgccctgctgggtttcaaacatgcatggagcctgtagccctttccttttggccagtttctccctttggaatgggaatgtttatccaatgcttatactcccattgtaccttggaggtaacttgttttttattttagaggatcataggtggaagggatttgctttgtttcaaatgagactttggacttttgagttaatgctggaatgagttaagactttgggggactgttgggaaggcatgactatattttgcaatgtgaaaaggacatgagtttaggaggggccaggggtggaatgatatagtttggatatttgtcctttcccaaatcatgttggattatgatccccagtgctggaggtggggcctggtggaagatgcttggatcatgggggtgtttccctcatggcttggtgctgtctttgtgatagtgagttctcacaaaatctggtcatttaaaagtgtgtggcacttggccgggcgcagtggctcatgcctgtaatcccaacactttgagagaccaaggtgggcggatcacctgaggtcaggagtttgagaccagcctggccaacatggtgaaaccctatctctactaaaaatacaaaattagccaggcatggtggtgcacacctctgatcccagctactcaagaggctgaggcaggagaatcgcttgaacccgggaggcagaggttgcagtgagccgagatcgcgccattgcactccagcctgggcaaaaagagtgaaactgtctaaaaaaaaaaaatgtgtggcacccctgctcactccccatctcctgctcctgcttcctgctttcaccatatgaagtgcctgctgctgcttcgccttctaccatgagtaaaagcttcctgaggcctccccagaagcatatgcctctctgcttcctatacagactgcagaacagtgagccaactgcacttctttccttataaattactcagtctcaggtatttcttcatagcagtgccagaatggcctaatacacctgtgaacatacaaatttacaatttcctttacccaggaaaaaaactcaccaacaataaatacaaactaaagacatattcaacagataaaatctgagggagttcaccaccagtataccagtattcattcttcaatatggagccaagaaagtgatatgtgtgtgtgtgtatatacatatatattacttacatatgagtatatatatgtatgtatatgtgtatatatatgtatgtatgtgcctgcatgtacatactcacatccatcaagacattattatttgcttaataaatacatacatattaatatattaattacatattaatatgtattaaacacatgcataatatatacatatttatataatatatagacataaatattaagcaaataaaataataatagtgccttgatgtatgtgagcatccacatgcatctacacaaatacacacacacacatttctacatatttaccctttccaacgctcttctttcctacacatccaggatttatctggtgtatcaggccattcttccattgctataaagacatacctgagactgagtaatttgtaagaaaagaggtttaattggttcatggttctgcaggctgtacaggaagcatgacagcttctgtttctggggaggcctagggagcttatacttgtggtggaaggcaaagtgggatcaggctatcttataagaagggagcaggagaaagagagagaaaaaaaggaggaagtgctacacacttccaaacaaccagatcacacgagaactcactcataatcacaagaacagcaccaaggaaatggtgctaaactatttatgatgaatcagcccccagtcgcctcccaccgggtggccccacctccaagaatagggattacaatataacatgagatttgggtggggacatagatgcaaaccatatcatcaggtgtcatttccttttaacctaaaatgtttatagtttgtagacttatgtagtgcaagtctacttactggactaatttcctcagctttttcctgtctacaaatgtctttattttgcctttatttttgaagtatgtattttgaatgctttgttaaattctttcagcattttaaagaagccattacattgtctctgcatttttaataagaattcagccatcattctttcttcttgttaccttcttaaatgtatttgccccttttctctgatagcacttaagatatcctctttaatattggttttcagcaatttgaccatgatgtgctttggtatggttttctttgtatttattctgcttgagttttaatttttctctttatgcatcggtttggattaatttaattaacctatcttcaagtttatggatcttcccttgtgctctattcagtctgctgataagtacttcaaatgaatttttcatttcagtactggaattcccattttattcttttgtagagtttcagatttcctgccgaaatttacaatctgttcacacattttgcttggcttttccagtgaatattttaacagagttgtaatacttattttaaagtttttgtcggctgatttcaacatctgggtcattcctcattctgtttttttgttgttgttgttgttgttgttgtttttctttctcttgattattcattacatcttcctgctttttttttttttttagacagagtctcactctgctgcccaggctggagtgcagtggcacaatcttggctcactgcaacctccacctcccaggttcaagcaattctcgtgcctcagcctcccaagtagctgggattacaggtgtgcaccaccacggctggctaatttttgtatttttagtagagatgggctttcaccatattggccaggctggtctcgaactcctgacctcaggtgacccacccacctcagcctcccaaagtgctgggattacaggcatgaaccaccgcacccagcccttcctgctttttataaacatgtcttctctatttagttatgtgcacatttggaaagaattagtgggcaggtgtgccctgagcaagtctctcttaattctcccttccctgttcctcctgctgccaggttctcagtgaagacttaggaagagttgatgggtggatggtcctagagaaatctctttaccctcatttcctgtccttagcctttaccaggacagggctatgaagttggtgaagaccctgtagatgagaactggcatatagatgtcattttgtatttgggactttgggggattttaatacattttgccagctcatgcaaatttgttaaaagttcagctagtttctccttgcatctgcaaaaattcccatctatagtgggttcaatcttccatccaccatacccctatgaggaaagcagccttgggtctcactttcctagcaagggctctttgcactatggaatttagtttatttccacttctttatcctcagcttgggtttttaacaactatgcttctgtagcttatccagcttactcacattatttcagtgagagcaatgatctcttgaaactttctatatcctaattggaggtggcagtctaaatgtttttcaaaaagacttacacatttaaaatatgaagagaaaaggtgagaataaagtttctgacatctgtagactattagattatccatccctttccatatccagggaccatatttaatgctaacttgactcagagaaaataccaccaggtcatttagctaggtctatatccctgctgggaaggcccaggaaggctaatgcatcaaatgcccactggaacaaaaacatcttcttttaaaaaaatcacctgttttaaaatgaaattggaggaaaatgaagcaaaaaagaatttacccctatttcatcatactggatctctgttttcatttaaaatgctctttatcctcatttcaacatatttctacttcttaatctgtgctagactagaaccaaatccagaaatcagtttttctaacaaacttactgagtctgaagggagagtttgactttctgctcaccaacaaacttgggcacagccagaatttatgctatttcacataaagaaaaataggagggaaacggcactgacccgagaggccttatgcagcaacgattctcctgaagtgggagagaaagagaattaaaaagatgaaacacacatcttctttccccacaatgttcagtcaactgctctaggccttattatgtagaagtgtacaattgatagattctgtaagaaattacctaaaaatctatacttaattggtatcaaatagtctgaaattttctggtcacaaaccctttttaaaatctgatgaagagtctaatgcaggtagcttcagttgcaggacacttgaaacgcccagtgccctccagggacaaatagaacaattaggactgcaaaaggagaacaaaaagacatttgtagaacaggtaagtggtacttagaaggaaggtctaaaagcaatcatctaagcttccacattaaagactagaaagatagaataaactgaaaataaatagaagaaaagaataaaatcaaggtgagaataagaataatgaaatagaaaatggataacagcagagataacccaattaaagcaaaagctgtatcttttaaaagtataataaaattgataaacctttagactgctcaagaaaaaacaaaaattaccaatatcagaagtttaaaaggagacataactacaagtcctatgaacattaaaatgatagaaaggaataatataaacaaacatatgcaaatacatttatggatataatgaaattatccattttttcaaagaagcaaattacaaaaatgacagaagagataatctaagttatactatatctatgaaagaaatagaaattgtagttttaaaatgtttttttcacaaagaaaataccaacacagatcacttcactggtgaagtttataaaatatttaaggagaaaataacaccaatatcacactaacactttcaaaaaacagatggagagaatatttcctgtatcattttatgatgccagtattatcctgataagaaaaacaaagtcattacaagaaaactacaggctaatagtatttcttattaatataaatctttaacaaaatattagcaaatcaaacatagtaatatagaaaaaggataatacatgtgacttggaggggggcggcacttatcccagaatgcagagttggtctaatatttgaaaaattagtgtaattcgtgacattaataggataaaagagaaaaatcataatcttgagagatgtgaaaaaacttaacagaaataggtgtttataacattaaaaaaaaaaaaaaactcttatcaggcacggtggctcacctgtaatcccagcactttgggaggccaaggtgggaggatcacttgagcccaggagttcaagaccagcctgggtaacatagtgaaaccccatctctataaaaaatacaaaaattagctggatgtggtggcacatgcctatagtcccagctacttggaaggctgaggtgggagcatcacttgaaaccaggaggtggaggttgcagtgaaccaagattgcaccactgcactccagcctgggcgacagagggcggggagaaagacggctacaaccccactggcaatggcctacataatgggtttctcacagcgtcctcccttgacagttacagtaaagatggagcgaagtccttgaaaggagatgtgcctgcctctgaggtgacttcgaaagactcgacgttcagccagtttagtccgatctctagtgctgaagagtgtggtgacgacgagaagatcaaggtggatgaccccctgacaaggaggacgtgcaatcaagcttcaggtcgaacgtgttgacagggtcggctccccagcaggactatgataagctgaaggcatttggaggggaaaactccagtaaaactggactctctccatcaggcaatatggagaaaaacaaagttgttaagagagaagcagaagccaattctataaacctgagtgtttatgaaccttttaaagtcagaaaagcagaggataaattgaaggaaaactctgacaatgtgctggaaaacagagtcctggatgggaagctgagctccgagaagaatgacacctgcctccccggcactgcgccatcaaagacaaagtcatcctccaagctctcatcctgcagctctgccatcatggctctcagcgctaaaaaggcggcttcagactcctgcaaagaaccagtggccaattcgagggaatcctccccattaccaaaagaagtaaatgacagccaggcgcggtggctcatgcctgtaatcccagcactttgggaggccaagacgggtggatcatgaggtcagaagttcgagaccagcctgaccaacatggtgaaaccctgtctctactaaaaatgcaaaaattagttgggcatggaggtgcgcgcctgtaatcccagctatttgggaggctggggcaggagaatcgcttgaacctgggaggcggaggttgcagtgagccgagatcacgctactgcactccagcatgggtgacagagcaagactctgtctcaaaaaaaaaaaaaaaaagaagaagaagaagtaaacgacagtccgagagccaccgacaagtctcctgaatcccagaatctcataaacgggaccaaaaaaaccatccctaaagcaaccggataatcccagaagcatctcaagtgagaacagcagcaagagttccccgtcctctcctgcagggtccgcaccagcaatcctcaaagtccgcataaaaaccattaagatgtcttctggggaaatcaagagaacagtgaccagggtattgccagaagtggatcttgactctgggaagaaatcttctgagcagacggcgtctgtgatggcctctgtgacattccttctgtcatctccagcatcagctgccatcctttcctctctcctcagggcgcctctccagtccacggtcatgaccaatgcagtttcacctgcagagctcacccctaaacaggtcacaatcaagcctgtggctactgctttcctcccagtgtctgctgtgaacgaaagtgaagacggcaggatcccgagtcattaatttgaagctcgctaacaacaccacagtgaaagccacagtcatatctgctgcctctgtccagagcgccagcagcgccatcattaaagccgccaacgccatccagcagcaaactgtcgtggtgccggcacccagccgggccaacgccaaactcgtgccaaagactgtgcaccttgccaacattaaccttttgcctcagggtgcccaggccacctctgaactccgccaagtgctaaccaaagctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacattccaaacctgagtcctcccaccaatgcagggatcacgttaccaacgcgtgggtacaagtgcttggagtgtggggactcctttgcagttgaaaagagtctgacccagcactatgacagacagagcatgcgcatcgaagtaacatgcaaccatggtacaaagaacctcattttttacaacaaatgcagcctcctttcccatgcccgtgggcataaggagaaaggggtggtaatacaatgctcccacttcattttaaagccagtcccagcaggtcaaatgatagtttctccatcaagcaatatttccacttcaacttccactcttcagagccctgtgggagctggcacacacactgtcacaaaaattcagtctggcataactgggacagtcatatcggctcctttaagcattcccatcaccccagccatgcccctagatgaagacccctccaaagtgtgtagacatagtctaaaatgtttggagtgtaatgaagtcttcagtatgagacatcaatggctacacatttccagcaggctgcagatacacgtggacaaaagacttgcactatctgccagatgctgcttcctaaccagtgcagttacgcatcacaccagagaatccatcagcacaaatctctctacacctgccctgagtgcggggccatctgcaggtcggtgcacttccagacccatgtcaccaagaactgtctgcactacatgaggagagttggttttcgatgtgtgcattgcaatgttgtatactctgatgtggctgccctgcagtctcacattcaaggttctcactgtgaagtcttctacaagtgtcctatttgtccaatggcatgtaagtccgccccaagcacacattcccacacctacacacagcatcctggcatcaagataggagaaccagaaataatatataagtgttccatgtgcgacactgtgttcaccctgcaaaccttgctgtatcgccactttgaccaacacattgaaaaccagaagttgtctgttttcaagtgtccagactgttatcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcagtggaaaccaagaaagtggccagtcctgggtggacgtgttgggagtgtgaccgcctgttcattcagagagatgtgtacatatcccacgtgaggaaggagcaagggaagcaaatgaagaaacatccctgccgccagtgtgacaagctcatcccacagcctgtgccagcacaaccggatcaagcacaaaggcatcaggaaagtgtatgcctgctcgcactgcccagactccagacgtacctttaccaaacgattgatgctagagaagcacgtccagctgatgcacagcctcaaggaccctgacctgaaagaaatgacagatgccaccaatgaggaggaaacagaaataaaagaagacaccaagttccccagtcccaagtggaagttggaagaaccagttctggagctcaggccttcctgaggagcaatcactcaaccactgaaaaagctgaaaatcaatgtttttaaggttctcaagagtgccatgtgtggcttcaccaccgaaaacctgcttcagttccacgaacacatccctcagcacaaatctgatagttcttcctaccagtgccaggagtgtggcctctggtacacgtctcacgtctctctgtccaggcacctcttcattgtacacaagttaaaggaacctcagccagtgtccaagcaaaatggagctggggaagataaccaacaggagaacaaacccagccatgaggatgaatcccccaatggcaccgtgtcagacagaaagtgcaaagtgtgcgtgaaaacttttgaaactgaagctgccttaaatactcacatgcggatacatggcatggccttcatcaaatccaaaaggatgagctcagccaagaaatagccacagaaggtacatgaggaaaatccctgtccacattggaataaaaaagatatttttgttacaaaaagtttgcagtataataaacagtactgtctaggctgttgcaatatgttctctttcaacgtaccttccttcacctcgttgtatatatcctcgataagtagtaaaacagtatttgagtttcaaagagtttgtatagatttaaatgaataactttttatactgtttgttacacatttgtatcagtatttagtggcaaacgatttgagttgttttgggtcagaatttttctttttgtactgtttctttaaaacagagttcttagtaacaggggcagctcctgaattcaaataaaccattttgtatgtttggattttgaagaggttaactaattacaggctaaaataatgccttttttagtgtttttaatttttagaatacactacataaattgtaagtaattgtgggtctcaaaaaccctaggaacttttaagtgtcttagcacttcctcgatgtgcctgccctgaaggagtgagctcacatgtgagacaactgcactccagtgtgggcgtgcctttttcttcaggccatgcgaagggtgtttaaagcagccttgcaggtcgctcctttcccagccgtggataaaaactgaagccaggaatctaataaggaatgctgatttcctcaattccattttggggcatggggaaggctgttctaaagaaaaaaatgggactggttttctaggcagatctgcaaggctggctttaaaagcacaaggagggaaagtaacgaaagggctggactactataaaagttacaaatacgtagttagaccaatagatttatatagtcaggtttttgtcatgtaatttattaactattacagaaacacaactaagaatatcaagtatttctctggctcttgacagaaaaaaaaatcagttgacttaaccctttgctgtcaaaagagttggcattgcctgttctaggtgctactgccaaatgttctgatacttagagttgggatgcacaacgtcaaccactgacttctcaatgcagccgcctgtgtattgcaattggccgttaccttaagcgcggggccacccgggtttagttcagccatttcaagaagtatatttaacgtcggtagttctgctttattaaaatgcagcagaggtactcttctgtcccttccgtttatagttctctgagagagttctattttttggttttgtttcgtgttttcttttttttttttttttttttttttttgagacagagtcttgctctgtcgcccaggctggagtgcagtggagtgatcttggctcactgcaagctctgctcgccgggttcacaccattctcctgcctcaccctcccgagtagctgggactacaggcgcccgccaccacgcccagataagttttttttttgtatttttagcagagacggggtttcaccattgttgcgggaagtcagggaacccaaacggaggaacctgctgaagccatgacagaagaacatggattatgaagattttatggacatttattagttccccaaattaatacttttgtaatttcttaatgcctgtctttactgcaatctctaaacataaattgtaaagatttcatggacacgtatcacttccccaatcaatacccttgtgatttcctatgcctgtcttgtctttaatctcttaatcctgtcagctgagaaggatgtatatcgtctcaggaccctgtaataattgcgttaactacacaaattgtacagcatgtgtgtttgagcaatatgaaatgtgggcaccctgaaaaaagaacaggataacagcaattgttcagggaataagagagataaccttaaactctgactgccggtgagccgggcagaacagagccatatttctcttctttcaaaaacaaatgggagaaatatcgctgaattctttttctcagcatggaacgtccctgagaaaagagaatgcgcacctaggggtaggtctctgaactggcccccccggggcgtacctgtctcttatggtcgagattgcagaggtgaaataaactccagtctcccatagtgctcccagtcttattaggaagaggaaattcccgcctaataaattttggtcagacaggttgatctcaaaaccctgtctcctgataagatgttatcaatgacaatggtgcctgaaacttcattagcaattttaatttcgcctcggtcctgtggtcctgtgatcttgccctgcctccacttgccttgtgacattctattaccctgttaagtacttgatgtctgcgacccacacctattcgcacacctccccttttgaaaatccctaataaaaacttgctggtttttgtggcttgtggggcatcgcggatcctaccaacgtgtgatgtctcccccggacacccagctttaaaatttctctcttttgtactctgtccctttatttctcaagccagctgacgcttaggaaaatagaaaagaacctacgtgattatcagggcaggtcccccgatacaccatgttagccaggatggtctcaatctcctgacctcgtgatctgcccacctcagcctcccaaagtgctgggattacaggtgtgagccaccatgcccaggcttgttttgtgttttattttgcatttcatatcttacatttatccctgaacatgttttgtacttttttttgttgttaagaaaaggaattcttttgtgtatctatagatacttgcatgatctactgtagtcaacgttcggttcctcaaaaggtcttgctgctgtcaggtgttatgcactccatccataataactgtgtgaaacacatttcatatgtaaataaacgtgggacatttggcccatgtgcttctgtgagagagttattgattgtgagtctctgacatctttgtgaagtttgggaagtgactaattgcagggacaagctacaggatgttgcagaatccttcccactcagaagaatggcatgttctctctcattagtaatcagctattttgtcactttctcattgactccatcagtacatcggtacaatccaagggtgtgaatttcagcttgaaattccattgctattacttgttatgtttgtattgctctaagttgtattcatagcactttcatatgtttctgcatttgaaccttgcaataagcctgtgtggtaggccacataggtccaaataacctagttttacagttgaggaagctgagctcagattcagttctttgctgaagccctcatagctggtaagtggctttgcatattagaacccaaatattttgctctctaaatctaatgctcgctctatgtggttatgtacatattgacaaatattcatttattcaacaaataaaaagtatgtacaaagcatgaaaaaaataaaaaataaaaacaacaacaataaactatagcttctgatctgaacggaaaactaagctgatggaggaaagagagtttcttaaaaatggcagaggagattccaaaaaaaaagtaattctagtcactcaagagaccaaaagacctcatgatcacaaagccacttatgatactaaacactcaaggtaaggggcaaaatttgtagataaaagtctttgtgaagatcatgagacacatatattagaagcaaagaacaacaaagagtcaagtggcaatcagttacttgatattgttattccaccaggcacacaaattgagaaagagcaaattactgggcaagttgagaagaatgctaccaaccctaaaccccagttaagtcactcctctcgactgtcccctgacttaactagagacactgatgaagctgcttttgagccagattataatgaaagtgacagtggaagttatgtatctgtaaaagatgaggaaacttcaggaaacacttctaaggtcctgaaagataagataatggagaaagcaggagaaagcaaaagaaagcctggacacagttggccaggtaggcataggaggagccagagtccgagcagaagtcagagcccttctggaggccagacttgaggccatagcagcagggccagttctgcagaaagttagaatagcaggaagaataataaaaagtaggaaaaggaaaagcacaagaaacattaaaaaaaaaaaaaaaaaaaaccatacatgcaggtactgcaggggaattggaaaaaagccaaaaaacacagacataagaaaaggaagtcaaagaagagcaaaagataaagagaaagataacaaaaaatgaaatctgtcaccatgtaaaaggacagattttttaaatggacttaatggctaagtctgtattcaattttgttattatgtaaagagattcaggtcttgtaaataatgacatggaagactctgtgctgcacttaaaatattgctgcttgattattggatttttacatcagaggttgatgcagtttggatatttgtccccaccccaatctcatgttgaaataaaatccccagtgttggaagtcaggcctggtgggaggtgtctgggtcatggaggtggatccctcatagcttggtgctttctctgcaaaatctggttgtttaaagtgtgtggcacctcccctactctctcttgcttctactcccaccatgtgagacacatgctcctgcttcacctttcaccatgattgtaagcttcctgagacctccccagaagcagatgccagtgctatgcttcctgtacagtctgaagaactataagccaattaaaccatttttctttataaattaaccagtctcaggtatttttatagaaatacaagaattgcttaatacagaaaattggtaccaaggagtgggacactgctatgaagatacctggaaatgtggaagcagctttggaactaggtaatgggcagaggttggaaaagtttggagagctcagaagaagagagaaagatgagagaaaatttggaactttttaaagactggttaaatacttgtgaccaaaatgctgatagtgatatgaacagtgaagtccaggctgatgaggtatcagatggaaatgacaaacttattgggaaatggaacaaatgtcacctttgttatgccttagcagagaacttagcagtattgtgtccatgcgctagggatctatggaagtttgaatgtcaaagtgatgatctacgttatctggcagaagaaatttctgagcaccaaagtgtttaagaagtggcatggctgcctctaacaacataagctcagatgtgggagcaaaggaatgacttaaagttggaacttatatttaaagaggaagcagagcataatagtttggaaatttttcagcctagccatgtgccaaagaaagaaaaagctttttcaagggaagaatccaagcaggcgatggagtaaccacttactagagatacttccttttggtaacaagtatttaaccagtctctatggagcaaccacttgctagagatatttacataactaaaagggagacgggtgctaatatccaaggcaatggggaaaaagcctccaaggcatttcagagacctttgaggcaggtgggaatgtaaactagtacaaccactatggaaaacactgtgaagattccttaaagagctaaaagtagaactaccatttaattcagcaatcccactactggctatctacccagaggaaaagaagtcattatatgaaaaagatacttgtacacatacaaaagatatagcagcacaatttgcaattttaaaaacatggaaccaacccaaatgcccatcaatcaatgagtggataaagaaactgtggtatatatatacaatggaatactacgcggccataaaaaggaatgaattaatggcattcacagtgacctgcatgagactggagactgttattctaagtgaagtaactcaggaatggaaaaccaaatatatgttctcactcatttgtggaagctaagctatgaggatgcaaaggtataagaacgatacagtgtactttggggactcaacaggaaagggtgggaagggggtaagggataaaagaccacaaatttgtttcagtaaatactgcttgggtgatgggtgcaccaaaatctcacacatcaccactaaagaactgactcatgtaaccaaacaccacctgttccccattaacctatggaaatgaaaagatttaataagaaagaaagaaaaaaagagagagaggaagaaagaaagaggaaagaaaaagaaagaaagaacaaaagaaaaggaagggaagaagaaacaaacagattggaaagagggaagtaaaaccatttttgcagaggacacaattatatttgtgtgtaaaaatcctaagaaatacaaaaaactactaaaataagaaaacttataaaaatcataaattacaaagtcaatatcataaattacaaaatcaaatcaattgatttttacatattgacaataaactatagggaaatgaaaatgtaaaatataccatttatacaatagcctcacaaactttaaaataattaggactggatttaacaaaatgtggacacaagacctatatacaaaaagctgtaagccgggcatggtgacatgagcctatagtcccacctacttggaagcctgatgaagaaggattgcttgagtggagtttgagtccagcctggccaacatagaaagaccccatctctatttaaaaatttttaacacaaaaaacaaaataaaatcctgtaaaatattgctgaaataaaataaagaagacttaaataaatagagggatatgccatgttcatggattgaaagactcagtattgttaagacaccaattttctccaaatccatctacagattcaacacaatcccattcaaatttcaacagggttttctttttttttttttttttttggtagaaattcacaagcttattctaaaagctatgtgaaaatacaaagaatctacaatagccagaacaattttaaaaagaacaaagaagacttatactatctgattttaagactttctataaagctataataatcaagacggtaaggtagacccacgatttccatgagcatgaacccactgctgaactttatttgctgtaaaatgaatttcttggccagaagcaaagcagagtgtcataccaccatggtgaataaggcattctttctgtatatggataatagttctggcaggagtattgcaggcagaaaaagcaaaggctggctggttcttccaaggaaaggtgccattgagggctcagctggtctctgctgttcaaaggttggccactcagcagtggtggtaggcattagaccttagtaagtggacagtccacatcactcttgccttggccactttgagcatgaacactttaggtagctgaggaaagaggctggatgatccagaggacagattatcttgcccacttgattattaaaatcttcttctgctgtaattactctaggtgagcattcacatgggatgcagatatcttcacttttgtggccaatctgagaggtctgtccatacacctcttcctcgaatgccttgtgaccacttttccaattgtgtcccttccaagcccagccagctaaaccattagccactgcccataaatcagtgtagatctatatctctggtaaccttttctttcccggaaataaacaatcaggggtactgcttgaagttatgcccagtaggagtattttccttcactactgtccttcagggccacaccagaaagtcctcctatttaaatctcaacacaaacaaaccaactgtaaaaagacattgatgaggcctggcgccgtggctcacgcctgtaatcccagcactttgggaggctgaggcgggtggatcacgaggtcaggagatcaagaccatcctggctaacacagtgaaaccccgtctctactaaaaatacaaaaaattagcctggcgtgatggtgggcacctgtagtcccagctactcgggaggctgaggcaggagaatcacttgaacctgggaggcagaggttgtagtgagccaagatcgtgccactgcaccccagccttgcaacagagtgagattccatctcaaaatataataataataataataaataaataaaaataaatctatctaagaaagcattctaaatattacccggcctcatcagcttatgatctcaaaatacggtcctatttctatttagacccaatttagaatgactgtaaacattacccccatctgccacctccccaagcaggggcatattctcaccctctccagactccattattccaagaagcccacaaaggggttctgcatattagaccacaaactaggcagaagctgacagccatccctatcattttctatcctctgactctctaaacccagctcccacttgtctacgtctactgcctcagaagccacttaaagaggcttaatcattgctgctgttgacaaaaacaaagagaaagaaagtccttgaaaccattccaaattaaaagacactaagatacaagacagctaagtgcaatatgcaatcctgagttgggttctttctatgattgaaatgtttgtgcccctgcaactcccatccttaccatcaaatgttgaaatcctaacccctaaagtgatgatattagaagttagggcttttaggaggttattaggtcatggaggtaagttctcatgaatgggatcagcgcccttataaaagaggccgagagacccctcacccctttaccatgtgaggacacagcaagaagtcaccatctatgagccagaaagcaaggccctcgccagacactgaatctgccagcaccttgctcttggacttgccagtgtccagaactgcaagaaataaatctctgttcataagccacccagtctacggtattttgttatagtagcctgaatgaactaagacagtcttaaactgggggaaaaaatggctataaagtcatgactgagacaactgaaatttcaatatgggctgtagattatagtatattcgtgttaaatttccaaatttggatcattgcatagtggttatgtaagagaatgttctcacacttaggaaatacacactgatgtatttaggggtataaattatcactgaaaattctccccatcaacacagcctttcagccacacaatttccttcccaatagccaacaaatgttatctccttcttggataaatcctcacagaggcatttcatgcttttacaaccaatacatgtcctaaatctcttttataacaaaagtgagaccattctctacagtctattctgcattttgctttcttttttttttttttttttttttttttgagacagagtctcgctctgtagcccaggcttgagtgcagtggcgtgggtttccgctcgctgcaacctctgcctcccgagttcaagcgattctcctgcctcagcctcctgagtagctgggactataggcgtgtgccaccacacccagctaattttttgtatttttagtagagacggggtttgaccatgttagccaggatggtctcgatctcctgaccccccacctcgccctcccaaagtgctgggaggtgatccacccacctcgccctaccaaagtgctgggattacaggcatgagccaccacacccaggctggctgtctttcttaatacagtcatgcatcacttaatgacagggatatggccttaggcaattttgtctgttgttctgtgaacatcttagagtacttacacaaacatagatggaacagcctactactcacttaggctatgtggtaatgcctactgctcctacactacaaacctaaacatgttaatttacagaacactgtaggtaattgtaacaaaatggaaagtatttatgcatctaaacacacctaaacatagaaaaagtacagtaacaatatggtagaaaagattaaaaacggtatacctgcatagggcagctccattataatcttatgggatcaacattatatatgtggtccatcactgacaaaaacattagttaggcagggcatcactgtaatcttgaagatcaatccacatcagaacgtgaagtgcctcctcattattttttaccactacctagtattccactgtgagatgtaccataactgaagcaggccccattctctggatactcagcttgtttccaatcttttgctatcccttattaacatctgtacaatagcaaacatcaagggacccaggaagattgggaacataaacatatagtaaaagtatgacattaatatgtcattaataatttcattaggaattatattttaaatggatactaagaaatgcaacgttttatgttatgagtcaggaaactagatgtgtgaaggaatgattgatgagtatgaaaaaccaagaatgtgcctgtaatcccagcactttgggaggccgaggcaggtggatcacgaggtcaagagatcgagaccatcctggccaacttggtaaaaccctgtctctacaaaagtacaaaaattagccaggcctggtggcatgcgctgtagtcccagctgcttgggaggctgaggcaggagaatcgcttgaacctgggaggcggaggttgcagtgagctgggatcctgtgactacacttcagcctggtgacagactgagactgtctcaaaaaaaaaaaaaaatagaagaagaaaaaccaagaatgattgtgaggaggtcaatgttaacagttctgtgtattaactattaaataaaccttcctggaaaagcatttgaatacaatgagttgttttttttttttttttttggaaaactattccagacatgaaacccaaatgacaattaagaatactagtaaaacaattgatggtggtgttgttattgtgccattaatgaaagtactgacaggaaaaggataggactttgcgttcattaataaaagatctaaaaaaaaccataatgtcctataattaaaacaacaacaaataaagttaccttttacttcactctgccaaataaggctatactggaagagaaagaggtaactattgacctgagagtgaagactggagtataaatgtacatatacatacctatatatacactgagactatgtatttggggattgtaggactcttttggttggtaaaaattaattccgtatcacttttatcctcaggttcttttttcctcaggtatttttccttaggttcttgaatttcaaaagatagtaacttaatttgacatacacttagacaatatcccaagagcctaaaaccacataggcaacttatcctgacctaaaatcctctcttcttccaggaatcagagtctagtaactgtcctctgccagcagactcagcactttctcttttattacaacggccttttgtggattttcactcctcggactagacagttggccctttgaaggtagaatccatatcttaatgatccagctgcacagaatgtattcgagcaagcgtagtgtcagctcctactctccagaagcagcaagcacaggctctgtccagtgtccactgtccagggccagcggtgatagtggtgcaagttgcagcatctatgccagcagcgatggcattactgtcttcactgaagcagttctagcctatgatttgggaggctggccttgaacatgaagccacctagcttaattttccggtcttattggtcagaataggctaggtcatcccatgaaacaaataaattccaacatttcagcagttttgctttccaatcacacacgggtggaggcgggttggacagcttgtctgggcggtgcatctccaggcagtgactcatgccctgggctgttcctagtgtggttccagcatcgcagctccttctctttcacaggaccatgagagccaaggatatggcaagaaattttagggacaggcctggaaacactatgcattaatttccccttatgctccgtcggcctaactgaaaggcaggctgaaaaacctcatcttcctatgtgcttaagaagcagaaatgggactggggaggatccagccagggtttacccttcaagaaattttattcttccaattttggtatgtggtatatgtgagcactctctcagagattttatgagccacctcttatcctttcagaggttcattttctgatgaccccagccaagattggtttctattgtctgcaactaatgtccttgactgatagaaagatgggaggtccaataggatatactgttcaggagcacatacctgcactcaaactccaggctcttgctttactaaacttcacacttttggcaagtgaccgggcctcatcttccataaagtgcagagaataatagcatctaccctatgaagttgttgtgaggatagagtaagttaatgcgaggaaagtgcctagcacagctggcctgcagtaagtgctcagtaaatggtatccattatttatcctcccaaggtatccagccttcagaggcttcctggaggaggtactcacaaagatttgaatgattgtagaggactgggcagaagaaggggtcttataggaaaatgagcttctccaggcatgatagatgtgttatctttgttttgggtttttacagtttgtttgttttagagacagggtctcactctgtcacccaggctggagtgcaatggtgtgatcatagctcactgcagtctcaaaatccagggttcaagggatcctcccacctcagcttcccaagtagctaggactataggcacacagaaccatggccacccagctgactgagatgtgttatttttaaattaatgggtgctgagcactgaagaaagagccatccagtgtttgagtattcccatcatgtgctcaagggaacctccttgcctgggtcccatttatcttctcctttgaaagtcagatttgggggagtttgactcatggacaaggtctgtgcgcacgctgtcttttagctctgggatgggggtggtggtgggcaagcccttcccgggtaaggcagagcctgtggggccagtgcctgtgtgaagacagcaaggacactggcaagcacacaccaggcagggttcaggctcgggcttagggtgtccggaaggggaatggctattctgaaatcccaagtctaagctgaagaccttcctcaaagcctcaggagatccggctcacggtggggacaagtatagagtatttgtttcacagcagcagtgagcaggccttcatttgcttctgtgtttttcaagtcacttgttggggtgtgaaaatcccatccctagattctccactaacttcttcactgtaaatgcagaagccccaaaggagccaatttcatgtgccagagcccaacaggcctgggctcccatcctcagtgtgttatcatggaagacaaggcaatgacaagcaaatggtctttctttggggacagttgtaaagcccttgagtgataagccccctccaatggaatgtggcccttcctatcaagaacagctccaggaggccgggcgcagtggctcatccctgtaatcccaacactttgggaggccgaggcgggtggatcacttgaggttaggacttcgagaccagcctaaccaacatggtgaaatcccacctctactaaaaatacaaaattagccaggcatggtggcaggcacctataatcccagctacttaggaggctgaggcaggagaatcgcttgaatccagaaggcagaggttgcagtgatctgagatcgtgcctttgcactccagtctgggcaacaagagtgaaactccatctcaaaaaaataaaaaagaacagctccagggaatgaatatagtgtcaggtcgagtcctctttctctagagagggattttctaaatatgaaagaatcgaggttcctattttgaccatgtcttcttaaaggatgacagtccaagttctcactgaaacaacagtagtaggcagcagaaagacagtgcagagggaggggaagaagtagaggtatggacttaaggactgggtgacatggccagggaaatggacattaatactcaacaggctaagtcaaggatgtttaatgtgcccatcccactgctgggtttcagggagctgaagggagcaatgggccagcactgaggttgagatctgattttgtcctttactagccttggagccttggtccatgttaactgtctgagcttcggtttcttcatttatcaactatagataaaattccttgccctggctgcttcacaggattctcatgatgaactaaaacacacagacacatagacacacacacacacacacacacacacacacacacaaaacactttataaagcttgataatccagaaggggttgttttaaaacaaagcattattattatagttgaagttaagataaattctagctctctgggaacctacagtccagttgtagaaataaaatacatgaaattaaaatacataagtagcaaataatggcaatctgtgctcagcacgagatagtgttatcaaacccacattcagtaagttttctgagagtcagatgtagagtgaatcaggtagaacaaatttcatagaagtggtggtaagaactgaaatgggtcctagaaaaaaagaaggttgtagaaaaattgcaagaaggaaggaaggcaattgcgtgtgtgtgtgtgtgtgtgtgtgtgcattttaagctgaaaagctcaaccaggacatacactatgctaggctagagatgcatactctgactgtgaaaggtaagaaataggtctaaagcagagataggaaaactacagccccacgagccaattttggtacaagctgtaagctaagaataatttttacacttagaaaatgttataaggaaaaagaaaaaaaggaggagtgacacagactttgtgttatatttccttataacagaaaatgttataaggaaaaagaaaaaaaggaggaggagtgacacagactttgtgccccacaaaatctaaagtatttactatctgtccctatacggaccaatatgtacatgacgattcaatgacaatgaaaatacaacatattcaaatttgtgtggtgcagccaaaacagtgctgatagggaaatttatagtactgagtgaaatgtttatattagaaaagacaagaggccacaaattaatattacaaggtcctatatcaggaaactagaaaaataagaacaaactaaacaggggccgggcatagtggctcacacttgtaatcccagcactttgggaggccaaggtgggtggatcacttgaggccaggagttcaagaccagcctggccaacatgatgaaaccccatctctgtaaccccagctatgtggaaggctgaagcacgagaattgcttgagcctgggaggtagagattgcagtgagctgagatcgcaccaaatccttgaaatcctcacatgcactccagcctgggcaataaagcaagatcctgtctcaaaaaacaaaaaaaagggaaaaaaaagaaaatgaaacaaaaagcaaacagaaggaagaaaaaatgacaatagcagaagtaaatgaaattgaaaaaaatacatagtaaattaatgaagcaaaaactggttatttcaaaaaatttgtgaaattgacaaacttctattgaggtgggtggatcacttgaggcctggagttcaagatcagcctggccaacgtggtgaaacccatctctactaaaaatcaaaaattagccaggcatggtggtgcacgcctgtggtcccagctattcgtgaggctgaagcacaagaattgcttgaacccaggaggcagaggttgtagtgagctaagatcacaacactgcactccagcctgggcaacagagtgagagtttgtcaaaaaaaaaaagaaaaaaaaaaaagactgacaaaggcaaagagggaaaatatagtatcagaaatgaaacaagagatataattacagaccctacagacatcaaaaggataataaaggaatactacaactttacacacataaatcttgacaattttgataaaatgaaccaaatccttgaaacccacacatgaccacaagtcaactaatatggtataaaaagtttgaatagcgatataactattgagaaaattaaacccctaattttaaaactcctcccccaaccaaatctccaggcacagatgccttcaccactgaattatgccaaattttaaagaagaattaactccaatgctacacaatctcttccagaatatagaaaataaagaaacacatcccaatttattttgtaaagttaatattaccctgatgctaaaaccagacaaatatatttaaaaaaaagaaaatgacagatcaacagccctgatgaatatagaaataatccttatttaaaaatagcagagaattcaataatatccaaaaagaattatataccaccatcaagtaagggttatttcaggaatgcaaagctggttcaatatttgaaaatcaatcaaggtaatctaccatattgccatgctacaggaaaaaaattacatgattatgtcaattgatgcaaaagaagaattttacaaaatttgacactcatttataataaaaattctcaaaatacttaagagggaaactttctcaaattagtaaagatcagctacaaaaaaaaaaatctacagataacatcatatataatggtaaaagatggagtactttctccctaagattagacacaaggatgtcttttatcacttctagtactggaagggctagccagtataacaataaaaagaaaaaaaaaaaaggaaataaaggctagccctggtggctcatgcctgtaatcccagcattttgggaggctgaggcgggtggatcacgaggtcgggagttcaagaccagcctggccaacatggtgaaatcctgtctctactaaaaatacaaaaattagtcaggtgtggtggctcacacctgtagtcccagctactcaggaggctgaggcaggagaatcgcttgaacccaggaggcggaggttgcagtgagccaaaattgcacctttgcactccagcctggtgagagagcaagactctgtctcaaaaaaataaaagtaaataaaatacataaaaatcaccaagaaaaagttgtcctatttgcagatcatatgatcatctataaaaatcctcagggaggcggggcgcagtggctcacacctgtaatctcagcactttgggaggctgaggtgggcggatcacgaggtcaggagatcaagaccatcctggctaacacggtgaaaccccgtctctactaaaaatacaaaaaaaaacttatctgggcgtggtggcagacacctgtagtcccagctgctagggaggctgaggcagaagaatggcgtgaacccgggaggcagagcttgcagtgagccgagatcgcaccactgcactccaacctgggcgacagagcaagactccatctcaaaaaaacaaaaaaaaaaaatagaaatcctcagggaatatacctaaacaaaacaaaaccaataaaatcatccaactcctaggaattatggtaagactgaaagatacaagttcaacatacaaaaaacacttgtattactatatatccatggaaactgaaatttaaaataccatttatgactgtaataaaaatttctaatacttaggtgtgaatatagcaaaacctatacaagactgaatgtaaaaaatgacaaaatgctgatcaaaaaaattaaaagattaaaataaataaagagaaatagagacatagcatattcatgggttacaacacccaccatgctgttaatatatacttttgctacaatttctataaaaattacagatatacacaagattatttgaaaatgtatatgggaaggcaaaggaacttaaaaagctaaaacaattttgaaaatgaagactaaggtaggagggataattcaacccaattttaagacattgcatagctacagtgatcaagactttgtggtactggtggagtaatagacacatagatcaatggactagaagaccccaaagtagccctgtacaggtacaatctactgatttttttaaggtgcaaaagtaatcaaatgcaggaagaatggtcttttcaacaaatggtatttgaccaagtagacatccataggcaaaaaatgaacctcgacctgaacctcacaacttatatgaaaatcaacttaaaatatttgcaaactactcatctgatagaggattaatatccaaaatatacaaggaactcaaacatctcaacagcaaaaacaaacaaacaatccaattaaaaatgggttataaatttaaatgtaaaactataaaacttctagaagaaaacacaggagaaaatctttaggacctagggcttggtgaagagttcctggtcatggcattaaaaacacaattcgtaaaagaaaaaaaaaggttaagtagtacatcatcaaaatttaaaactttaaaagaaagaaggcccaagcaaataaactgaacgacaaaaaaaaaatgagacatcacaaaggatagcacagaaatacaaaggatcattagagactattatgaaaacctatatgccaataaatctgaaaacctagatgaaatagacaaattcctgaacacttacaacctaccaagactgaatcaagaagaaataaaaaaaaaaaaactaaacagaacaataacaagtaatgagattgaatcagtaataaaaagtcttccaacaaagaaaagcccaagaccagatggcttcatcattgaattatactgaacattcaaggaagaattagtactagtccatcttaaactattcccaaaaattgaagcagagtgtattcttgctaactcattctacaaggccagcataaccctgataccaaaaccagacaagaacacaataaaaaaaaaaaaaaacgtacaggccaatatcactagagaacattaatgcaaaatctctcaacaaaatactagcaaacttaatttaacaacatatcaaaaagaaaatacaccaagattaagtgggatttattccaggaatgcaaggatgtttcaacatacgcaaatcaataaacttcatacatcacatcaataaaatgaaggacaaaaaccatatgatcatctcaatagacacagaaacagcttttgatagaattcaacatccattcatgatttaaaaaaaacctcttaattaggtatagaaggaaagtacctcaatataataatggtcatatataacaaacacacagataacatttaactaaatggggaatagctgaaatcttttcttctaagaactggaacaagacaaggatgcccactcttaccactcttattcaaggtaatactggaagtcctaaccagaccaattagacaagacaaagaaataaaagacatccaaatgggaaaggaagtaaaattgtccctgtttgcagataacatgatctcgtgtacagaaaaacctaagtactcttaaaaaaaaaaaaaaacctgataaacaatttcaccaaagtcacaagatataaaattaatatacaaaatgtgtgtttcgatatatgaacaatgaactagctaaaaagtaatcaagaggacaatttcatttacaatagctaccaaataaataaaacacctaaaataaatttaaccaaggaggtgaaaaacctcaacaaaaaaatctccaaagcagttatgaaaaaaatagaaaaagatgcaaatggaaagacattccatgctcatggatcagaaggattaatattgttaaaatgacaatactacccaaagcaatctatagattcaatgcaatccctatcaaaataccaatgatactcttcacagaaacaggaaaaaaatcctaaaagttgtatgaaactacaaaaactccaaatagccaaagcaatactgagcacaaggaacgaagaaaaaagctggaagtatcatactaccagaactcaaaatctactacaaacctttaataaccaaaacagcatggtactggcataaaaacacatagaccaatggaacagaattgagaacacagaaattaatccacatatctacagtcaactgatttttttttaagttttttattttaagttccagtatacacgtgcaggatgtgcaggcttgttgcataggtaaacgtgtggcatggaggtttgctgtacctatcaacccatcacctaggtattaagcccagcatgcattactgatgctctccctcctgctgcccacgccctgacaggccccagtgtgtattgttcccctccctgtgtctatgtgttctcattgttcagctcccacttgtgagaacatgtggtgtttagttttctgttcctgcatcagtttgctggtttctagctccatccatgtccctgcagaggacatgatctcattcctttttatggctgcatagtagtcgatggtgtatatgtaccatattttctttatccagtctgtcattgatgggcattcgggttgattccatgcctttactattgtgaagagtgtacaacagccaactgatttttgacaaaggtgccaacaatactttttaggaaaagaacagtctcttcaataaatggtgctaggaaaattggatattcacatgaaaaagaatgaaactagaccctcacctctcatcttttttttttaagacatctcactctgtcacccaagctggagtgcagtggcatgatctcggctcactgcaacctctgcctcccaggttcaagcaattctcctgcctcagcctcctgagtagctgggactacagtctcgtgccaccacgcctggctaatttttgtatttttagtagagacgaggtttcactgtgttggccaggctggtctcaaactcctgaccttgtgatccacccgcctcgacctcccaaagtgctgggattaaaggtgtgagccactgtgcccagctacctctcatcctatgcaaaaataaattcaaaatcctaaatatgaggccaaaagtgataaaacttctagaataaaacaggggaaacacttcaagacattggtctgggaaaagattttatgaataagactgcaaaagcacaggaaacaaaagtaaaaacaaagaaataggagtatatggtaaagtaaaaataaatcggtttacaaatagtatatggtatatggtataaacaaatagcatatggtataaacaaatagtatatggtaaagtaaaaataaacaggagtatatggaactacaaatcttctgcgcagcaaaggaaacaatcagcaaagtaaaaagacaacctacagaatgggagaaaatatttgcaaactactcatctgataggggattaatatccagaatatacaaggaactcaacagcaaaataataataatcatccattaaaaatgggcaaatgatctcagcagatatttctcaaaagaagacatacaaatggccagtaaatacattaaaaattctcaacgtcactaattatcatggaaatgcaaatcaaaaccccagggaggtatcatctcaccccagttaacatggctattatcaaaaaataaataaataaataaataaatagcaaatgctggcagggatatagagaaaagggaatacttatacactactgatggggatgtaaactagtacagccactcgggagaacagtatggaggtcactcaaaaaactacaactagaactaccatatgacccagcaatcccactgctgagacaaagggggattgtgggactactatccccagccctggaaactctgctttgtcaaaaacttagccaaaggagacaacaaatcaaagagcggctgttcagtagcaccacactgtaggaggtacattccacagcaacccccactccccagcacaaacccccagccagcggtcccacactgcctggacaatccctttgggacctccctcatttggctctgaccatttactagagccaacgtgaacttgggcttgaggcgccatctacagccgaaatggaggcagcgacctactagcaaagatttgctaagctgatatattcaataaaaaacaaaagtgaacggagaaaattggaataaataactaacccttcaatgcaaagacgtagatggatactcacaagaaacaacaacaaacagggaaccatgacctccccaaaaggaggtcatgagacaggtaagttcttatcaataacagcactggaagtaaactgtctcaattctctaattaaaaggcatagagtggctgatatagttgaatatttgtcccctcctaatctcatgttggaatttgatctccaacactggaggtggagcccaatgggaagtgtttacatcacaggggtgggtccctcgtgaatggcttggtgtcatccccttggtgatgagtgagttctcactctattagttcatgcaagagctggttgtttaaaaagaatctggcacttcctttctctctcttgctccctctcttgccatgtgatatgtctactacctctttgccttctaccgtggatggaagcagtctgaggccttcaccagaagcagaggctggtgccgtccttcttgtatagtctgtagaactgtcagccaaataaactccttttctttacaaattacccagtctcagatatttctttaaattacaggggtgtccaatcttttggcttccctgtgccaagaagcactgtgctcagccacaaataaaatatactaacactaatgatagctgatgaactttttaaaatagcagaaaaatctcacagtgtttcaagaaagtttatgaatttgtgttgggctgcattcagagctgtcctgggatgcatgctttataacaatgcaaaacagactaacacagtggctgaatggataaagaaacatgaccctactatatgctaccttcaagaaacccatttcacctacaaagtcacacacagactgaaacggaaggggtggaaaaatatataacatgcaagtggaaaccagaaaaggctaggtgtagttgtaattatatcaggtaaaatagactacaaatcaaagactgtaaaaaaaaagacaaagaaggttactatataataataaaggggtcaattcttcaggagcatatcacaattataaatcgctatgcacctaacattggaactcccaagtaaagcaaatgttaataaatctaaagggagaaatagactgcaatacaataatggtaagagactttaacaccccactctcagtaacagataggttatccagacagaaaaccaacaaaaaaagtagtagagttaggccaggcacggtggctcacacctgtaatcccagcactctgggagccccaggtgggcaatcacctgaggtcaggagttcaagactaacctggccaacatggtgaaaccccatctctactgaaaatacaaaaaaaattagccaggcgtggtggcacgtgtctgtaatcccagctacttgggaggctgaggcaggagaattacttgaacccgggaggcagaggttgcagtgaactgagatctggccactgcactccagcctgggtgacagagcaagattctgtcacaaaaaaaaaaaaaaaaaaaaagaaagaaagaaatagtggaaatagtggactgaaactatatactagtcagcctgaccaacatggtgaaaccccgtctctactataactacaaatattagctaggcatggttgtgggcgcctgtaatcccagctacttgggaggctgaggcaggagaatcacttgaacctgggaagcagaggttgcagtgaaccgagatcgtgccattgcactccagcctgggtgacaagagcaaaactccatctcaaaaataaataaataaataaataaataaaaataaatgaaaccacatactagggcctagctgacatttatagaacatttcatcagctgctgcaggatacacattcttttgatcagcacatggaatattcttcagaatagatcatatctcaggccaaaaaacaagtctgaacaaactgtaaaaatagaaatcacatcaagtatctttcctgatcacaatggaacaaaactagaaatcagtaacaagaggaacctcagagaacacacaaacccatggaaattaaacaacatgctcctgaatgaccactgggtcaatgaaagaatattaagaagaaaattttaaatatttttgaaacaaatgaaaatggaaatacaacataccaaaatctatgggatacggtaaatgcagtactaagaggaaagtatttagcaataagtgcctatgtcaaaaaagtagaaagacttcaaataaacaacctaacaatgcacctcaaggaacaagaaaagcaagaacaaaccacgcccaaaattagtagaaggaaagacataactaggatcagagcagaaataaatgaaagtgagactaaaaaacgcacatcaacaaaatgaagtttttttctgaaaagataaacaaaattgacaagcctttagatggactaagaaaaaaagacccaaataaacaaaatcagaaatgaaaaaggagacataacaattgatatctcagaaatacaaagaatcattagaggctatcatgaaaaactgtacaccaacacattaaatcaggaagttaacacagattcaatactataatgaatctataggccttattcaaatttcaccaatgcctcttaatttaatgttatgtttctggcccaggatccaatcaaggccaccacattgcatttagttgtcacatgtccctagtcttccaatttgagacagctcataattttgacacttttttgcaaaacattattttgcacaatgtttgtcaacttgcttgtgtctgatattttctcatcattaggttgtagttatgcaattttggcatgaacactacagaaaccatgttgtgcccttctcagtcttatcaagaggtacaagatgccaatatgtcttatgactcatgttaatttttagcaattggttaaggtgatgcttgtcacatttattaactgtaaagttactatttcccctttataattagtatcttctggagacatattttgagaccaatcatatctcttctttttcattctatttttgcccactaattttagcatctattaaccctttttctgtttacaaaattaaaaagtgcagccgttgccagcgctcattaaattttacctaaacacactttttaagtttggagcaaatctgactggttttcaatgtaaaaataaaatacagttgggcgtggtggctcacgcctgtaatcccagcactctgagagactgaggcaggtggatcacctgaggtcaggagtgtaatcccagcactttgagaggctgaggcaggtggatcacctgaggttaggagttcaagacacggtgaaacccagtctctactaaaaatacaaaaattagccaggcatggtggcaggcacctgtaatcccagctacttgagaggctgaggcaggagaatcgcttgaacctgagaggcgaaggttgcagtgagctgagatggctccactgcactgcagcctgggtgacagagtgagactccatctcaaaaaaaaaaaaaaaaagaaaagaaaatagaaaatataaaaattgttcttggagttaattctaaacagaactaacatcagaatcatctgaatcataaaaatcatctatttcagacaaataaaattcaccaaatgaatctttggccaacagctctttgagaacaatgttaacatcactcatagacatcatggtgtggggggcagaggaagggatagcattaggagaaatacctaatgtaaatgatgagttaatgggtgcagcaaaccaacatggcacatgtattcctatgtaacaaacctgcacgttgtgtacgtgtaccctagaagttaaagtataatttaaaaaaagaaaaagaaatgctacatttgccgggtgcagtggctcatgcctgtaatcccagcactttgggaggccgaggcgggcagatcgcctgaggtcaggagttcaagaccagcctggccaacatggtgaaaccctgtctctattaagaatacaaaaattagctgggcatggtggtgggtgcctgtaatctcagctacttgggaggttgaggcaggagaatcacttgaacctgtgaggcagaggttacagtaagcagagatcacgccattgcactcccacgtgggcaataagagcaagactccgtctcaaaaaaaaaaaaagctacattttctaggatttgacatttttagcaattgagaattactatattttgtcaatggaaatatcactactaaaagcagaatgctataaataggatgatgtcttttttttttttgagatggagtcttgctctgttgcccaggctgcagtgcagtggcgcaatctcggctcactgcaagctccgcctcccaagtttatgccattctcctgcctcagcctcccgagcagctgggactacaggtgcccaccaccacacctggctaattttttttgtatttttagtagagacggggtttcactgtgttagccaggatggtcttgatctcctgacctcgtgatccgcccgcctcggcctcccaaagttgttcttaatttttattgttctgatggctaatgacgttgagcttgagaattctttatgtattcaagatatgagtactttgtcagtaatttccaattattttcttctagtctgtagctcgccttttcatctttgtaaagagcaaaagtcttttacagagcaaagccttttaattttcttttaaattgagacggagtctcgctctcacccaggctggagtgcagtggcgcaatctccactcactgcaacctctgcctcccagattgaagcgattcccctgcctcagcctccgagtagatgggattacaggcatgcggcaccacacccagctaacttttgtatttttaatagagacaaggtttcatcatgttggccaggctggtcttgaactcctgacctcaaatgatccacctgcctcggcttcccaaattgctgggaatacaggcttaagccaccacgcccaacctaagccttttaatttttaaaaatgttttccagggtgatcatttcctttcttttaatttgcattattttgaatgttcatagaagctttattcattttttgattgactatcaaaaaatattcagatgtggtggcagatgcctgtaatcccagcctctttggagactgaggcaggagaatctcttgaacccaggaggcagaggttgcagtgagctgagatcgcgccattgcactccagcctgggtgacaagagcgaaactccattgaaaaaaaaaattgtctccaaacactagagtaactgtacacaaaatgtagctctgagctgcgcagccaaagcagggaagggagcagatgagtgacattagactctttgactagtacaaagatatttataaatatatgtacaaataatcattgtacatattcattggggttcatagtgatgttttgatagaaatgttatcatgattagatcagggtgattagcatatccatcatctcaaacattatcatttctttgtgttggaaatattcaatatcctccctctagctatttgaaactatatattgttattaactacaaccttcctacagtgatacagaagactgtaacttttttaaaaattaccttttatttgagtatttttaattgagataaaatatacatatataatttaccacctttaccatttttaagtgtacagtttagtggtaatgaagatgtttatttatttattccccctccttcctccccttccccagcctctggtaaccactaatctactgtctatgaggtgaagaggaaaggtctaagatcgtttgcacatgttttcttccattctacaggttccctcttcactttgttgattgttttctttgctgtgcagaagcttttttagtttgatgtaatccaaagtatcattttgggggccacgcatggtggctcacacctgtaatcccagcactttgggagcctcaggcgggcagatcacatgaggccaggagtccgagaccagcctggccaatatggtgaaaccccatctctactaaaaatacaaaaattagccgggtgtggtggtgcacacctgtaatcccaactacttgggaggctgaggcacgagaatcacttgaaccagggaggcagaggttgcagtaacccgagattgcaccactacactcgggcctgggtgacagagtaagactctgtctcaaaaaaaaaaaaaaaaaaaaaagtccaggtactgtggttcacgcctgttatcctagcactttgggaggctgaggtcggtggatcacctgaggtcaggagttcgagaccagcctggccaacatggtgaaacccagtctctactaaaaatacaaaaattagccaggtgtaacggcggatgcctgtaatcccagctactttggaggctgaggcaggagaatcgcttgaacccaggaggcaaaggttgcagtgagccgagatcgtgccattgcactccagcctgggcaacaagagtgaaactccattgaaaaaaaaatcatttttgctttggttgcctctgcttttcatgtcttacagaaaaaaatctttgctcagaccaatgtcctggagcattttcccaatgttttcttctagtagctttgtagtttcaggtcttggatttaagtctctaatccatttttattttatttttgtgtatggtgagacacaggagcctagtttcattctttccaggcccatccccaggagatttggtaaggactggggcctgggactcagcatttaaaacaaatattctagatgattctgattcaggtgtcctgtgaccacacttcggaaaacttgccctaggtgaagtttggcattagatttctcccctggatcagaatcaggctgtgtttgaccatctgatagggatcctgaaacatccccaagcctagcatttctaatatagggctggaggtgacattggagcaattgatgacacagagtgtgatgtaaaagatcacaaatggatcagagagaggatacttgggttttagtcccagcctggaagactctgaccaagccttgcctcgcttctgtaaaatacagttaaacagtcaccgccccgtcaaccccagcaagcaggtgagcaccaactgaaagttcctgaataactgtcatgggcagttgggaggctcagccccacccatgttgccagggaaaccagacctcctgagccgggactagactctcaggctcagtggccagtgtgactcgatccactgaagaggaaacctgcaaaaagagctaccaaagaagcctgcaggggtgctgcccctggccctgaggctggagagagtcttgaagatgaggagaaagggagaagggcagtcccttcagggcttagggaaccaggccctaacagaagtccaataaatgcaggtctgtttgaagacctgaagctgtctttcagaaactgggtctgaagaagcctcacagctgttgccaggcctgggagagctgccatcagaggccgctgctgcggagaaagtccttctgctctgtcctgaaggggagaaggccatgtcaccataggtctcctgctgggggtgggccaggattctcagcaaggaggtagaaatgaccagggcaatgacaacatggggattcacatggacctatgttaatgtatcaagaatagtcggaccaaagcttgttaacacagaataaaacagggaaaccaaaaagtagtggagagggaatagagaaatataattccaaagaaattgcctccaaacactggagtaactgtacacaaaatgtagctctgagctgggcagccaaaacagagaagggagcagatgagtgacattagactctctgactagtagaaggaagcattagtatccatttctcagaaaagaaattgctttcctgactcctgagcaaaggcagcaaaccacagtcccttctcatacttcttaatgaagaattcctgaaccagggattcagcattcatagcaaagggaagtcttaccccagagggaggctagtgagggacaccaaatcaaagaagacaacagtttatttaggttagaaggaagaacaaggctgcaaagctaatgaagcttggcttcaggatcgcacagttacaggtccttccctcacattctctcccctttctccgtccaccagggcaaactagagatttaagttttcgcttttgttgactttacaaactcaattcatgggtacagatggggatttaaaaacaaaaacaaggacctggagcagtggttcatatgcctgtctgcactctgggagctgaggcaggaggatgactggaggccaggagttcgaaaccaggctggacaacatagtgaaatttcatctctacaaaatttaaaataataataataataataaccaggcatggtggcacatggctgtagtccctactcaggaggctgaggcaggaggagggtatgagttcgagcccaggaggttgacgttgcagtgtgctatgattgtgccactgcagtctagtctagggtgacattgtttaaaactgttcaaacacacacaaagtgaaaattgtaagtgctcttctaaaagcattgcatgttggaaaattagactaggaggcactttgacatctttttagaccacagatttctggggaagccagaaaggagctggggtggcaaaactaggagcacaaggaatgcctcattagctgtgctggggggccaagggtgtggagaataagccaggcaccaggaaaaggcagctgccattctctcgcatacccggcacaccttgctgggatgttggtataccatgggtaaaatgccaaacctagcgccatctcttctttaaccccctacagtactttgtttgtacttttcttagggtactcatgttgcccgcctccctttatagatgctcatatttaatccttccaaaaacatgtgccctgatgccaagggcaagatcttccccgcctctgcatccaggagctctgaagtctacacgaatggaaatatatattcaaaatacgtattcaacataccattggggatttgatccaaatggaaatcaaagaaataggagactcagtgtgagctctgagtatgtttccaggcttactgaataagacactataagtagctctaaccctgcagatcagttaaactgcagctgagagctgcagatgatcagaatggtgggtgcaagtttatgtggggtcgaagttcataatattgaaagaacttctttagaaaaaaaaaatatatatatatagttacaaatatataataaggtccaagccttgggggtgtgaggccctgaagttgaaacttcaagaacttcaagggtaaatagcctgtggtctttgcaagtggctggcgaaggtgtcaaagagatgggactcacccttgactgagcctggaagactgggcagaatttggaaagacaaaataaaaagggccgtgtggcaggatgaacaaagacatttaatattgccagaggcctgcttggggagcccgtgagcaaaccagtccaattggacagaaacgttgcaaagtccaggtggaaagaggaaggctggaaagtcagctgaagtcagttgggggtggtgggggtgggccttgagtgtaggctgacatctgaattctatttcactagttataggagccatggatgtttattttttaaatgcagttcattgacttgaagaaaacaatgtcttaggaagattagcctggttttattgttcaaggcaatgaagcaggaggcacttacaaaagtccaggcttgggtgataagggcctaaacttaggctgttgatgaaacccaggttgtagccgtgcgaatgaaaaggaaatacctaactcagtggattttggtgatttttagagaccaagaagagaaggattccaagatgattgaggtttctgctgagtattagagaataactgtatcattaagagatatgagaaggttaagagggccagatttgaaggagaaaatagaagtggaggattttagatatttcagactagagatgatgggagaactatgaattttgagatggtcttagggaactgagggctggagactgatttggtaatcagaagcacccatttattcattcatgccataggaatttggctggtaacctctggaaaaatcagccctgtgttgcatgtcaaaagggatgtaacagatgaagtggtccctcccttcagtgagttaaatttaggatctcaagagagaagagatggaggtgaaatgagtgaagtaaggcagggtctattgtgtacaagaatgagcgacctaaatgtgggggaagagttggctgtggcgtctgtcacctactggtttccaaagagtattagactcagctgactcaccatgtgtatcccccatccactgtatccctctccaaatggcaggcttgtctgaagagaacaatgtccatagaggttacaactgccctctgccccctgagtaaaatgagttgtacagacaataaatatgatgccgttcatgaaattggagggaaactcccggatcctggagaagggagaactagatctgaacctgtgaagacgagcagtttgcataagtggaggggtgtagaggaagctgccttccaaaaatggcagctacaaaaaaatagggaggatgtttcctaggaggtggaggagatgtaaccccatggggaagctcaactgacttttctcatgctgttccctctgttgagaatggctgaagccaagaagccagtgtcagaaactaaagaaagggaaacaagagtcgaggtggaagataagggtacagggttgagagaggaatgggtgacaactccacgattttcaagtgaagctgaacccccaacttccaacttcttgtttacgtagcagtgaactgcctagagctgttttttgcagaatcgtatagagttgacctcatgcatgtttctttaacttctatcactgacgtgtgtttcaatttccttgtttcatgataccctttcttaagcttacgtgaatatgtgtaatacatttttaaatgtgacatatgttaattttaggcatgtcagagtaaaacagccactatcaagggaaatctgaaatctgaaatctgcagggtttgatcttcctctcagtaatttgacatcaaactgtgtgtcccatacttttaagaaaaaactgtttgtggtatacccgcaaatcacgggagatcatacatatctgaaggtgctgtttatgaaactacattactctcaaactccttggctgcctgttttttgtttgttttgcctttaataggagttttctttacttatatgaataaagtgaagacagggaggaccaaaaaaaagaatacagtcacaatgaaattaactttgctacttattcctacttggccaccaagatacaatagatgttgaggctgtgagtaggatgagggtttgtagtcatttccataaatggtcacaccccatattaatggacagatggcccatgtggcaagagagctggttggtcaatggaacaggacttgctgtaaccagtgctgaataagctcaccagcatccagcctgagatgagggggggaagtctgagaggctttgtctgtcactttcaattaaccaggatcaaccaaggtaagcttcttgtcctgactgctgaaaagttctcaccctaaagaatcctaccttccccgatgcaagatggaaaattgctcaaacacttaaagctattctcaatgagaaacaaaaaaaggaccacagatacaaagtaagatccttttgtttattagaagctatttccacaaactgaacaatttggagactgagcatccttacactgtgtatgtagctctagcaaatcctactattttactctcctagctcagattcctttgtaaaaagtcagatgctgctgatgttcatgaggcttctcttctggcaccagggcagacaagacaacctgaagggctttctgcaacaaaatgcctagaaaatgttgggtgcaatttataaaacataattttaatgcatagctgagctcacaggaaggtaatggaaacccccaggagtcagaaggccaaggggacagaactctggagaatgaagcataagtgcctgctgtagctgccttgaaggtggaagggtatggtaggatggggctgttttaggaaatacacagggaaaagtgacagaaacctttggccttgcctatgggttgttggaactaagaaacccctcacacagatacataaatttgggattatctaggagcaacacagcaccttgggagattgaggcgggaggactgcttgaggccaggagcttaagaccagcctgggcaacatagcaaaaccgtatctctgcaaaaaaaaaatttttttaattagccaggcatggtgtgacatgatacttgagtagttccagctactcaagaggctgagctgggaggattaaccaatgtctaggattctcaggggttctgaagttcaaatatacactgtccttttattttgggaactcaaaaaattgtctctaagcctatactatccctcagtgaccttgcataagcaaatcacaaatgtctacaggacccatccacaagccaggcctcacaggagtcccactgatacagccctgctaaagctgagtgcacagtccaagaattaatccatttaaacaatctaccccttggcctacattttctccttgctccttccagctacaagttacgccgctctgtgatacaaactgttcctctcacgcagcagaattagaaccgaaggactgttttcccttcctgtatcctatttcttgcctccttgagagcagtccctaagttccttatagctcccatgcattgtttatacttaaaatacaccacgtgctcccacaaataatacacactggtttgcaacctcaagctcacaggtgatgggaataatgcccacgataaaagcctgtgagccagctcacgtcagaatcaagactagggtacaagtcctcaggctcctggctcctgctctttccacttcactattttgcttctctttttcttgcagcgagtattggcaatagtaaaatgagtcccacttctctgataactcaccaaccatgttggagagaaagtatctgagaagtcagttgaaacaaccaccacaacaaaaactaattcccaagacagatgatccttgagtggataattgccacttgattgtttattagagccatggctcctgtacggggactggtgagggcgggtgttgggattacctttcaaagggccattcagaggggaaaagctacctgtgctcaaaaacaaccaatgagggtctcttggattaccaggaggctgaaaagcccagagatggtgggcacagtgaaaggttggggcagtggggccaaagacataaataaaggactctgtgttttaggactctaggagctcatcactaaacaaagtgcatactccacactccctgcagaggctgtgttgccgtctgctgtgtgagtgaaggtgacagctcatcccgctagcatcagcaccaccagattgctgtcaggatctcgagggcaaggcccatgtctgattcaataacctgtattctgagcactcagaagagagcttggcacactgtcagtgctccctaaagaagttaaatggatgctgcataaccagggcagcccagcagcgtcggtccagagacaagggagtgacacctgctccccgacgcagtatattccgtacaccacagctctgaatgtccatgttcaactcatgcggtggtggggaggagatgagagagacctgagacacgaggcacctctgaatgatccccccacggcccacagggctggcagccccctaggagaccctggaatggactcgcggacagcagccacctatctcatggctcacacgtccccgcccttcagcttatgttgcttccctgctctttcctgctaaagtggcccctgctgaatgccgccagccacggggtcatgcagcttccctcctgagcctgatccactgaggtttccacatgtgtagtcaggggctttgctatgactgagctgaagacgccttcttccctttgaggccagaaagagaaagcccatgggagctgaagtgcagatgggcagcactggctcttccctgtcaatgtgtggatggcagaggcatagtcctggctggtacctgctgcctcggccttggaggtcaccacagacctgtctcttctgtggttatcgcgctttgcctgccgctgagtctctctgaggtgatgctcctcctgtcgttggcttggccctccaacccagactgcatactgtggcctctcaaagcaatgtcgcctgatactcaggccagaaagagaagggaggagagtggggaggagaggggtggaggcgatagcagaacttccttccagagtctctatattcttctgtgttgtttgaacacaacaaccatatactatctctgtgatttaaattcaaatttcaatgagaattaaaagttgaagctcaggccacactgctgtgcgttttttagagagatatgtttgactgaaagcatatcaaggggcaggaagaattttttgctgggcagtataaccagggcagagaaaggtttttatttcttaaaaatattttctatatcataaaaaaaaaaaaaaaaaaaaggccaggagtcaaaactagaccctccttcggccccatggacctagccagtggagcaggggtcccagccctcatgccatgaggtgctggggagaggcaagagagagctggtgctgctgccattctccccagctgagtacaggacccaggaggaaggcccagccccagtcggggtgcagcagctgcagacagaccctactctttgtggtcaggccacactctgagacatagttcaacctctggacaactttccctgtgagcccaactcaacccatcccagtccggcccaagaggtgtcatcatcatcacattgagggccagctgccccatcacagggcaagcagccctgacccaggaggtaaccggaagcagctttgctcctctagaaacagaatccacgtgaggctcactgccctcctagggggtctccatgtgttcccttcccctatcccaagggaaagtctccaagccttgtctttacagaagggaacattgagacccaaagaaccgggctgactctgtccacgtcaccggggcacagccagaagccttttaacaccaactcccttgaataagacattcctggcacccagaagggatttctatgctcagagccataccttcactctccatacaagacagaaatctcagtttactcagtacacgcacccggagtgaggtcagaattccccctgatttcataccagtagtttattaaggaagccaggccaccagctgtcattctgatgctctcaagaaggcagtctccggtagaaatgcaccaatccttttcgctgatgtttctcctgcttttaagtagcctcattaagaaaagtaattaggaccttattaagaagtcctttcagttgtcgtcgttaagaagaaggtgctcatcagctatcctaggtggagtcctcggcctcctcccagaagaacttgtcttcatggacacaaacatatattcccaggagccaatgaagagagcttgaactctgccttctcctgggttcccttcccaggaagcaatcttgccctggagtgggggcagcaggattgcagggcaaaaagagtaggggaaggacctcacatccagggtaaggggctatctacctcgaaagggccagtaaggaacatctggggaaggagaccagaggccctttgtgactccctcagattagttccgtgtgtaggtagagctccaacctgaaaacccagcaaggaattggactggggtcagggaagcagtggcagggacctgtggcccagccaattcatggaccagccttgcccggcccggggtctgcttgcaccaaggaatgtgtgcagtggcaggaaagctgttctccatactgatcagaaatctgcctcctggaatgtctttccttgggcctgcttctgatggccgtccagatatgtagggtccagccctatggggcttagcgggtgttctccccgtgtgcagagacaagagattgtaataaatgaaggcacaagacaaagagataaagagaaagcagctgggcccgggggaccactaccatcaagacatggagaccggtagtggccccgaacagctgggctcgctgatatttattgcacacaagacaagggggcagggtaaggagggtgaatcttctaagtgattgacaaggtgaagcaagtcacgtgattacaggataggcgggcccttcccttttaggtagccaaagcagagagagaaggcagcatatgacagcgttttctgttcacacgtacaagaaagatcaaagactttactttcactatttcttctaccgctatctactacgaacttcaaagaggaaccaggagtacgggaggagcatgaaagtggacaaggagtgtgaccattgaagcacagcaccacagggaggggtttaggcctctggatgactgaaggcaggcctggataatatccagccttccacaagaagctggtggagcagagtgttccctgactcctctaaggaaaggagactccctttcacggtctgctaagtaacggtgccttcccagacactggcgttaccacttgaccaaggagccctcaagcagcccttatgcaggcgtgacagaaggctcacctcttgccttctagatcacttctcacaatgtcccttaagcacctgaccctatacccaccggttattcctaggttatattagtaatgcaacaaagagtaatattaaaagctaatgattaatgttgataataatgattgataattgttcatgatcatctctgtatctaatttgtattatgactattcttattctaactattttctttattatactgaaacagtttgtgccttcagtctcttgcctcagcacctaggtaatcctccgcccacacagatatttgaagccagtgacactgtcctcctaaaatgtctctggatttgccgtcaggatttgctgtaggatgtgttttgtaactcaacctgtgatctgtcctccaaaggacagcctcaggaacgtggggaatctgatcgcctgtatcctacctctgtgtgggcagaggagctgctttttgtgttcagggtgataatgcattttctatttcatttaaattcactctcggccttctttccagattagtagcaggcccagtgtctctcctgggaataccctagtccccttgagttgtcccaagaatcgctagaggtggctcagtcctgtttccccggggaaaggccaaacctctccattctcttggcgagagttaagaaccagccacaattgtaagctgccattgcttctgctgcttccatagggtgttgctgctgacccactgatcccaaacaagaacagacattcttgcccacaaataggatggttttcatgatggttcagatccccactgaggtcatggacgcacactgagctgctctaatctcgccttttaggctcatctacagggccagctagagccctcgccgccatgtcatctccttggataacctttctttgcagtggccctcagctgcaaaagcctaagaacaaatccagaggaagctggcctccgaggaggaatgcacacggaaccaccctgtctccggggagcttggagttttagttttgtccaagctcgcagggcaaggctgcccactcatcttgcggagggacacagctaagaggggcttttgtggaggttctcctccaagcaaagatcctggtttgggctctgatctacacacaaaagtagcaggaccctgcagctttgttgacaaaacatttggaaaatgcacccatgccaccaggccacctgcctatttctagcaatcacttctggttgaattctttaaaaaaaaaaaaatcttgaaaataagcccttaaaaggttgtttaagaagtctaactctctcacagtcaacggtacccactttggaaatgggtcatctccccttcctaactgccctgggggatgagggtaagggatgatagggccccttgtgagatgacatttgaagtatttgtgtcattgtcctaacagaacagatgcctgtctgcaggacactgactgggccatagtcactcatgcatgtgttcacagtgtggtccatgcacaccccctatctggcccttccctaacagctgctgcaaccctgccagactgctggaggtggaattggccaggctggctatctcaggcctctagccatggcattagccagtcagcacagacacaaccccaagggtccacatgcccaggcagacataaggtggctggaaaggcagctgcccctgccctaaggactgttagtccaaactgcaccattctgtaaacaccctccacccatacccctgcatttcacagatcttggttaaagtgaaacattccatgggggtttgggccatgagaaacagcctgaccaaccacctgactttcttacattctgctgtaaaaaagtacaaagaacatcacattcagccagaacaagggccaaaccacctcatcgtgggaacatgttatcaaccttttcccaggcaacatgctccccaagatccctcctgcccagggttataattgccccagcctgtaagcagtggtgagcactggcattaagctggtcccccatctctgcaggtctcatgctgaacatagaacctgcattgctgtagagccgccgactccctttctttaaccctcgccttccctttaaaaaacctaatgaggatgtctcacagctaaaccttagaaaccatgaccttcactgaaactggctgagtttaaggagaggctcttagtcatggtcagtttcccctctcctctggctcccacctcccttggccatgctgtgtcccttgagggatgagcacacctggctgcttctccagacactagtcccctccgattaccagctctgggctgggctgaccaccttctcaaccatcctggtcagcatcctacgttctatctcttacagcaaacaaccagcctatttccttcaatgcctccttcactgtttctttgagactagagtaatataatgcttttaacagtggaaagactataaaaaatgaagttatcaatactcaataagtgagtacattctcccaaataaatactatgtgtgttgccataaaaaagaatgcagcagatccacatggtctgatacaggaaaatttccatggcattgggtagggaaaaaatctagtaggtggattataattatgtttaggaaaaaatatgaaaggggaatacaagactattttttgctcgtatagacattaaactgcaacagtagttactaagtggaatttaagatagagcacaatagactcccctctaaacatgattacaaaaagtacaaacacagactagtctgtttttctgtcatgaaaacccatgtactcaccacttagatctaagactacatttcgccatactgcattataaattttttttaatgagccatttcagaggaaattacttcagatgctgcatctttaaagtgttgagtttaccttgcctcaacatattcccctacaagatgccattaacaccctaacacaataagtgattccccaataccatataattgagtccatatgaaaatctcaattgtttcccaaatgttgttgctgatcaccaggggcttggtctaggtcctgttgctcaccacacagaaagccaatcactgtggcaacaagtattgccagggaagaagattttatttgagtgatgtcagccagagagaagggagaccagcctcaaatacgtcccttcccaccaactaaagttaagggaaaagaagaggggcagggacgaggagttggtcaataggcagcaggcggtagtataaggggttccagcatctcattgtaaccacatgtgggaaaacaggaatgaggcagggataagaagttggtcaacaaggagcaggtgcacctcactgtccagtggcagtgatctggaaagtctcagttcccggtatcattcaggaggcccgatggttggtttcccaagaaaggaactcagataagacaaatgtaagttttccaagcttcaaggtttttgttttttttaaaatatggaatccttcactaatttgagtgtcatccttacaggggccatgctaatcttctctgtatcgttccaattttagaatatgtgctgctgaagtgagcactttgttttttcaagacaacagtttcattctttcacccaggctggagtgaagtggcaccatcttggctcactgcaacctccacctcccagattcaagtgattctcctgcctcagcctcccaagtagctgggattacaggtgtatgccaccacgcctggctaatttttgtattttcagtagaggcggggttttgccatgtgggccaggctggtctcgaactcctgacctcaggtgatccacccaccttggcctcctaaagtgctagaattacaggcttgagccaccgcgcccggcccaagcttcagttttatgagaaaactgggcctgtttcaatgtttattttatttggttattcaagtctcaacattctttcaatctaaaacagtcctcccaccagccctccttccccagccctttttaaatccatagcattgaagagaccaggtcattgtcttatagaatatccttcattttagatttgcctgattgtgtcttcattccctaaacttcctataaaccagcagttggatttaaagccttgataagacccaggtggaggatttttggcaagaacacattccagttgacactgtgtacttacttacttcatgttgtaactcatatctggtggtttcattatgggatctactagaatatacagaccatgggcagatcatatacaaaaacagaactctgacccacagtctgcagtaaccagtccaggaagccaaacaacccctgtagcctttggtcccaaatggcccggacttgatcagtacctgccagcttccctaattcttgcctctgttttgaaaatcctttagtaggaccaaccagagaaggccaaatatgcttccctaaccaatcacataggataccctgcttctagttagctcacccacagcctccagatgccaacagcctttgatcaaggctcacctgaagcctccccttttcccagcataaagctttctcactccgctgactgcctttgagtgtctgcaatggcaagtgactgtggctgactctctgtgtatataccacactgagaataagtagctgctgctcattttcatttgggtggtctataattattactgaagtgaagtgtgatcacagttaaggtggtaatagtcagaccctttacactgtcgatggactcagactttttacttcatgccttgcttatactgcttggatgttttccatgtgcctatattaatatttacaataaaagcatgatttagattttcatttagaatttatcttaaatgcatcaaatatgcaattttaagtcaagttttgcatgtttggctcaaaatatcaaaataatgttgtgtggttttaaaataacaaggtttattgctctttatattagacatgtagttaattacgttgatctccataaaaataagtttaattttaatttgaataaaagaatgccacaatgaaatactgaccattaaaaaaaaaaaaaagaataaaggaccttaaccctgggcaaacatataaaagcataggaaagtcacccagtataatgtctggcacattgcaggtgttttgcaattagagcccattcccacggtggtgcacactgcacaagaccacagaggtccagcccttttatctttctggtcccatccagtcatcacccatagtgaatcccgaaggcagcatctccacccaccgtactggaggaccaccgacaactcctagtcctcaggggaaactcccttccatattcttcttggtggcggccaatatacatttctttcttcacttcccaggacgtttgacatacttggtgttcctccctccaagctcctcccttcccttcaggtctcaaggtctcatccaacacttcaagctcaaaatatcacacaagcatcaagggggtgagcccagacaggcactcttccttgtccagtttcgggagaagatctctgttccctgtgaccccaggatacacaatggctgttctacactcaggaatcactacatgtgattcccaggacaggggctgcaactcttctgctaagagctcccatagccccagggctcccccacccccaccccatatacacacacccctctcccagtcttctgtgtctttctcgaggactggttagcattttggtagcacctttgccagggaagcaggctccccaggatgcactttgaaccctccccctactgacatggacttgcgttctcctgcctctaggctccttgcctggcagttctgcactttcggactcccctcctctaacgagtccatttgccaccacagcagtgactgcagtagggtcacggcacctgttttctgtgttatgtggaaaaaaattaagatactgaacatttatgtatgctaccttctgggtgtgaaggagggaacatgaattcacatttgatttagctggtatctgcagaaagcagcagtagggatttagaaatgcataaaaatagtgttactttttgggatgaagagtggcatgagactgatatctatatatatatctatatagatatagatatatatttggaggcattgaaacctgcttgatttattctgattatttaatacacactgacgcaactgtgatcccaaagagtgcaaagttaaagccttcaactgcagctgaggaagagggcaggaatggtacacctcgggacggtggtgagtcaggaatgacaggcaggtagccatgaccagggcagcttcctccccagggccaggaacaggggagtagcctgaggagcaggacccaagggtagcccagggccggggaagggggcagagacctccccttggcctaggtcaggagctcagaagtgccacatggctgaggggacaggaccctggaagggccagaggcagggccaggacagcaccatttcctgggggtctgggggcaggaagctgccctagagaagaagccaggaggggttgcctgcccctggggtgggggccaggctgaaggaggctgcagcaggctgcagcaagaaagacctgaggcaggtgcagggcctgagagcccagctagctgagcagggggggctcccagggcagcctggcccaggaagcagtcctgactctgcaggggatgccaagcaaggggccgcagacccctcaggacctcccctcttctctccctggaaaggagctggggaacccatagtgcaaatctgtgtaccactcagtgatggagggagactgtgccccaaggtggacactggggtgcaccccctccaccacctcagcctccaccgctgtcctcatcacagctgcttctcatacgagtgcaggccatggacaccacccttgatctgggccgacatggtctgcttctcaaacttgagctcccctgagtacatcatggaccaaaggacagacaggctgcgggccccgatatcctggcagctgtgctggatgcccgctatgaggtagggcacgaacttctgaatggaccctttgtcctggatggagcccgagacaccctgtgcgatcttcaccttatcccccttgctgaagtatcgtttctggctgctgctgctcttctccatggcatccagtgagcccatgccctggtacttcttgagctgcaccctttctaagaagaagtactcaccaggtgcctccgtggtggtggccagcaggagcccatcatcactgtggaggctccaagggccagggccttgaccacgtgccccacagtctggatgccaccatcgactatgatgggcacaccaaagcactgggcatacttggccaccttgtacacagcagtgccctggggccaaccgcaggccatcactttctgggtaatgcagatggagccgtagcccatgcccacatgcagcccgtccacacgagcgtccatcaggttcttggcctgggctgctgtcaccacgttccccccaatcacctggaggtgggggtacttctgtttgatgtaatgcaccatggtgatctgatacaccgagctcccttgggatgagtccaagactacaacattgacacccgcctgggtgagcaggtccaggtggcattcgtcatcctcacgggtgcccacagctgccctgcacagcagctgtttgtgggaatccttggaggccagagggtagtctcgattcttcttcaggtcagtgcgggcaatgatggccaccagctcatcgcgatcactgacgataggcagcttccctttcttgttacgctgcaggatctcatttgcctctttcaacgtcacacctttcaacgtcagccaccaccagttccatccttggcgtcatcacctcactgatgaaggtggcgtgctccttcttagcaagaaagtcgacgtctcgggaggtgatgatgcccaccagcttgctgcccatggtgcccgtctcagtgagggggataccagagaagccatgcagcatcttggcctccaagcacatcacccacggtgtgcaaggggctcagcaccacagggtccgtgatgaagccctgttcaaacttcttgaccttcagcacctcattggcctcgaactctggggtgcagttgtggtgaatgaaaccaatacctcccatcagagccatcccgattgccatgtcagcctctgtcagtgtccacaggggaggagatcagcggcgtcttcagcccttgtgggtcagggctgaggtcaggtccacctcatcatcagctatgaagtctatgaatcctgggagaatcaggaagtcattgtaggtgaggccgttggtgctggtgaagagctgctgcgcggtgagcccgtcctcgggcacgtagctggtgccgctgctgatcaggtagtctgccaggctgccgtgacaccccgcgacccgacataaacacccgagtggccacctgccgcaggcacactgccactgcgggccgggcacaggggctctcagtgtaaatctttttatatcccttctacttttgggaaaaaaaaatgccccaggaaggtctgatcaccaaatccttccagagagcgatcttccaagccaaagaggttttcagtcccacccactgaaatcatccagtcctttattcacctgtgtcaacccggctcggaggtgtggcctgcgagatccttcatgcaatcaagaagtcaggcctccacctggtcctgggggtcatctgaggcccgcagttttggaagaggaatgttttctgccagcagttcccacagacgggctggctccccactgtggggacatgcaccatgccctctgtgggcctctgtttttcatccctgaattcatcccccacagaatggttcagttgtcatatctagctatctaataagcttgagggcactgtgtcccctaggggatgcccacatgcctgaccatgcaggctgatgcagtgacaagcacaaagtatcgtgattatagttcctgctctcctttccagggctttaagcccagcacatgatgttgtgcgtttcttgttccaccaactggctgctgtggaatgactacgaaacatcttggatgacagtttaatcctcgtggggtaccaggtggcatctgggcacaggtcaaactttccgagagcctttttaacctctttcactgcagccaggaatggctggatctctgctgctgcctatagggattacagttgtcccatccatacactggtctgtgttggcttttgtcacctgggcatgtgcggccaccatcttgactgctcagctagttctgtacctgggttctagaatgatgtcataatgatgccattatgacagatcagcccaaggctgcacactgacctaatcaacaggtgcggcagagctgtgattaagagactgagtcagttcccacttgtgaatagacagcatgaaggctttaaacctctctgaacctgatcagcattggcaatgatcttctgcagatccaacaacagcacagaagaatgtatcatcaggaacacatttggatattgacacaacttcatctgcagttggcttgtcatcctgagctccgttcccaggcagcgtagatattgcacaggattttgctgaccagggagttgggttataagtggtaactccaacctcttaatactaacgacattgacagtaccatataatccatctattacaccacacaggaaaatcaagcccagtggtacaggacagaagaactggctccagccaggatcaagcattgctttggcattgttccccaatacctgggcctttcttctccaattgttggggtaactggagtgaggagcctgaggggacccaaaggtgttctcctggtaggattccctctcatggtcttctgcatttgtagacattttgattggttccatttctaagggccaattatctgtgctttaacctgaaataaggaacctgccttctgatcttcaaggatatgtacatggacacacatctttcagattcaactcttgagatttttggttttaaacaaacaattgtgttcatcacaaatgaagattccctcaagcagcagcctcctggaatcaactgctgagtccaaatcttgtagcccttaaaaatatttagtatttttactaagtaataagtatttagggtgttatgaaaaatgcaatttgaaaaagtacattggtttttaagaacaagaggaactatttagaaattatacaatatattaacaaaagtaaatatttaatatatctcaaacacaaaaatgcaaaaactggttaccaagcatcaagaaaaacttaaaacttgtaaaatacaaaggttaaatgtattttatcttcattctattattagcagataaccttaataaaaatgagctgttatttacagcaaaatatcatgtaattttagatttatcactttttatttctatggaaaagcaacaccagcatgtattgttgctgaaggtgaagcaactttttgattctgttctgttccactctgtgttctaagatgtgtgtcagataccggccacacaccctacatgtgctcggggcacagcctggccccacacagcactctagtctgcaggtgggcatctaaggccctgccattcccacttcttattgtcatatttacttagttctcagcacctctgcccatctttaaatgacttaagtgagagtatgttaaagtagcttacatgttcctaagcttcctcacagcacatcccatctgtgacagcaattcagaaaaaaacaaattttcttttattcttaatggtacacagcataagagaacagctcaggcagtttactgtaattgacggtcctgatatccttatctataaactaaaaactccccacagaagcttctgtaagtataatgttaaataagtctataaacacaaataacagtaacaacaagaatgtaatccaaatgctcagttatgggaaactagtgaagaaatttactggtaaacccactgtgatgatgtgtgtgtatgtgtgtgtgtgtgtgcatgtcaagttggctcagtgacagtccctagttatgtaagctaggtgctgctgtgaaggtattttgcagatgtgatgaatattaagagtatcctggaccgggtgtggtggctcacacctgtaatcccagcactttgggaggctgaaatgggtggatcatgaggtcaggagaccgagaccatcctggctaacacggtgaaacccgtctctactgaaaaatacaaaaaattagccgggcgtggtggcaggtgtctgtagtcccagctacttgggaggctgaggcaggagaatggcatgaacctgggaggcagagcttgcagtgagccaaatctctgcactccagcctgagcaacagagcgagactccgtctcaaaaaaaaaaaaaagagtatcctgaaagatctgggtgagcccgattcaatcagttgaaaagctttaaaagcagaagcctaaaaaggccttaaaagttgaagcttccctgaaaaagaaaagaaattccacccacaggcagtggcgtctgctgtacttgtgcctgtggagttccattctgctcattcacttccctcctgactgcccatagacaacagttgtggtctgtgcccatgacctccctgattctggacttgcttagccagcacccacaatcttgcaagccaattcctttaacaaatttgtatatatatgaaatacactggttcttcctctctaattaaagcctggccaacacacccaaaaattagaaggggatgctgctgttagaaggaataaggtatacattttaggccattcaagactccaataaatgacagtaaaataatagcaaagaaaaaccttactttggggttaagaaatcacagattgatacataaacttaattttgctcctctattaaaatcctactacaaaacagtaaatatagtaaaagaatttcttttaaaaggacattaatttagaaatacagggaaagcagaggggcaacaaccacaaaatcattttagaagttgaaaaggagagagaccagtggcaaattccttagcagacctgagaataccacacccaaaaccagcagaagaaaatgctaagaatctttaaatacatagaactgtggcattgttaccccatggaagttggggtggaggggaggcttaagtatggaatgggtaaaagctgggtgagaaacccattcctagtttccaaactacagagctacagccttttcctcaacatggccgaagctaggaggttattctctagagagtataagtgaggtttggaactaggggatgccagcatggatccagagaatgggcgccacactgaaaacaaaaggatgaagtgaccatatgctgtcatgctgaacgctgagtgcaaagagtcctagccttcttcccctactgggctccaagatgcggccaggccgatccttcccatcacataggaagggccccttggggtaatctggcaaatctctgaagacctaaagagagcactgctgtgcttccccagtgaacagcccagccagaccatcctacagtgaaactcaaaagactcaaaagaccgcactctcacccatttgatctggacttttacatttcccaggcttcatcagtcgacacccagtgattacctgacacctgaagttaaaacctctaatgtgcaaaaccaagaccaaggcaaaaacaaacaaacaaacaaacaaacaaacaaaaaaaaacaaccttagaggaaatggaattatgtgggatgaagaaaaaaaatactatcctcagataagatattgtattcatgaaacaagtacaggaagatataaaagagttcttggaaattaagaacttgttagcaaaactgaaaaactcaagagaagggactgaaggatgaaagttgagtgaatcgccacaaaataagagtaaaatgacaaaacgacactggagtaaccaaaaaatgagggagctggccagatccaggggctcacgcctgtaatcccaacactttgggaggccaagatgggagaatcatgaggccaggagtttgagatcagcctggacaacacagtgagacccatttctacaaaaaatttaaaaattggctgggcttggtggcgtgtacctgtagtcctagctacttgggaggctgaggcgggaagatcgcttgagcccaggagttggaggctacagtgagctatgattgcacctctgcactccagcctgggtgacagaataagattctgtctcaaaaaaaaaaaaaaaagaaaagaaaagaaaaagagaagagaagagaaaatgagggaactgtccaggatccccaacacataaataactgaagctccagaaagaacagggaagtggcctgcagcaggtgctcacggcccttgctgttttggctctctgggtctgcgtgtccaccccagcctccagcctcccaacccatacatatcaatccacacacaaggatgaacacagattttgctagtttctttgttttttgtttttgtttctgagatggagtctcgctctgttgcccaggctggagtgcagtgcacgatctcggctcactgcaagctccgcctcccaggttcacgccattctcctgcctcagcctcccgagtagctgggactataggtgcctgccaccacacccgatcaaatttttggatttttagtagagacagggttgcaccgtgttaatcaggatagtctcgatctcctgaccttgtgatctgcccgcctcagcctcccaaagtgctgggattacaggcgtgagccaccgcgcccggccagactttgctagtttttacttcatccagccctgttcaagaagatgatgcataggagaagataaacccagtgaccctcctgtggattaagaattcagatccgaggctaagcctttctcctcaagtgtttcctcacaggaaacagatccatcgaaggagaggaggacaggaaaatcaaaagaagtcaacattcccaggagattctcagcaaaatagaggagaggtgtcaagatgagagctggcaccagaccccgagggcagtgattctggcctggagcaaggattcaggacagacacgtcaggagccctcagcaccaagatccctgcgggcttcccgcagctcagctgaggacaggtcacccgggcgatcccattcacattctttctactcggcttaccttgacatgatggagaagcttcctgccctccagatcagctgaagatcctcactccatcccacagcagcgctcggctttgacgtcctcccgaaatcaaaaggtcagctgtggggactacaaaaacagaactcagcagccggcaccctccatccacattcttgccagatgatcagggtctggtccatggatagtgtggccacgggccctgatggtggcagccctgctacgcccaggactcattcaagccttgctgctccctggcttccccagaagggccccttgtaaattcttggagaagctgaagtccactctgaccttgagatcacattatgttctccagcagacttcattcaacattggaaacactgtgctttccccacacagctaatctgtgcttgatgctcaatgtttttaaaaatgaacagtatgtgaagagcaaggaaattattcactacaggtcaggctagcacttactttggtagagagggtggggcattcaaccgggtgaagacatacgagtgcttctaaggtagttggtagtgttctgttccttaaagatggaaacactatccattttactctttaaactatacatttatggccaggcacagtggctcatgcctgtaatcccagcacttggggaggctagggtgggaggactgtttgagcccaggagttcaaaaccagcctgggcaacatagcaagatcccatctctacttaataacaaaactatacacttatattggatatgctcttctctatggatgacatctttcacagttggggagaaaaagagataaaaacacatagtaatagggagaactaaaggggaaccatcaggaggccagagactatattctacaaagggagagcaaatgaaagagtatggacggacaagagaagggtgagggaacccacaggccagaaaagtagcagaagggggcagtacagaaggcccacccaccctggagcccccatctgctgagaggtccaccgttcccacgccagcacgtgcacccttgtctgcggtttatgttcactctgcatcccttcctgtacttcacgtttctcttcatctttgacatcatgacccttgtggccctgtgtctcatcaaccccacaggaggtggcagctcggcttccccaagcctctggttagcccactgctgttgagcctcaaagctttgtcttggctggaaagaaaggcctgaggcttctggccggtgctcggcttctactccagagctgctcagggtcggcgcctaagcatgaggtctcctcctgccttgaagctggggtttcccacagtctctgctaggccaggagcaaagtcaagctccatttgagtcctgttgcccacccatatcacagaatcatagctgttagcatgggaaggggccgcagaggtcatctcatattcaatttcttggtctcatggctggagttgaagaatctgctctgcctttccagaatgatctgagccagtgtgagacagacaccacctccaggaggaggcccatttggctgtgcccacaaccccgccccccagcacagtctccatgtggggtaaataagcctctaacccaccagggtacaaatcctttcagggctgcttgacagcatgtctcggggctgccctgcaaggcccgtgtgtccagaaagagcgatctcagtgacttaagtgccttccacctgaaaaagacataggattttcccccccttgtaattataaaagaaaaccaaggtacctgtagaaaatctggaaattacagaaaaatctaaagaagaaaataaaatcacgatggcctaagtgcaactgtgaaggtttggcatcacacctgagctctgtgaaagaaaccagccctaaaaccagcagccaccaccccaacccctacacccccatctgcccagtcagtgacttaaaatccatcgtgttaggccgggagtggtggctcatgcctgtaatcccagcactttgggaggccgaggcaggcagatcacctgaggtcgggagtttgagaccggcctgaccaacatggagaaaccccgtctctactaaaaatacaaaattagccaggtgtggtggcgcacgcctgtaatcccagctactcaggaggctaaggcaggagaatcacttgaacccagcaggtagaggctgcagtgagctgagagcatgccactgcactccagactgggcaacgagagcgaaactccgtctcaaaaaaaaaatatatcaacggctctgctgcccattctgaggatggcgcagggtgtgggctgtcaaggagacagaggcaggccctgtccctatggacacaagggcccactccaactaccagagccccgcacagctctgtgacaccccgtggccacaggtgagatcaagactgcagggccacagtggaacttcacccagcaggaaatgatgagggaggcatccacatcagtctgcccccaccagcctggccaccagtggagtgtgagtgaagcttctggagaacattctgcccccaagcccctccaagaaaaaggatcagagaaggagggctctgctctgccccaggcctcaacctggcttcctgcagctaaaggcccagcctcccaacttcctcatcaccttgcaacacggagttcaggcccacgtgggctgttctgggagtccagcaatgctgggtgatctcccagtgtgatgctgtcaggtactacaaagcagcccccaagcaggtggggccattcccagccaagggccccagacagggccctgactgagaatgctacccagagcactcagctcactcccttttgcttttcccaagcctgcagaattgaatgtgagggccagagggcagaatctgggtctcacacagatgggcagcctggctgcagtcaccagttcatgccacactggacagatgggtggcagggaagggcaggaaggagtgagagagaggctgatgcagcgggtagcagggactgcaaattgtcatgtgagacagaaagaacctacacatcagccaactccagctacgtgctgcagaggagaagctgtctcaagtttagaaatacaggaaagctgactgactaggaagagattaaaaactcacatcttcaaacacagccttacagaaattgacctttatttgttgtactaaagcctgtttaacttttgatacaaagtaacattttagtacagaaaatcccagtctgtcagctcagtacctgtctgtgcacactgtaccatctcagtcccactctgcctgtaacttagaaaacagcccctacccccagagggtctgcgagttaataccttgagaatagtctacagtttttcatagtttgtctgagctagaaaacttgtacctgtaaaacaaaggacagcattgaggactgaaacttgtctcttttttgaacaactgtgcaagaaaatatatccctttttaaaaaacatcagttatggctaaactacaatctagtgtctagaattacaaagaataaaatgaaatcaaagatttctcgctagtaaaatgaaatgttaggaacagtattaaaatataggtcctaccccaacgacacttacacagagcccagtacagtacctattattaacaggacgcatagcttaaggaggaaccacatcaaatcttcagccagacatatctagcctcagaagtgcaaaaaaaaaaaaagcccccaaacgaagacacccacactgagtagggtgcatgccgtgagtgctgtaatcaagattaaaaagacctcagtttttctttttagactgttgatagtgacaataaccattatgcttcccctaaaagctctcaattcaatgtctgaaacatgaatgttttcatatcaaaaagaactgatgtacctgccaccctctaaaaagtttaagaattaccctgcaaacattgcactgatgaaggctgtcacgacttacagagcctaaggaggacccaatggcaggcatcagcacagctgaacaccacctggaccccactgcagccctgcccacgcagctctcacggagcagacacagtcctcaagtaataagcacagatggaggagaaacgagaggctgtggaaggcaggagagaaaggccgagagacgagtttgtaagaatgccaaagtcaccttccccattgtgggaggaaaatgccaaaggcactggttctgctgccacaggcagtctgagcacctggagttgtgacgtccttccaggagaggtgccaccaaggagcaggaggtttgtcaaagctctggtcccaccaacaagaacctcccaaagcaaagcagcccccattgaggttccaaggtcgttttgctgaagacgggaacgaaaccaacaccaaagcgacagggggttgacagaggggacaggggctgggcaccggcaacatggagccgttcaagtaaacataaaccaccaaatacttagaaaaggcttgtaaacgagtgatccgaaaggttctctttgcagcatctctgatcagctggctaaagaaaggtgggtgctgaacccgtctttagtgttatctgttttgtgttaaagcacacgtgtgacacgggcagagtgtgtgggcctgggcctggatcgcacgcagccgtggccctctgtctacaaaggaggtgcttctgggtcctggttccggatccttcccccgcatgttcatagacggacagacttctactttcagtcgctagaaaagagctgagtctggtgtcccctcaggcggccagctgcagtcatccacagcacagcattctcctagagcgggcaggctggaatccacaggactttattttgttcttgattgaccattgccaagatctgagtgcaaatgcttgacagggctcctccctggatgacccctgcaaaagagccccccagacacgtcattcagctcagagtaagaccccaggtttgaggcaaggcagtacagcttgcactctttctactgtgtggctgtctgctttgtgctccttggcactctgctccatccccacctgactctccttcaccagcaagaaactgggaaagaaaattgcccctcttgagttgatcactcatatgtaaactgcccaccccactgcagttaacaccctgggttgggtttgcaatggttgggggaatcccagggcatcagaaggaagtttggaggacatgtggcggtggtctaatcattagcaggattctgcaggaaacgacaagtttaaggagccagatagctcatggccaagaggagagtcacagaaagatgatggcgccaacttgggccagccctgtactataggagtttgacaaaggggtctatagacaccaggccaggggtactccagtgtgctccacataacagcacctggacacaaaccaagcccctactgcaacaaggcatgctcagaaattgacagtgagtgtctagaaactgctatggaaacaggacgtcgtaattttatgtctgttgaatctaacaagaaaaaaatagagcttaccttttgcaagacttagagttttaaattttcatctctctaggaattgtcagtgtatttggctaaataccagtctgtgaggaattggaaatgaaagttcacacacacacccacacacacacacacacagaggcatgcacacctgcacatacctacacacacatgggcaccaagcccaggtccctggactagatcataacactctccacaatgcagttagaatccctgtcccatcctctgtgactgcaaatgctaatgccctgcaaatgacagactttcccaaagaggctgaaggccagaaggtaaaatagaaccaaacttcactgagtttgtttcactttgaagaccagagatggtaaggggacagcattgtttttttttgttttgttttttgtttttttttttttggaggggggtttgccaaatcccgctgcaaaacgggactgccctggagggtgctagggacagatgggcccctagcctccgctgcccacactgctggcacactgggggctgctccagtccccgccctgcctggggacactgtggctgcactaaactgcacctgtgctatgagacagacccaccactgcacgtgtgaaaatgagcaggcaagccaggcaggacctgaggccaagatcggtgagcttaacattcaacctgtaagaatcctgacgttggccagggactgcaatctgaacacctgacttgtcaggaacgtgctcatgacagcacttgggagcatgtagaaagtgcgggcttctccacggctaagaaaacagccttaggaagcctctgcttccttccctgctgcctgctccccactccaggcccacgcacacctacctgtgaagtacctgctgtactcctgctcaagcttctgcgccgcctcaaactgctctttggaatgcctctgagtcaccttgtccctcaggtagatggggtctctctgctccctgtggggacagccagacaccaggctgagcactgagcctcctccaggccctctttccttcctctgtccaggctaacaggggccccatcaaggcaggggtaggctgtggagggaggccccatgtgctccccacataaagcacagcaacagcctgtaggctgtcgggggagctctgggcagatgggggaaggagggccccccagcacacacacttggaacagatgcaccagcagcccctagcgcaggtcccagaagctcagcagcacagaaaggcaaaatggagcagggccttggtgagcccttggcccaaccagcacaggagccgaagctcagcgaaggcaacggctcctgagtcatgagccagctcggggctgagtgggactgtgcccaggccactggctcccctgctcctaagcagcacgtagcgaggaaagggggctggggcaggagaggggagctgtgcagaccaagctggccatgcccaaaaaacagtggcagcacccaaatggcggaggggcgcgaggaaggggctgcgcttggctgacaccacctctgagtaggggacagggccgacagggaagggtcattttctacacgtactgcctatttcaagacccataggcccatctctcattcctcaaccccccaccccaacacaccctgctccctacttgggctcccagccccacctgtgacaaggccccagcggagcccagggggccagttacctacttgatgtgcttggcgctcttgtagtggatgaagatgacaatggggtagatgtgcatgtggtggagccgctcaatagcgtgcggagcaatgtccaggaggcagtgtcggttctggggtggggggtgcagagtgagccctggcgggcagtgaggggcagccagccccctgtcctgccaccagcaggacccacctcacctcacagggctctacccacaaacaaggcagtaaagccacacagtacaccgtggggaaaccatacccacgaaactcccaacaaaccccacttgctgtgaggaaggccaaggctgggagccagggcttagggggctaggggtgctggccagcccaactccaaacttcctttcccgcctttgcccagatacagggaccttctgaaagccctgccccaccctggcctctgaagccttatttttgccagactgagcgaatgaagagccagagtctggtgagcctttgtgtggctgagactgaaatatgtctgtcatgtctgtcgtcccaggcatccaggtggagtgcaggcccgtgcactcccgacccccagatgctccactggggcattcccccaagtagagtttgcccactttcagcagtgagaagccaacaccttcatctaacagagaagggaagcaaagcccagcgagcgagctgagcagcctggagaaatggagcccaaggagcggctgtgtccttggactccgagtgtttgccccaccagcactccccacagacgtccccgccctcgtgctgcctaggatgttcgaaggcaccgagagtcatagcccttttaggggcagggaccctgagggaaggcacgttcctgtccccagaaggtgcatgtgaaattgttcggcacatgcatttggggaccccgttccggaatgccctgcgagaggcctttccgcagagctcaatactctcatcagagatgagaccccccgcacctgccagagaggaagatggggcggcacatacacaggggaactcctccatccccaccaagggatgtgcttgcagaaacacacagcagccatgagggcaagcccaggcacaggtgaactcagactaacacaacacggtgggctcactgaaggtctgagccgctggggcagaggatcacggaccaggggcctagacctgtgcacaggaggtctaatactggatgcctaatcctcagactgaagccctgggtaccttttctgtgatctcctttattgacgccacagtggtcacatcgaaatggccgcttctccgcttatagtcgacaaacaggcaatctttgacaccccgctcaatggcctgctgggaggccttcatcacctctgcaatgcacagacacaggaatcagggagccccaggccctgctgagccccagcagagggagcaggggaagaacactgctcagcagctgtcagtaacccagtcctgccatgcatgaatctgacccatgtcagcaggcttctggaacactgtgaaatctgccccccggtactgccacccactgtgcacagctgggcaggcaggtggacagggacatagagacaaagagcccagtaggcacagagggtgccccgtgccccttaccaaggggacatctgcagaacttgccaggagcctcattcaccagcatctccttcaccacgtccagcaaaggccccagaatcaggacaggcctcagagcggtgcagtccaccttctggacccgctgataggccaggctcaccgaatctgagggagagagagcagcagcgtcacggacccagcttggagtggaggacctgagtggggctggggaaccccgctccctgacctcgcccactctggtttgcctgggactcccccagcttcagcactgaaaatctcgtgtcccaggcacaaccgggcatcgtcacccctggagtccagcatgagcaccccccatgccctctgtgaacaccagaggcagctggtctcaaccactcatcccagagcttccttctgctctgatttttcctcgtgggtcgacgcctgcttcccctgccccatctccattctcctctgctctctggcaaggcagcctctggggtttggcaggtaaagctcccactccccaggaaggtgtggtcagtgtaacccagacctgcccagtgacaggtgaggcctccccaatctgcacggctagaacaggtgagtgctgtgagccagctctggccatgcagttgaggataacccttaagaaatggcagaggcacaagatggaagggacctgggtcctggatgatcctcagaacgcaatgcctctcccacatcaaccacagctcagacttgtacatgacagagaaataaactgcccattatgcttaagccactgttatttggtttcagttaaagcagtcaaaccaatatcctagttgatacatgcagtaaacctccccttgcaccaaatgaataaagtccttgcagggagacacagtctaaaacccagcaagatcttcctggcgtctccctggtataagtcactgtgctggaatctcagaaacataataaagaatagaacacagagttcctgccattaaaaagcacacactttaactagagtcacaacagagcaacacatgaacagcaagagagcacgcaagagctgcctggcaattccaggagcggcgggcttcagtagacactgtggctggatgacagggtgaaaagaccacttgggcaggcccaggagggaagtgggatgagagtctccagaaagagcagggcaagaggatgagtatggagatgatggggagggcagagcacaagatgactgcaggcttgggaggaagggtccatgagaggcttggcctggagggatctgtacgcatatgcagaacaaggagtgactgcagagcaggcacagggaccaggaggcagaaggctcaggagaacacaagcacagtgccagctgcagcagcaggctccatgaagagcaacctgtgggcaaactcagggagtaagtaaagtctctcctctcctcttgccctgtccctgtgtgtgtgttttttagaagtgatcactgctgggcatggtggctcacgtctgtaatcccagcactttgggaggctgaggcaggtggatcgcttgaggtcaagagtttgagaccagcctggccaataaggcaagaccccttctctactaaaaatacaaaaattagccgggtgtgctggcgcacacctgtaatcccagctactcaggaagctgaagcacaacaatcacttgaacccaggaggcggaggttgcagtgagccgagactgcaccactgtactccagcctgggcaacagagcaagactagatctcaataaaaataaataaaataataaaactgatcattatccacatacatccacacagtcttttacacagcacttcctaacctggtgaccagcagctctgttgtttaaaactggaggagggtttggtggtcacattcaccaccttggaaccccatgtggtcccgagtgaaggctctgaggaggagtcacggggcaaagaacttcctccgagaggagtttacataaacaaatcctctctgtaacaaatctgaacctcacggataaggccagcactcctctctgataccccttccccaacctcagtccccactgggctccttgaaggtaaccactattatgagctggaagtgtatcctagttcttcttataaactgatttttatatgctaaagaaaacctagaatatatattgtttaagtgtgtctgtggatactttataactcgctccttgtccggggctgtgtttctgggaggcatccctggtgattcgtcgtgggccgctctgctccttttgggcatcccattaacacttattctggatcgacttatccacttccctgctgatggacactacgtcaccattccctccatttactagtataagaatcatattctcaaattatggcacagttgctatagggtggaattcaatatagtgcttaaaagaatggtttggaagaatattactgagatgggaagatgctaacaatatgatagtggaaatacctggatgaaaacagtgtaatgcagtgtaatcccagctttgttgtattaagtaaaaaactggtaagaaatacattaaaatgttaatggttaaaaaaaaccatattctcccttaatgattactaacattccacactatggggtaccaatttaggagattctttttcctccctgacaatcttctttgtcagatgtcctcacaattacagaattgtaagactagacagcatcttatgagtcactgactccaactggagaagaaaaacagcctatccaaggtcacagctaatcagggcagagcaaaggcatggtcctgggggttccaaccttagaccatacggcaatggctttctttaaaaggtgctgtggactgaactatgtcccctcgacatttatatgttgaagccctaagccccagtgtgactacctttggagacggagtcttcaggaggtaagttaaatgaggtcagaagagcaaggccctaatctgatagaactgcggctttttaagaggaagagacaccagagatctctctgtctccaacatgtgaggacacagcaaggaggcagctgcgtacaaggcaggatgacagccctcaccagaaccaaccacactggcacccagatctcggatttccaacctcaagaactgtgagaaaatgaattcttgttatttaagtcacctagtctgtggtattggttttttggtttgtttttgtttttgagatatgctcttgctttgttgccaggctgaagtggagtggcacaatcatagctcatcgcagcactgtactcctgggcttaggtgatcctccagcctcagcctcctgagtagccgggactacaggcacacgccaccacacttgattagttttttaaagtttttgtagagatgggagtcttgccatgttgcccaggctggtctcaaactcctggcctcaagcgatcctcttgcctcagcttcccaaagtgctgggattacaggtgtgagctaccgtgcctggcctgtggtatttggttacagcagccctagcagactaacataagaggaaaaccagtcctccatatattcctgagacactcccgcacaagcccctaaaagagcaagcataaagacatgcagtgtcctctgggtggtggagagttgagtccacttagaccattgcaggtgggtgcacaatcagcagggtggggggtaccagggatgctatgcagcagttggaagcaataaactaaagcaggaattcaaaacccactgtgcattagaattagctggggtaacttttaaactactacacagggattaccactcccaggtataatggaacagcttgcagcatcccttggagaacacctagaaaatctgggtaaaaaatgagaaatatctttttgaaggcatcgtagagtggcagagacaagacagaatttgagatgccaagatcctggagagaaggaaactggagtattagaagctgacattctgcaggcctttcccccttcagagcaactggagacttctaaagtgagagtgaggggcagagaacccaggcagagggccgccgctgaggggctgagaacccaggcacggggccgccgctgaggggctgagaacccaggcacggggccgccgctgaggggctgagaacccaggcacggggccgccgctgagggctgagaacccacgaaaagtttctgaaaatctccaaagcaggtgagatcaaaacggagttcagggctgccaggacctggtgggtcattattccagaggaagggaagggcaaagaactaagtctggtatcacaggttttcccttaaagccatttgccaaattcttaagctgtgaaaagcaagaagctaagcatctaagacagtcactaagacactgagcagtgttccatggcctcccagtgctgaagagtgagaaactggaagtcaaggctccctagggaagagcggccctagggaacaccccaggctgggaccactggtgggccaccccctagggtcaggtgaaccaccagctgcacaaaagctgcaacccagcctgaggtcagctgagtctgtggctggatcaaagtgatctgcgagcagcggctatctccagagcagagggcagaccctctctggaagctggcaacatcactcggagccctgaaaatcccctaaacataacttctgacatctcaataaacaataactaggcatatcatggggcaggaccaagaaaaacaaagaccacagaaagagactcagggatgaccacacatgacagttaccaaacgcagtctttacaaacatatgattcaagtatttaagaggacagatgacaagagggaaagtctcagcagagaattaaagcctggtaaaaaagaaccaagtggaaactctagagtgataaataaaatacaacttctgaaagtaagaacataatggatgcaacagaagagtggaataatgaacaggaaaaaagagtagaaaacaaccaggctggctgaatcatggagagaaagaaagaagtggaaaatgcaggagaaaaagagcccagaagacaggagacagacagggtattgtcgaagaacaaaaaccccgaggagaggcaaggtcagcacagaagcaatatgaaagaaactgcggccaggaatctccaaaaccgaccacaccaccaaactacagatgtaaaaagtgctaagcaccttctgagcaggataaacacaaagaaaaccacacgggggaagcacggtgtggtaagaaattaagaagtttctttctgagaaaggaaggcagagaaaaccctacccactcatggtggtggacgggtggtggcactgccttcagcactgagcctggaaagatgacttctcaccagcaatgagtgtggcaggctgacaagtgtcccccaaagactgactcatgtcctaagccccagatcccatgagcattacaccttatgcaacaaaagaagcgatgattcagttaaaggccttgggaggaagggcttttcctggagtatctgggtgggtcctaaataaaaccccacgggtcctctgagaggcagagggagttgagagagagacccacgtggaggacgaggtgacgtgaagatggagcagatgagatttgaagatgacagtgatgtggccacagcaaaggcttggcagcagccaccagaagctgggaggggcaaggaacaggctctctcctcaagcccggagggagcgaaggttggccaacaatttgactgacccagtggtcctgagtgtggacttctggcctccagaactgtgggaggataaacctgtgtgtttgaagccacacagtctgtggtaattgggtacagcggccacaggaaactactacacaaagagagccagggaccaggaatgatatctttaaagcacccaagtaaaacatccaccaatctaaaattctatatccagtgagaatctccaaaaacgatattaaaatggacattttcagacacaaacactgacaggatgtgtcaccaaaaaacctgcactacaagaaaaacatttctgcaagttgttcagcagaaagaaaacaaaatcagaagcacaaaactgcaggaaggaataaagagcaatggaaatgtaaaaggcaaaaaccgatgaataattgatgtgcaaatggacagactgagtcagagttaaagtatctgtagaattaaaatgagaaaagtatggccggggacagtgccttgcgcctgtaatcccgggtgcagtgccttgcactttgtgaggctaagacaggcggctcacttgaggtcaggagtttcaagaccagcctggccaacatggtgaaaccccgtctttactaaaaatacaaaaattagccagatgtggtgacaggcacctgtaatcccagctactcggcaggctgaggcaggaaaatcgcttgaacctgggaggcagaggttgcagcgagccgagatcgtaccattgcactccggcctgggcgacagagcgagattctgcctcaaaaaataaaataataaaaaaataaaatgcgaatagtatcaaagttagaaaagagataaatggagttagtggtttgatgtcttagaattatcagggaagtggccaaagcaatgatttctcttagcagtaagtcaaaggtgcacactgtgaggtctattttaacccccaaaagaataaaatagaaacaactaaacactagtggatgtgagaggataacagtagatgatataggggcagaataaaacaaaacacatgattcatttttaaaaagcaagaaagaagggacaaacataaacgaggtagaatgaatagaaaacaaacagtaagatgggaaatgtctactttatgtaatgaggtaaatactcttgatgaaacaatcaagactgccacaggggtgttcagattgtggaaattcctcacactgctcacttttctgtaaatgaatgtgtgcattgctgtatgtatgttacacttggataaaatttttaaaaagacagattgccacagtggatttaaaaagtcccacatgctgcttataagggatatttaaatataaagtgacagaaaagtttgaagtaaaagaaaaagataaactgtgccaaagataaccaaaagaaaactggtaatgtcaataaaaatatcacgtaaaatagactttcagaaagaaacattcctggagatcaagaagggcattttataacgataaaaaggttaatttaccaggaaggtgtaacaatgcaaaaggtgtatgtatctaacgacaacttcaagatatatattgaaaaacacctgaagagctaaaaggaagaatagacaaagggctattttttaaagacactagcaccaccggacaaatgccaaacataatggagatggcacctacggagaaaggagcagagggcacaagagtggaggccaaagagagtgaaggaaaaaaaacaaaaagcaaaataagagagaaaccttgccttgagtaacaggttggcatttttttttttttttttttttgagacaggttctcactctgttgcctgggctagagtgcagtggcgtgatcacagttcactgcagctcttgacctcccaggctgaagctatcttcctgcctcagcctcttcggtagctggaactacaggcatgagccaccacaccaggctaatttttgtattttttagtagagatggggtttcaccatgttggccaggctggtcttgaactccctgcctcaagtgatccacccacctcggcttcccaaagtgctgggattacaggcatgcgccaccatgcctggcctaaactttttctataaggggcaagatagtaaatattttaggctttgaaggcaaaacggcaaaattaagcaattgttatcagcaaagggctaatagacttttttacatcttacattttaagaagtgtaaaaacccatgctcagctcacagaccatttaaaaataggcagtagtccagactcggtccatggccaatagtttgccaacccttgtcccagctgatagtgacagtgggccatgaactacagtgtgatccactgaactccctaggcctaaggtcttcattgtaaaaagcgaagagagggagggaggcagccagctgccctacactctgctgctcactgccacccccacacctgattgccagggagggcacattctaggacagtagacagtagacacacaccagggccctgggagccacgttcctaagggcctcttgctttaaaggacaaatgcatcctttccacaagggctgtctaccaggggatgtctgacatctcctatcactcaactccagccctggactagcatcttgctccataaggattatacaagacttgttcatgaacacaggactgaggccagaaatgccgaagttctgcagaaaccgacagctcttggtcactaccaagcagcctgtaagaacctaaaaacaaatggcaagcaaggcactcagcagagattgcttcttgcctacccaatagctatccctccattcttcctcagtaactgaacctcttactgaggccagcaatgcacccagctaaaacatgccttttctttttaattattttttgagacaggatcttgctctgtcacccaggctggagtacggtggcgtgatcttggctcactgcacctccgcctcctgggttcaagggattctcctgcctcagcctcccaagtagctgggattacaggtgcatgccaccacacctggctaatttttgtatttttaatagagacagggtttcaccatgttggccaggctggtcttgaactcctgacctcaggtgatccacccacctcagcctcccaaagtgctgggattaaacgtgtgagccactgtgcctggccaaaacatgcctttttgacctctcttgcacatgcaagtggacaatgagatgcaagttgaagtcacaggttagggcttccagatagctgctgaaagaggcacgctcagctgaggcacacttctgccttaccactccttccttcctcctgctgcctgaaacagggacatgatggctgcagctgcattgacaggcggtgactgggaggatggaagccacaccccatagatgtggctctgaagatggcagcaccccccgaccaagccgaacacacaccttcagacttgcgcacaaaagcaaagtaagactctcttttgtttaagtccctgttgtggagctcctggatccacagcaagccccatctggagagcccactggaaaatgagctcagccacttgccttcaaagagtggaatggagtcactggaaaaggcatccaaggcgagcaggtctttcccgtccttggacccgctgcgtttgtgcttgtgtttcctccgaaaaaaggaccggcgtgcagccgctgacagcgtctttgtggcgctattgtcatctttgacttcagacatgctgagcctcctggagaattcttggtccatcctgtggcacaggggacaatgctgggcagggccatcgagaccctgctgccctgcccttcctgcccttcctggtgagaaaagcaaaggtgggccagacactgggctccccccacactccttggcaggtctcaaggctacatctcctcccacgcccctgggaaccctcggtacatgctgcgggggtgacacaaacaccagcaccagggcaagctctcagagcaggcgattttttctactacagcatattcagctcggtgtcaaaaggaactgctaggacagccttcaattggtgacatgacgagttacgcttcctgccatagaagggaaatgatgcagggatgcaggctgcctcgaaaacatgctcagtgacaggagccagatgaaaggccacactatgcaatcccaaccacacagaagtccagacagggagacccatgggtatcaaaagtaaagtagtggctgcctagggctgagggctgggtgggaggacagtgggataaggggctgacagctaatgggtctggggtttgtttgaggtgatggaaatgctctaaaattaactgtagtggcggctgcacacacctatcaatatgttgaaaaccactgaatggtacactttgagggagcggcaaggcacgagtatctccataaatccatttttctaaaacacgttatgccttctgacccatcactgtgctctatacagcactgactcacactaggagcagctttttagaccagcacttttggcaaaatgtagagagcagaagctaagataagaagcagaatccctcctccagcagccctggccccagccccctcccatgggacagctccatggctggtggccctcggcgacccctgccccaccccaccccaggcccggagaacacttacacatatttgctgggaatctgcccgcgctggatcttctgggcattctcgtccagctgccaagccatccaggacccgaacgtgccctggggtaaggtgtcatccacgtagaggatgtcgtccttcttaaagctcaactcttgctccacatctgccagccggtcgtacagggccctggaccacagcacagaaggaacacgatcaggcggctctggccaccaaggacgaaccaggtgccttctgtggccaggcccctaaggctgccattctgctttgggctgtctccaaacttgatcaggaatcgccgagggtggtgattctcaaagtggggagccctgtgttttacataaaggggcaaagactgcctttgctcccctaacactgagggcgcatccccatcaaagaactcaccaagatctgaggccataacttccctttccaggtggcctttcccagttgcctccctcctcgaagcccaggcccggcccctggttcctacagactggaatctctctaggatggaaatatgtcatcttctaccctagagacagggagttgtaccgcatcagtgttctcatgctttctgtgatcttggatcttaggaaatgtgaagaaagctctgagctcctcctagaaagcctgctgccatccctaaatgcccacagcatttcatacagtagtaagggcactgaagatgcctggaagtccacacacactgcagagggatctgcaaacctggcttgggggacaccagaaaaagaggagcacagcacacaggaaaacggggcttgactgcctccaaattctctaggtcttaagccctaaagagggggcccagctggttctttaagccctaaagggttgttctaagtcacaatcatctcaacataaataagcgtgcagattgagtgtcaaggaatgatgatcatggccccagccttggggggcaagaaacagagagccattcaccaggaaaagagtctccagtgaaagcctctcctctggttccaaatctcccaccgattccccagccactggtacctgatgtagaagctgtcaccaggcaggcccttggccttcgtgaactcctcagggcggtactgcaccttcaggcggacgccatccctgggcttcagcatctccacatagacttcctccactgtcttgttccgcacgtccaggctgccatactgccagggatgggggtggatgcatcagaaggcagaagccagggggcagcttgggcacccgagaggggccagtgctgaccatacggcagaaattcaacatccctccttaactgagactctggctacctcccctctgcaggaaggactgagtcttcatggtctccccagtctccaggtcctgtgcatgctccctggacaccaggtcctctgccaagtggctgccctgcccttgacagcttatccaggaaaaaccctgttctggtgactggcaagtctgggcttttcagaatagggaccttcctcttgctgatgttgcctgtgcttttatttatttattttctgaaacagggtctccctctgtcacacagactgagtgcagtggtgcaatcacagctcacagtagcctatacctcttaggctcaagtgatcctcccacctcagcctccagaatagctgggacaacaggcacactccaccacacctggctaatttttttgttttgttttctgtaaagacagggtctcactatgttgcccaggccggtcttgaactcttgggctcaactaattctcccaccttggcctcctaaaattcacaggtgtgagccaccaaacccagcccaacttgtgcctttatattctcacaaaccatctcccccatgaggcaggagaccacagagaaagaccatcctctctcatcagaacagagtcctgcagctacatcacctgagggcgagcaccccctgatgcccagggcctgagccaaggctctgccctcaggttccctcaatggcctgcctggcttcacagggacctcctcagaagggcttggcaggattctgggtttacagggattaaaaatcaaccctggccaggcacagtggctcacgcctgtaatccctgtactttgggaggccgaggcgggtggatcacctgaggtcaggagtttgagaccagcctggccaacatgatgaaaccccgtctctacaaaaaatacaaaaataaattagctgggcgtgttggcgcatgcctgtaatctcagctactcaggaggctgaggcaggagaatcgcttgaacctgggaggcggaggttgtggtgagttgagattgcaccactgcactccagcctgggcaacaagggcaaaactctgtctcaaaaaaaaaaaaaaatcaatcctgaggctggacacggtagctcatgcctataatcacagcagtttggaaggccgaggcgggcagatcacttgaggtcaggagtttgagaccagcctgggcaacatggtgaaactggtctctactgaaaatataaaaattagccgggtatcgtggcacatgcctgtagtcccagctactcggaaggctgaggcaggagaatcgcttgaacctgggaagtgaaggttgcagtgagctgagattgtgccagtgcactccagcctgggcgacagagcaagactctgcctcaacaacaacaacaaaagtcagccctgactggctcaccagatgagaggctgtactcctccgtctttggtgccacctgagatggcagcaagcccactgtgcaggtagatggaggcctggcctgctcagcagctcagaactcacctccaggatgaggtcccctggcacgaggccgtcaggacccttggcaggactgtcatcctccacctcggccacaaacaccccatgcaggttcccaccacacaagtgcaccccaagctccagctgggactttttgatgaagacaacgcgtggctccagggtcttcttgttggcatctcccgcaatcctttcaggaaaaaaacaaagttcctcaactgtgcacaaagaggaggcacaaaaagacaaagcagtggccaatgccctaaccgctttctgcctgcttcttggggtctcagaaccacagggagctgagaggtggcctctagttctactggctcggcgttcgggacaggatgctaaggtgcactggagatgaaggcaagaccccaggtccaaagccagttagcgggggcagtcaaaaccgtaaatcagtgcccctgctcccaggcccggctatcaatctcatgccttaaagatcaggatggcctccctcccatgtggatcacactcattttcctaacttagtacttcctaaggaaaggtaaagttggcctcactgtccagagcacagcaatgtattcagcaaatgtctacgaagaagcttctatagaccagcaactgctaacttgtgaagaggggccccttgccatcaaggcacttacaatcaaggaagggaagctgaaagtaagctgctgaacacatggagggagtgagatgggacagcgatggaaacagatacagggggcttcaggggagatgccagcccgggaggaaaaccttgcagcaggtaagttccaatgtgacagactctggtatagagaatgcagagctggcctcattctgtgagatgctgcccagggcttggtgaaggcctctcagtgctggagacacagctcctccaggacggcagagtgatcatgtcacaccatggcctggatggccctccctgcagccccaggccaggctggacgctgtgcagctcccatggagctccttcctcctcctgaactctgctgctccctcggcctggacttctctttatgcccactcttggctcttgcctgtcctgaacattttaatccagctgccacctcccctgccacactccagtgatcttcctgcctgctctgcggcggccggcagtgccctcccagcaccctgactctgctgcacgtgcccggcactggtctgccacctcattgggggaagcactgctgtgggtggccagagcccagggcctggccgggtgatgactgtgggaatgtgtccaaagacagactcagaaagcgagtgaacaagaaaaggagaagagaaagagaagatgcaggggaaaaaacaagtcaatagaaaacaggagaaaaagagaaaggaaaagagagagtagggaaggaaaaaaggaatgccgtgctcccggcccaactcctgaagacctggtgtgcggcctgcagcacatgaggccagctgcccagtgcccacgccacttggagaatgtgctcagccccacccagccgaagcggacacagggaaggctcacagcaacgtctgctgacctggagctgctctgcttggctgggggggtgctaggcccctcgtcctgctccatcagtgggtcgatgacagatggatgctccggggtggtggtgccactgccctggagagtggagtgggtaccggcagggtccaggtgtgagctggaggcggaggacaggagggataaggagcagtacgaagccacccagagccacccccactcctgtggcaactagatctgagctataaatggggaccaggtcacatagccctgcaccctgtgccctgagcagagcagacacattagaagcctggacccatgacatccacctgtcctctcccctccacctgtcctcagctcaggggccctctccaaaggcatctgacctcaggaagctgtgagcatcctgtctcttttcctctgcctgtgcatcccatctctcctgctgagcttgtggcgcagcactgcagggcatgcctccccttcttttctgcccttcaacccacagctcaggggcagatacagacaggtgtacagcatctgctcctggacagggagccaaacactttgagtgagaatccacccccggggccacaactcctggctaccatgggcccctgctggtcagggggaccacagccatctgtttccacaccccatttcaggaggagacagcctctctatatatgccccttttccaaaatccagggctggtcaactctctctttagcagcagtaggatccccagaacttacggctggcaccctgggtctccctaaaatgagcagagtgctgctgcacccacctctccacccccagcccagacggccctgggaggcccgcactcacctggaccgggagtggctgctgagctggtgcacgtgggggttgtactgggccaggatggtgatggtatcacactgctgcccgatgatgagccgcgcctgctgctccgtggcgctccgcaggtttatgccgttgaactggggaaacaccaggatgggctcagtgggggggtcggggctgtggacagggaggaggccctggggacttgggagcactgctgttccctaggaggaggagagggggaagaagtgcaggtttccatgggcgccatgcaggagggcagctccctctcacctccagtaactgatccccatactcgaggccagcctggtgagcgatgctccccacggtcaccttggagacgtagatgccgcccttctctccactcacgatggagatgcccagcggctctgagcccttctgcaccttcacgtggcgtggctcctccacataaggcctaaggaaaagtcaaaagtttcggggactcagggtcaaacaaaagggttggggagagcctgagctctctgatcaggcatatgatctgacagtgcagaaagggccccgagcctggatgctcccattgtgacacagctacatggggacatggtgggcccacccctgtgtgacaaacgatcacattcccacagcctcacgcaacacgagcacagcacacgcagacacgcaaccacccaggccaaagacacagagaacggtccgtgtgaactataaacactgatacatgtggattttcattacaggagaggagctgccccacaatatgcaattacaaactctggggggtcttgagatgccctccgaggaaaagagatggctcctgggatgacattccatcctaagggggcaacagaaaataatccagttttatgtttactggctacacagagtgatgcaaactggtcacggaaattaagctgctgcagacccaagcctttgtaaagggagaaggctgggagcaaggctgcagccatgcacttgctgccctggggctgtacagtgcacccaagggcgccggggcaggggctcggcagggagcctctgggcaggccaactgcatggtggaagacctgggcctggtggccacgggcagcctcagaagagatctgtggtggcagagacatctggaaggtgacaaaggttagaaagaagataagggacgctcagaggagaaagacaatcagagacacctggaacataacagaaaagacagtcaagtgatgcggagcctcccgttgggacttcacgccactcagggcttcattcctccaaggtatggacacctgagattttcctcgcaggataaaaccatatagccaaaggctgagggggccagtccaggtcccctctacagcacatggtcaggatagattctagcggggaggcacctaaaccaccccaccccggccacctggaggcagagcagcttcccacttggcagtctcagcctgtggccctatgccccagccctcttgggaaggggaaattaaaattcttcttgagttgtccctgctctctcccaccctccaaagtgttcccacttcccaaacttgcccactctggaaatcctcccttgaccctccagctcagacagatccaccccagactacacccacggtcccttccaattcaacacggattacagccccgtgctgttgagagctgcagagccctcagcacacagccacccctacatcaccctcctgccccagccttagatgatgaaacagaggcccagagcagaaagaggtccacctccgtacaacacgtgtatcacaataaaggagcaagcaactaagtcacagcaatagccacccaatagaacaatgatctgaaccaggttcccaggttccagtgacatgcaaagacgtaagggacacaccacggggtggggaggcccgatcggcatcatttcacttatatttatctgcatctgcaaacaaaagtatgtgtggatttatgcacaaggaggcttcttatgtaggacattaccaagtgttaacaatggtgtctccagttgaggggatctgagctaatcttttttttctttctttttttttggaggcagattcttgctctgtcacccagggtggagtgcagtggcatgatctcagcttgctgcaattccacctcctgggttccaatgattctcctgcctcagcctctcaagtagctgggattacaggtgtacaccatcacgcccagctaatttttgtatttttagtagagacagggtttcaccatgttggccaggctggtctcgaacccctgacctcaggtgatatgcccgtctcagccacccaaagtgctgggattacaggcataggctaccgcgcccagccagagataatctttactttatagtcttctgaatgatttgaattgtttgtaatatgcatagaagttttctctaaacaacagctgcttctcaaaagaggtttataaagtatacttaaactattaaaaatagctaaaaacataatattaagggagatttgattatgtacataaataataaagcatgtttatatatatatatatatatatatatatatatatatatatatatatccaaagggtaatggcaattgaatctcttgttgaagaaataatctgtgacttttttcttctttctacttttctgttttttattttttgagacagagtctcgctctgtcacccaggctggagtgcagtggcgcaatctcagctcactgcaacctccgcctcccgggttcaagcaattctcctgcctcagcctcctgagtagcagggactacaggtgcctgccaccgtgcctggctaatttttgtatttttagtagagacggggtttcaccatgttggccaggttggtcttgaactcctgacctccagtgatccacctgcctcggcctccttacaggtgtgaaccacagcactcggccttctttctacttttctatgtctctgattttccataacaagtataaaatactgtacttcagaatctgggaaacggggccatttttaaaaagaaagctgttgctcagtcaggtcacacatgtcaaatttcatctccaatcggatcctaaccaccgtgagggcaggagtcactcacatttttctccctcctggagcaggtcctggctctccgtgccctgtggggagctaagggaatgcttggcagtgggtggcaaggccttttccacaactgaagaacccacttcacttggggaaggtcccgtcctctctgtggccagggccggggctgagtaaaacaggccagcatgctcctgcgcgtgccacatggtaagagctccgtcagcatttcttccgagttacacccgattcccctactggggccaggcctctgtgttttgctgtccttccgttacccctcaggttctctggttggttgccttttaagttcagattttcaagtcaaatataagattttctctggctgggcacggtggctcacgtctgtaatcccaacactgtgggaggccgaggcgggtggatcacctgaggtcaggagttcaagataagcttgaccaacatggtgaaaccctatctctactaaaaatacaaaaattagccaggcgtggtggtgggcgcctgtaatctcagctactcaggaggctgaggcacaagaatcgccttgaacttgggaggcagagattgcagtgagccaagattgcaccactgtactccagcctgggcgaaaagagcaaaactctgtctcaaaaaaaaatatgttttcttaacatagggcccacccctgctgaggctcacagctacagaggcctcagctttctggactcaaatgaaagagagtatctgtgtttcttttggtgattaaataaaagtaagtttatcagagctctttaagatctacaatctagacagaagctgttaaatataaacacaatctagtaagttccatctaggggaacaacagagagggatgtgtgtgcacagtgcgcgggggtgacggattccatggaggaggtgcctctggacagacagcaagcctacagtcaacctgaaacctaagatggacctacattctaaaatgaaccagtaccagtaaaaagctaggctgcacatttatgctttcttcctgtgtatattttatttcacaacagaaagcttcgaatgagagggaaaaagcaaagggtaagaatgagtcccggtgccagccactaaccacgtggccacaggtctgtcactccaacgtctggatccagtttcctcaactgtgaaacagggataacaataataacgacactggcagggtccctgtaaggatctcgtgacttagccacacgtaaagtgcttgaacaagggcccaggaaggtgtaaatggtgccatgatggcacgatcaccgtcaggtcatttccagcatcatctactgtgagccctcttggctccctgccttgccatccacacacgccccacctccctgcatccagtgccccatggcacttactggtgacaccagcaaatgctgggacactcaagctactcctgctgcttctactaagccccttccctgcagagcccaggcccgctgccgggatgcacactgtccactggtttacccactccaccgatgaccggccatgctcacctgtcctttctccgctccccgagggacgcggggttgacagcgattctgggcaatgtggaggctgaggtctgggactggctacaagaggacagggtgtcgatgttcaggggtgactgtggaggagtgctgcattcagaatgtgacactgaacctgcagagaggagcgggtaatgccggtgtgaactcccatctcacttccccaacagccaagaccaagaggcaggtgcgatccagacacacagctctatccccactgcatcgcatagtctggagctcagatgctaggctctgcattgccccctaccccccacaccaccaggcctactgctgggctcagtgaatttttactgactgactgagatgactatgaagttctcagctaagcccagagactccaccatgaggagtcagaccgcaggaaaagcaggagagatgggaatgtcgagaagtccttacctctctcggagcccacgacactccgcggatatcttggtgttgatgggattttaatgcgttccgccttgaactgcaagttactcgaagaacctattgttccataagggaacaaaacttcaggcctcatggttaaacaccaccctgtccttcctctccaccaggctaccagtcaggataataaatgcaaagctgggccctgctgtttattcccaagggagccttgatatggaacagtcaagaaaagcagacgtttaacatttatctcaatgaactgtgcaggcccagactgctccagaacaggagcgcacaagtctcacttccagccacggaacagcagcctaagagacacggcagctgctccatcttttctccccagcgccagagttccccaagatctccatgggctacctttgtccgactctcctctggggttcactttccatacaaaaatgtatgaagagccatacaaaacagtccagaatgaggccaacaacctcagggacacagagcaaggctcctagctgaggggtcacctgaatgaccataaggcccccacagaaagcggaaggcgaaagcaatggctctgacagcagcatgggcatggctggcccatgaaggaagcagcccttcccagtagagaaatgagctcagtcccaggaggtgacaggagctcgtgtggggagcccacccgcagatctggacattaggatgcaggcagagatgaaaagcttggcaccctctgcagcacaaagtccaagtggtgcagttacccaggcgggcgctggagggcagtgagttggacccatgggtggctctcatctcggagtagtcgctgcaggtcctgtggctcaggtccaggctcaggcgtccctggtgctggacactgcgtaaaaacaagaggtgaggagttcgggaggagaaccaggaacagatgtggccactggggagaaacacacagaccaggcaagggttcccaagcgggcagaagggaggcccaggagccactgattatcagccgaggatagcaggctgccctcagccactcccggaggtggcatccactaagagccttcaggaagtagaaagggccacacacatggggcggtcagtatcatacccactccagccatagggtcaggattaggctcactaggaagaagtgataaaaaacagaggttttgcaacctgggtgggcctggggagggggaacctgtcctcccaggaagtgggtaaggagagacaaggcacagaggactttggggaggggacctatgtgcctcactcgggacagcgtgcctaagaaaatgaagggcagagcagggatcgcccacatcaggctgccctgagaccaggcctcaacagcatctttttccagctatgtaatgaggtgacatctcttccctgcttaaactctacagtggtctccactgtccttagaataaaatccaaactcttcatcaccgctgcaggtcccacagggtttgtgccctgtgacctcaaacctcttcttgactcgctgcccctttgacaagctcccacgactgtgcctgggtgccctggccttggcaccgatggcccttctccctggaggctccagcccaggtcttgtgcagctggcctctttcatccttctggtcacagcagcatcccctctgccacagggcccttcctgaccacccactctaacttgccaccctcttccaagttacagcccagcctgtcaccctgtttgactgccttcatagcctcttggcaccatctgatatcacttcgttcattttttttttttgtctgcctcccacatttgaaaaaccacacgacatgagctagaagctaatttgtttagttcagcaatgtatcctcttataattaggatagaccaaggcatgtagtaggtgctcaaaaaatatctgtcaaatgaatgaataagagtggcttggagccagcccaccctcttatgaagtaccagtttcctcatcttcaagacagaaacagtaataggacttagcccatgaggttgctgttgattcggtgaaatgatattcataaaggtctgagcacagtggctgggacataagcactcaaacatcagctgctatcactatcgtgtccttccagtaccttttgaaaccttgtgctgatgaattcagaaagcagccctaaggctccctttccctgtgctgctctagccagtcccctcccaggcaggcaaggaagcttctccaccaatgagcctctttatgcactcatggttccatgtccaggcaggcttgggcagctggagtacagagaagcgtagggtgccttcacatacctgggatgcaaaccctgggggccagcatctcgggccgcaggtggagagctgcaggggccgaccctgtgactgcgcacagtgtagatggggttccgcaggatggagctcacagtggtgctgggggtcaaactccggggaacagtgcctagaaatgggcttggtgagaaaagacgccccaaaggacccagccagcccaggacttacacaagcctttcccctgtatcccaggacgcagccgcagtcttttgggaaaaggacttgggagatgagttttaaccaccaattcacaatgtggctgtggctcctggcctgtctccatttgtaaaaaggggggaagtctctttcatgcttcctatttcccaggttgctatggggagaaagcatgttgacaagctaagacatgtcatggctataagacaaaccatcccagacaggacagcatttcccagttctctggacctcagggctgaaaacacatggcagctctctgaaatgctgcctcccctctccctggagactaggcatcccgagtttacaccgaccctcagccccagcccctggctggctgactcacccacagacggcctgctagggtatagcggggggttgctgtgccggctggaatgcccaggcgagtaaggtgcccactcctggagctccggggagagttctccactggccgggacacacttctgttcctgcagatgcaagggcaagagtgtctgctagaaagagtggagtgtggccaggcgcagtggctcacacctataatcccagcactctgggaggccgaggcgggcagatcacctaaggtcaggagttcaagaccaccctggccaacatggcgaaatcccgtctctaccaaaaatacaaaaattagctgggcatggtagtgggtgcctgtaatcccagctacttgggaggctgaggcaggagaatcgcttgaactcgggaggcagaagttgcagtgagccaagactgcaccactgtactccagcctgggtgacagagtgagactccatcttaggggaaaaaaaaaaaaaaaaccaaacagtggaacgcttgagcagctctgcaagccagtttctgccccccaggaaccagctcctcccactggggcacaggaagggacatgaatgggaacgctgcccattcatgttgccttacacatcttcaaggaagcagctttacttcagaagaaaaccacagagaatgaatctttcacagagatcacgtaaaaggtgagaatgcacaagtgcatcaggcacgtacaactctgcccgatgtggagggctgtgcgaagctctttgtccccagtgagcagtgtggactggtgcctgagatgctttccacagtccccagcaatctcacccttctggaaactatgacagcacacgcaatcaggccgtcccgctgcccactcagcctcacacgtgccacctcatctccctagcccttcaaggcaagtctatgccctaggttttattgtgtaagttcaaaagcttcttattaaaaaagcaaaccaaatgctatgcccaataaagtgttcccctcttgtgtcacactcccactaccatgcacttccacgccacttacctacctcctagctgggccacttcccacttgagtccaacagcaaaggcaaaggcaccaggctaaacaggggcctgggacactggtgcagggccacttagcagccctccttcggccaactgcccctctctaggcctcccctccccacaccctggggctcagctatacctccaggaactgagcaggaatcactactggagcaagcttcggccgaaaactgggagcagattttggccggcgacgcttctgccccagctcatccaccttctgggaggtgaggtcctcatcacaggatttcttggccggcaggtgggaggagtccccatctccttcagggtagtagctggaagcaatgcggaccctggccttgcgagggggtgatgcgtgcatgggctccccggggtccacgtcagggggcagggcgctcgggggactagtggatggggagctgcccaccagagtggcttctgactcggagctagtctccagcctgtgctggaacttaatggagtcgctccttctgggaggttttgggggtgtcagaggccccgccctcttggagggctggggagagtgagcaggcccaggacctggaagcaggtagtctattttggggggtgtctgggggcgtttgaaagtgttagggtcaaagatggactttctttgctttggctttttataaacagagagcttctcaggcactgccgtggagctgagcatggccttgggccaggtcccgccgctgttggagccttcagagtctgccttgtccagggaggcctccccaaccccacaggggcccacctcggtctcaaagggcagcagtggccgccggccacgcacgtccaccagcccaaagccacggtccccagaggcatctgagcggaaggagctcaggctacgctcagaggcactgggacaggcctgggggcagacctgcaagggtcccccagggaatggcttatgcagaaaggagctgctgcctcctggggggcctggctccttcctgtcttccagcctgtccgtgtagaagatgtctgtctgcgtggagttattgtgctgtatcaagttccgtttgttatgagcctggacctccgggccatgggctcgaaaactcagcatcttatcagagtctttgatattttcaaaaatgttctggccactccacgaggagctctgagggaatacctaggcagggattgcagaggagtgagagagagagtgagatggcaggacttggagctgccactgaaaaccatccccagaggtaaagcaatggtcaggaatgggccacctgccccttaaaaaagagacagatagacagagatgcacacacacatgaacacatatgcttctccctaatggataagttttctcatggctctggtcactctgaactcaaagaagagtcaaagttttcttaactttgaacactttctgaaattatctgggccgggcacagtggctcatgcctgtaatcccagcgctttggtaggctgaggcaggcgggtcacgaggtcaggagttcgagaccagcctgaccgatatggtgaaaccccatctatacaaaaattacaaaaataagccaggcacggtggcatgcacctgtagtcccagctacttgggaggctgaggcaggagaatcgcttgaacccggaggtggaggttgcagtgaactaagatcacgccactgcactccagtctgggcgacacaatgagactctgtctcaaaaagaaggaaattacctgcataatgtcttgaatattttttttaaatattaaacataaaagtaaaaattcattgttaaaaatatatctcttgtggtacacccagacaacggaatataaattagcactaaaaagaactgaaacaacgtgcaggaaccttaagtgtatattagcaaatgaagaagccattctatacactctgtgattccaactctatggcattctggaaaacacaaaagcatggaggcagtaaaaggatcagttgttgccaggggcttgcataaatatggggagcatagggaatttttagagcagtgaaactactctgtatgatattacaatggtagtacatgtcatcacctgcatcaaaactcacagaaaatacaccaagactgaaccttaatgtaaactatgcattatagttaatactaatgcatccacattggctcactaattataacgcatgtactaactacactaacgcaaaatgccaaaattggggaaacttggggacaggagtggggatggtggtgatggggtggttgagagagtgctaagaattctgtatcagcccaacttttctgtaaacataaaactgcttccaaaaaagtcaaataatttgaaaatagttaatttagaaaacatctcttaatagaaagttagaaaaaataggcccagccatttcattaagagatgttttctaaattcggcctattttttctaacttcctattattaaacttttcaaatatgtagaaaagtataataaatgtccataaatgtaccatctagattcaaaaatatttcactaaattgtctttttgtctataatgatactacagaacactggaaagcaagttacaaatatcatgacatgtcacttcccttcctttttttttttttttttgagacagaggttcgctcttattgcccaggctggagtgcaaaggcgtgatctcagctcactgcaacctccgcctcctgggttcaagcgattctcctgcctcagtctcctgagtagctgggattacaggaatgcaccatcacatccggctatttttgtatttttagtagagacggggtttctccatgttggtcaaggctggtctcgaactcccgacctcaggtgatccacccgcctcccaaagtgctgggattacaggcatgagccattgcacccagcttcttcctttcatttttgagatagggtctcactttgtcacccaggctggagtgcagtggcacaatcacaactcactgccacctcgacctcccaggctttttgtattttctgtagaggcaaggtctcgctgtgttgctgggctcaagtgattcgactgccttggcctcccaaagtgttggggttacaggcatgagcaaccatgcccggccatgacacatcacttctaacaactttagcttgtacctcccccaaataaagccattctcctgtataacaaccccaatgccatcatcatacctaggaaaactggcaacaattccctaagatcatctaattatcgggtccagattcaaatgtacccaactgtgcccaacatggccttgactgctgttttttgatttcagaccagcgtccagtcagggttcctgccccctctgcactcagtaaatgcccaccctgttctcaaggatcctgtgaccccaaggagtagcatggctatgtggagccggggctctgcccatactcctgaccgtgagagcagagccaggtccagcccttaccttcaggagggacagggtcagggagtcctggcagctgcgcagcagagattcacattcattcagagacttgttgtccagtgcaatgccattgatctagagcaggacagagagcatgtcaggccacaggcagagcggcctcaggcctaccagtcaggatctctgcctacctaacctcctgtgctagacagtcaccaaatgcaaggtgccaaagtcaggagttggcaaaggatagaggtctttctggtgaggcccaaggagtccaactaaggggattctgaggtagaggaacacataagccttcacagcaggctaggggaggagcatgtccttctgggatcagaacaccgaggacccggagggaacatcttggcactgctgtgcccggccatgtggcgtgggaccttggctcagaacttcccagctccttgcctccacagaggaaatggaagataaatacatgcatgtggctcgggagagcgggggactaaaaacaagaccatggataggaaaggccttgtagagaaagtaccacgcgaagtggggccctgtgagtgttcacaaagaacctctcaaccctgctcccggaatctctgctcacagctatgtgcagaccttcttaagaagtatatgtgcaaccggtgaatgaccaaactgtgatacacccacattgcagaacactgctcagcaacgataagtaacaagcagccagcacacgcagcctcttgggtggatcttgcaggcatggtgcggaatcaaaacagcccagctccaaaggtcacatactatatgattccatgtctgtaacattctcaaaaggacaacatcacagagatggagaaaaaatcagctgccagggggcagggatgggagggagcagggggtgttactacaaatgggcagtgggagggagacctcagtgctgatagaacagctacgtatcttcattacggtggtggttacacagaacaacatgtgtttaaccacacacaaccacacacacacacacacacacacacacacacacacacacacagtaccaatgtcaatatgctagctttgatattatactcatgcaaggtgcaaccatgaggggaagcagggagaagagtacataggacccccctgtactatctctgcagcttcctatgaatctataatcatttcaaagtcaagttttcttttttttttttgagatggagtctcgctctgtccctcaggctgaagtgcagaggcatgatctcggctcgctgcaacctccgcctcccaggttcaagcaattctcctatctcagtctcccgagtagctgggattacagatgtatgcctccatgcccggctaatatttttgtattttagtagagatggggtttcattgtgttgcccaggctggtctcgaacccctgaactaaggcaatccacccgcctcggcctcccaaagtgctaggattacaggcgtgagccaccatgcccggccagtcaagttttctttttaaaatatctgcagagtgattatctggaagtagtaaattaatttgtggttttttccttataacatatccacatttaaaaaattttcatagtggccatatagcttttacactctggctccccaaaaaatctgaaaaacattggcaaagatgtgaggcaatgagttcccccacacactgcagggaggactgcaaaagccatgacctttttggagcaaagggggaagatctcgctggatgttaaacattcatgtcctctgacccagcaaaccccacccccaggaatgtaccccagggcacactcctgggtccctatgaagtagcatgtcagtggccatgcagcacgacacagatgtaagtaagggcagagatgcccagactatccctcgggagggactggtcaacaacttaggctgctgccactaaggaatgacacgcagttatatgccttggggcagatctaaagacgtgaatgtgggctgggcatggtggctcacacctgtaatcctagcacttcgggaggctgagggcagatcgtttgaggtcaggagttcaagaccagcctgggcaacatggtgaaacccccatctctactaaaaatacaaaaaaactagcagggcgtgatggcacatgtctgtaatcccagctgctcaggtggctgaggcaggagaatcacttagacctgggaggcagaggctgcagtgagccaagatcacgccactgcactccagcctgggcaacagagtgaggctatctcaaacaaaaataaaaacaaaaagacatgctgctaaaatctggctgggcgtggtggctcacatctgtaatcccagcactttgagaggccaaggcaggtggatcacctgacgtcaggagctcgagaccaggctggccaaaatggcgaaaccccgtctctactaaaagtacaaaaattagctgggtgtggtggcgcatgcctgtaatctcagctacttgggaggctgaagcaggatagttacttgaacctgggaggcggaggctacagtgagcccagatcacaccattgtactccagcctgggcaacagagtgatactccatcttaaaaaataataataaaaacaaaaacaaaaagcaagatgagcaactgagtatattataatcccatccaggttacctcaaccccccaaaaatgtgtgagatgtacatgttttgaaagtgtctgggacataatataataaattgttaacagtgattgccatcggggtgggaagcagtacacaagaggtctagccagaggaagatttgttgtcacgatttgccttttgtactactggaattttgtatgtatgccatgaaaaagtgtatggcattttcagtttttgttttttatttattagagacaggagtcttgctctgtcacccaggctagagtgcagtggcgcgatctcggctcactgcaacctctgcctcccaggttcaagtgattctcctgcctcagcctcccgagtagctgggattacaggcacccaccaccaagcccggctaatttttgtatttttagtaaagacagggtttcaccacgttccccaggctggtctcgaactccctacctcaggtgatccacccacctcggcctcccaaagtgccatgattacgggcgtgagccaccgtgccccgctggcattttcaattttaaaaggtcagaagtattaaatttgcatgtcctatgactcagcaatctcacggcatttgtagcttagtctcagagataccattacatgtctccagaggctctgtgcacacaggtaaagttcaatgcaggactgtttgcaattgcagaccctgaaaacaacttctatgtccatcaataggtggataatttaaactacatataatcaaacaacagaataccataaggtgggtaacattagccaggctacacttggaaagatatccaaggtaggatgcgaattgcagatcccattactgtacataaataagcaaaacaacaccaagaaatctatctaggtatatatagatttgtaggggcacatatggtttgggctgagtgcttatcttctaaatgggggcagggacaatctctaggagcaggattaaagggggaagaaagggactgccacttttcactttacatatttttatattgcttggctgttttacaacaaacaggacttactttggtaacaaaaaaatttaaaaataagtattacatttagttaaaaaaaaaggggtggcatttaaaagtcacaacacaatgatgtcaatttttttaattgtccttgataaacattcatgagaatgttaaatgtagagaactacatttaaaatgttaataaagctgggtgctgtggatcatgcctgtaatcccagaactttgggaagccaaggcgggcagatcacctgaggtcaggagttcaagaccagcctggccaacatggtgaaaccccatctctactaaaagtacaaaaattagccaggcatggtggtgcacaccctgtaatcccaactactcaggaggctgaggcagcagaatcacttgaacacgaaagtcagaggttgcagtgagccgggattgcgccactgcgttctaacctgggtgacagagcaagactccatatcaaaaaaaaaaaaaaaaaaaaaaaagttaatagaggttatctacaggtggtaccaaagcaagtggttcttatttcccgcttaggcctttggaggttgcagtgagctgggattgcgtcactgcactccagcctgagggacagagagagatagagaaaggttatctacaggtggtagcaatgcaattgattcttatttccctcccagaccttttatttcctaattttctacagtaaatagaaacataccatcaagaaacctatttttaaatgttcacatagtacaatgcccacaacaaggaaaatataaaaactttgctcattacttcttgctcaaacctcccaaatgtaatctgcctatgcacggcagatgaccctggctccagccttgagacttaccgcaacgatcctgtctcccacagcaagggacccttctttagcggcagggcttccaggcagcacagcggcagcatacactccattctccagactgatgccactgtctgcaagccacaggaggtcactgggtagcccctggcctcgctgcccagccctgggtcaccctacctcatctttgttaccatcttcttacaaaagaggatgtcagcaggctgcgccctgtctacgcctgcaccctgccccagtcccaccaatcgggggctcagttacatctaccctggtgaatcaaacactcagaaagcaagactcagggcccagaccacctcttgccagaaaagcacatgggctacatttaaatggcattggcccctcatccctgtgaatgaggtgctctaaggggcacccccggcccctgtccacaaaaaagggccccagccacctgaggcactctgccatgttcacaggcccgctacctttctgtccactgaggttgatgtgcagcggcgtgaccaccttcccacccagggacttcctccgccgcacgaccatgttgatggccccctccccattgaggagcgccttgatggcctgcttcttgtccttgttgatgaggtccacatcgttgattctcagcagccagtcattgaccctgagaaagggcacagccagttcagcacccacacaggctgtgggaccagcggctaccgcccacaactctcactcagggggctgactgccaaggagtgggtgcctcacatacacgctcagaaaatctcctcttgcaggagtgcacagtggtgaaatttgcaaatgctgaggttagacagcctgggttcaaatcctggccctaccacttactagttgtatgacctagcccctccaggcctcagcgtcttcatatgtaaaatgggggcaataatcacgcctaccttgtaggattgtaaagattaatcaattaatttctataaagtgcttaaaccagtactcagcaaatagcactgtaatagtgttagctattttatcatcatgactatttccctgaatgagcatgccatgtacatcctgggctctcacgcataccccttgagcactttcccacccaaaggagcaaaagacagtacctggtaactaaagaataatcagattcagaggcaactgagaagcactgtttctttcggagcattattagctgctgagactgcaggccttggacagactgtgtgtgagtctaaggctgggaaacgttcacctaagtgctacctggctctcttcgggtcctctgcactgggaagaagggccccaccttgcctccagagcctgggcctcaactcttaccttaagcggccatcagcaatgcttcctttgtccactttagtgacaaatatgccacagtcccccgggaaacaaggctcattcacaccttctgccatatcaaaccccagtgccttcaagtcaatatcctcctgcaaaaacagcagcaacagcaacgcatttcacaaagcagtgacagagacatttggctcttaagccccgaagctgcccactccaatgtgggggactgtcccttcacctcatctgataagacactccatccccaggatggaaacctatgagtatctgcaacctgccccttctggccactgcagacagacatccctgtcagcgtcctccgaggaccctgcccttccccagctgcaacccagcctggacagctgctgggaaaggatgcctcacactcctgggaggaaaaggagaacctccaaacttggagtggtgaaactgggagatactgcaagcgggtcaccgtctcctccttcatccatcagagaaggagagaagaaccatcagaggcagcttaccgtctccctctcgaactctacaacttccgtttcccactccatggaatccgtgtcaatggccgagtcgtgggagctgtgggccatcagctgtcggaaccgggcctccttttccaactgggattccatctgttccctgtgaacagagagagccacggtgacagccccttgggaggtgaaacatcccaccgcgtaacggctctgaacctcacgaggcaggccatttgaaacagctaaaatgggttcctttcccccttgtttcccaataactcagagtcaggtcaaggctgctgggatatctgtgagttttcacagtggttttttaaaaaagacaaattctccccaaatttatctagaggtttaacacaattaaaatcaaaatgccagctgggcacagtggttcatgcctgtaatcccagcactttgggaggccgagacaggcagatcaccagaagtcaggagtttgagaccagcctgaccgacatggtgaaacctcgtctctactaaaaatacaaaaattagccgggcgtggtggcatgtgcctgtaacctcggctactcaggaggcaggagaattacttgaatcagggaggcagaggttgcagggagtggaggtcacaccgctgcactccagcctggcgacagagtgaaactccatctcaaaaaaaaaataaaatttaatttaaaaaataaaatcaaaatgccaacaagatttttgtagatatagacggctattctaaaatgtatacaaaaaggcatcagaatcactaaaactattttgaaaatgactaaagtgggaggaaactctctacccaatttaagacttagtatacagctacagcaatcaagactgtgtgctgctgtcagggagacagacacacaggtctgtagaacagaataaggaacctaggaatgccccaagtcaccaaaggtgcataagttaacagaggaaggacagcctccaactaatgatgctggagcgactgcacatccatggccaaagaaatgtatctcaacctaaaccacttaacctcggataaaagttaacgccaactatatcacaaattgaaatgcaaactgacagaagcagcaacagaaataccacttaaatagttatattaggatgaagatgtagttcttaacatttcctttaatgccattgttacaattttaaaaaatgttcactgatggccggatgcggaggctcacgcctgtaatcccagcacttcaggaggcagaggtaagtggatcacttgaggtcaggggttcaagaccagcctggccaacatggtaaaaccccgtctctaccaaaaatacaaaaattagccaggtgtggtaacatgcacctgtaatcccagctactcaggaggctgaggtacaagaatcacctgaacccaggaagcagaggttgcagtaagcaaagactataccactgcactctagcctgggcatctcaaaaaaaaaaatttgatagatttgacttcatcaaaattataaatattagctcagagaaagacctagtaatgaagatgtgaaagagagactcagaagcctcgttatatcctcaggtgacttgcctgtgacacccttcctgaaatctgggcccaggctgccttgccagctcatgaacactgcccactgggctcctgacctacttgtgtttcctgctccagcagacaggccccagggccgcacctttgcctaggctgtgctctcaccagccagctctagaatgccactcagcctccagggcagagctccaatgccttccaacactgccccagcccctccccaggccagtgcagctgagctcagcattcattgctcactatacctgtctcatctggcattaccagggagtgcctgaggcttcccaggcagcaacacagaccccctcaccagcatcctgccagttagagaacttagcagacaggaggcacaaatgcaaacatgctgaatgaacacacaagctgaatgcacaagcttcaggcaactctggcccaaacaagaggcaaaatgtcccatgttcacggccagagattctaggctttcccttcgaagagaaccccttgattccatcacattgctagacccaagatggttcctgtgaagagtcttgccttgcctcttaacccctataatattcctgagagcacccaagctccagagagtctgggtttttatagaataaatggagctctttgtctcattaggaattttactgaatgggaaagaagagaagctgtcactcccttctgacgggcagcacttgagtgtgcaaggcttgcacacttgcactcacacacgagcttctcactgccccctcaccacactaacagctagggaaatgtcgcacaatggatggagagccactgctttcctactagatttgggttttagaccacggcctattgggctctgccaatttctatgcttaaaccctgatctttgtatttcaatgcactactaaaggccactgagtgtttaaatgacaccctgggaggctgctgtaatcgaggggaggatgtctgacaccccaaatggtcttccaaatggacgtccaaataacacaagcagaacagactgctggatgggggttgcaattgcctttaaaactctaatcacaatctgtcgtcatcttactcatttacgtacttgtctcttagatggacctgaccttggtctgtgtctcttcctgcgcactgtgagcccatgaggaaagggacttggtatgcttgtcagtgccatttctccagtgcctctaatggaggctggcccatacagagcaggtacttaaaaaatctctgcgagtgagtgagtgagtgagtgagtgagtgagtaggggaatgaatgaatggataacacatgcatgcctgccccagatggactgcttgggaacagggtcctcccttcctagtgccttggcacatggtgcctgccctgtgtctaagaatttttggcctaagaatttctaattaaccctacatggagatgacattcgaacccattctacacactgacagagtaaggcagagtgaagtgaagggacaaacagccagctcgacgcagaaggatgaggccctggccaatgcactcagcattgccttgcccagaagggagaggggccccaggctcccagatgcatgcccactccagcgggtgcccacccgagcctacttgagctccttcagctcgcggctgacatcattcttctgcttgcgggtgtcatccaggctgcgcagggcctcagccagctcgctcaccgcacggtcccgctcccgcctcaggttgtcacacagtgtcctggtggaaggagcagaggacaaggtcatctcaagaggcatggggaagggggttcctggtctgcagcggatggtctggccacctcactccaaatacctgccggcacctatcccatccccagatgcacaggaacacttgggaatctaggggtaagaccacctaggccagccccagtgcatgacagagggaatgtggaggacctgggcagggaagagacacccccacagtcacccggcaacaagtgtcaggttcccaatgccctgtttcaccctcaatgtgcctggggttaaggaccaccctctgcacacactcactgttctaatgccaacttggggagccagggggtggctctcctctgcatgaagcaccccccacctgcctggcaggcctgtgctccagcactaccacatgtctcatatctacccacaggcagagctttctagagctgtccctgtaccctgcaactaggaagggagccccttcggataccagccagtcctcatgcatctctgtctctattagctctgtgcaggtgcaaagtacaagcttggcaagactctatgaaagaggaccccaaggaggtggaaacagattacctggctgtggaggggcctgggctctgtgccacctccagaaatggacatacccagaggactggttcctacctctccacagcctcgaatctcccccagcctcagtcagagcctggctgaggactgccccctggagacacccgtggaaggggtctgagcagaagcagacaggaagcagcccctgggcctccctccccttgcactgggcacctaactgtgctctccattagcagggcctcaccacctagccatcctcatctcctgaccagcccctagagacattggtctctcccctgacaaaccacaagaaatcttttggacacctcccaaatagcaagacattatctctccccaccccaaacatcaccaccaccatagcctctcctggttcctccccagccaaggatcaagcccacactgcttggcttccctttcaaggcctctacacctgcccctgggaatctcgccagcctgccctccccacgacttgcccacgtccctgccctgagcacactccacaggtgccctccatctgcaatgcccttcccccttttccacctggaaaaaccccactcatgcttccagttctagtgcgaatgccacactctctggggagacctccccacaccccagggagccctgcatgccccccacagccctagagctcagttacacatcttcctccctcactgccgtgcctgaccaagcctctcccaaggtctccttgctccagagatctaagaccctggcacacagtaggcgcccggtgaatactgctgaaaggacacacttcggatgtgctcttctcatcagaaaccctcaaataaaagaggtcggcctcgtgccccttcacagcggtctcacgtggacatagtacacacttgggacacctagggctgagtgagatgggagggagaaacaatggaaaattctaaaactaagaggcaaggctagggcatcaactaggggtgagaaaggaggagcccaggtccctcccactttacctggacatacagtaaatgattccgaccctcccaacagaccctagcaggtcccctcatcctggggagacgcaagcccacgccagcttgaggtcaccccataccggatgctgtcacgctctgctacaatcttgtctcgctcctggaaggcccagtcccgccggcacttggccacatccgcctcctggagggcttccttcagctcctggcacagagccttgcactgctttcgaaggatttcaacctccttgttggctctcccagcatccattgtcaccgtgtctttgatctggtgggagcaaggggcaggaagagggagaggttgctgagcctcatggaccaggagcgcctcccaccagtgcgggggccaaggctgaggctctagggagctggatggagggaaacacggagcccatcgcagcacaccccatacccccagtgactgcaccccacagccacggtcctattaaccagcaccccctagcccccgccatgtctgtgatcctataatctggcatactgagttatttttaaagacaaaaatacaccagtattcctgctggtgaagtgctgtgtatctcagttcatttaaaaagctgaaatccaaagcatttgcatcttgacacatccctagagagttatatgctccactaaaatttcaagtcaaactcttagtagcactcatatgaaaaccccctccacacctctataatccttagacaacacagggaaatgacggatgacaaagcaagtgtttactgcaagaataactcctcctcccgcttgaggctttccaaacatgcaaaagagaagcacgacagcagaggcgctgatgacactggtgtccccgccccgagactctccacccccaagtgctaggacacaggaagacacacacgcacaggaagaaagcttccgttccctctaaagatcattctccagacagcaggagacagcagcctctacaaaaatgtgttcagaaagatctcagacgtagaaaacaagagaagagaatgaagttgacaagaaaacacctggagtcagttgataattcccctcatctctgaaaacagaggcagaggagctgaaaaataatttgcacaaaaaggaccatcaaaactcgagggtgacagtgcagtggcaggctttcctcagacctcacggtttctgggggtcattcaaatcatttcagttttgatttttttttcagctttacatggtatgctgtgtttgtttagtttgctattttcaaaaaaaaaaatccttcttaaattttcattttaaaaagaattatttgggggcagggtacagtggctcacacctgtaatcccagcactttgggaggccaaggcaggcagatcacatgagatcaggagtttgagaccagcctgaccaacatggtaaaaccccatctctactaaaactacaaaaattagccagacatggtggcatgtgcctgtggtcccagctacatgggagactgaggcaggagaattgcttgaacttgggagactgaggtctcagtgagcccagatggcgccactgcactccagcctggacaacagagggagactcggtctcaaaaaaaaaaaaaaaaaaaaaaaaaaagtgtattaatttagtcaagaatttatgataaacaatactttgaaaaatttacattatatttgctgttttacaatatatttatggatagttttagagctgacacgttaccacgtggattccctgaaaggtttctccatggtgctctagatgagcatctaggagggaggccccaggtgcagacaggacgacaggcagcgcaggaggtgggcagctcccccagcccacagctcccttcctttccctgggccccacaccattgctggtatccaaaatgaattcatccccaaaatactgcttccttataaggaatacaagaagtactatacttagttttagtgagaggggagagggaaatgaggtaccttaaacaaatggtaaaatttggaagcccagaggacccaagtgacggactgactgattctgattacactggtgaggaaccgcaggatctagaagtgactcgccagggctcccccatcctgcagagctgatcagtactggctcctctaccccaggctgcctcggcatcagatgtcagtctgagtctgctctaaaagcgccacctgcagtctctttcttcctgtgctgggtgaacaaaggcgtgggaagagatgggctagtcttcacaagacacttgccagacccaggcatgaggccagtgagaaaggcctatgggctgcaacccagccccagagggccagagcccactcgagagtcccaggggaggatggggcccgagtgtggagtggtgcccctgagcagatggctctcgggtgagggcacctccctctgcttcctgggaagcttctcttgctacaacagccctctgcctctaagttctggaaaggccactgctgccttgccttgtcccctggcactgtccagtctatccaccacagctgagctcagctcctcaagcaggacctgtagctgcatgtgtaactgcattcagggcagcagacggcaggagcatggggggctgcccttctacagacggaactcggtgagcagggcccgtctaggaaagtgcgttggaacctgggagatttctgcaacagacagcagtggcctacagcttccagtggtgccgacctcaactccccaggcagttcctccctcctcctgggagcaatgagacttccccggacaaggtcagctactggcctgaggcaggagggcggccttaggggagctcccgaggatatctctcccctgggagctgggaagaagaaggcgagggaggcaagggcacagccaacctggcaaagatcctgacaggcccccggcctccccatgctacctctttgctccctctttgcctcagcccactcagaacacagaagggagagagggcatagagaaggaaaggggaaaatggagcaagacgtgcagatagaagacagaagcgtgcaagcacgatgccagaaactgaagcccagccctcgggctgagcaagatgaagatggctctgcggtgagggagctagacctgccagaaggccccccacagctgacccctgacaggcagcagccagtggggtggcggggccaatccccagggtgcctcactgcccacccctcctggtctgctcttgccggtggagagtgctctcttatccatgaagccagaccaacttgagaaggagctgaggatttcagctctcagagctgatggggcagccgcgggggctctctcctgcctgctgactcggaacagggcctggaaaagatccctgcctcagctgacaggtgcacttgatgcccagtcaacaccccctgtggaggatggaggcgggctccaggctgaatggctcgcctgagtgctgggaatgcggtggttgccgcaaggacgtcaggcctggaggtctcattgctggacgccagcaccacagggaactcaggtgttctttgtgcatctctgtgctttctatatttctacaaacagtcttcacgattaacttcaaagatctcaaaacttggccaggcgcagtggttcaggcctgtaatcctagcactttgggaggccaaggtgggtggatcacctgaggtcaggaattcgagactagcctggccaacagagcgaaaccccgtctctactaaaaatacaaaaattagctgggcgtactggcaagtgtctataatcccagctactcaggaggctgaggcaagaggatcgctggaacccggcaggtggaggttgtagtgagccgagatcgtgccacttcactccagcctgggcaaaagagggaaaccacatctcaaaaaaagaaagaaagaaaaaagaaaatctcaaaactccatccacacgggctcgctgttattccccaggcgtgtgtctgacattctgtgacatttcagagcagttactgactcggtcattttccaagtttccttcttcatcattttgttttccttatttgatattgacattttccccaaaaaattatgtgctcagataccaggatgtgaacatgagttcacggtttttctaggatgattaccaaattctaatgcattatctttacttattaaaaatttattctaataagcttttcaaaaatttcattgcagtaaatatttctcttcacactggcttttgcctcaagggtctggagaagtcttggtggttccttgtatgaaattcccattacttggctggcccatttttacccacagaaacagtttaatgaggttcaccctaatcctaacagaggagtaagattcagacgggcataataatgaatgcccatctcaactcactgttgctttgtgcaggcacaatgatgtattttctatattgaatcatttgttcatcatgaccaccattccattgtgcaaatgaagaaactaaggctggctgggtgcaggggctcacgcctgtaatcctagcactttgggaggctgaggcaggaggatcgcttgagcccaggagtttaagaccagcctgggcaacatagtgagaccgcatcactacaaaaaaattaagaattagctgggtgagctggtgctcgcctatagtcccagctacttggggggtctgaggtgggagcatcacttgagcccaagaggtcgagattacagtgagctatgattgtgccactgcactccagcctggggaacagagaggctgtctcaataaaaaaataaaaaataaattaaaaatagaaactgaggcccagaggccaggcacagtggctcaccaggcggtgaattatacttgtaatcccagtactttgggaggccgaggcggaaggatcgcttgagtccaggagttcgagaccagcctggccaacatggcaaagccacgtctctagtaaaaatacaaaaaattagccgggcgtggtggcacatgcctgtaatcccagctacttgggaggctgaggcacgagaattgcttgaacccaggaggtagaggttgcagtgagccgagattgcgccactgcacttcaggctgggcaacacgagactcagtctcataaaaaaaaagaaagaaagaaacggaggcctagagaggttcgagaccacatgactgaggagggccatctcccagcaaggggcctgtgtctcatgcattccccacatcccctaccactgcccaggcctgacgaggagttgctgtcggttgaaagacatgctggtcaccccctgggcatcacctgcctcacacttggtacagcaggacctggtagtaatgatccaatgcataccagccctgccaatctgcctgacctttaaacgccttgctttttgcttctcataaaccacctttgaaagctgcattctaactgacctgcacagaaaggcagaatagagggatgtgaatatctgagaactattctgataggaaaaaaatctgctgtgatcaagtctagaagctctaatcagagccacacacaacacagactgaagggaatctccatgggcccatccaagcccccgcagggctcagctagacctagggcaaggagctccgcgatgaggagaggttgacaggtaggaaggagacagaaaatccacattggccacccaggagttgagctaggtggcccaatctagtgctaccaaacatcccagccccccaaccctggaggtgtggcccccagagagcaaggctttaggagaagaatgttgggctcagcctactagcacatcttcccagcaggagcctgaaatactttttcaagagcagactcgtgagatgcacactgctggtgaaaaagggcccctgagggtgctcttccagacacaagaggcctaacgtatctatggctttgggaacttggccttggtatcttgcttcataataagcaagtccttgagatatcactgacttcagcatgggactgatctgcaattacgtagcaatgggtttgggtgtgagtgttggtgtgtaagctccgggcagccatgactgtgtctgggtctccctcccgccttgtcccctgtaatccagactagagctgggcattaagcatgagctcaggcagtgtctgataacccagcttgcacttaggcctccagtgagaagccatttactccaactcaggaggcttctaatccggacaccacgcactctgcagcccctcttcccgggatgctgtaggagaggctgaaagccagccaccggcccacccacctacctgccgcagcgcctccatctcctcattggccgccttcttctcagatgtgctgctcttgagcttggactcggccagctccacttcggtctgcagcttgtccagctcagagatgacctggtcacgctcactcatgatgagcttgtactcgctgtacacagcgtcccgctcctccctgtatttctccgactcctttgctgtcttcacctgcgtggttctcagctcggtcagctctgactgcagcagctccatctcccactgcaggtccttgttctgcgccgtggccttgttcagctcatggtggatcgcctcaaacctggcaagagaggtggcgagatgtgggaagggcgggggccctgcccggtcagtggccggctgcgctgctgcctcccgccagctctactgtgctggacagtcaagcgtgaagtttcaagtgaagtcactctctccacccccaggagagaaaagtcatggagtaccagtgcccccggacctggaatttttctcagccctttacaaatgccaggagttgaactgaggacttcatgccctccactccactagaaacaacagcatatttctcccacagtcaagccacattaattttttaaaataataaaaacaaaacaatgccaggataacagcataaagaggccttaacgatcatttagtcaaaccgcctcatttcacagatacgaacagtacagccctgtgacaaggtcatcaagttcgctcgaagagcacagctctgtccttccaggccgggggacatcttccacacaggcagcctgcaaatcagagcccatggctccagaccagcaattctcagtgtgctccatagacaccggttctgcatggagctccattacccccaaaaaagtatattatctgatgacttatgtttgggaaactctgcatcttggccccctcttggagagtctgtctactgcacaacaccacgctgaaggctctgagaagtcctgcagcagagacatctgtctgggttcaacctggcaatgctcaaacctatttatccccaaagagcacttttcatgtgaaactgctacatgccccagagaactggtgattcacaggcacatcctctacaaaacactgtttgagggcatatatcacatctctaaagatgacagaagacacatgccccagataattaactttcctatttgctaggtgggtgactgccacagaggggagaggcacatgacagtgaccaaagaaacaggatgctcagaacacaccagtatttattaagtattgtgcagagcagttaacacagcagacccgagatttctacacgctcagaaaggcccgcttgcaaggctaaccactgaatggtgtccgtgaacccgaaggtaaacagggatgttcagatgggaagagggagccacgattcccaagacacattcagtgtcaaaaaaaaatgtttcctggtcagaagcattttttgattgaaaaagcacaataactcatgctgttctcatcccctggtggtggctgggaaccttataggacccatttgcccccggcccccgatggccctagccctacctcctcagggagagggcgcactggtgctgcagctggatggccgtgtccctctgctgggtcagcatctctgtctgcttcagcaaccgctggttctcctcccccagctgctccaggcggctcaggtctgcattgtggatggcgactttctcactgtacctcttccgaagggcgtcatagtccttcttgaccacctccaacttgtccatggccgtgtcatacagtttgttgagaatctcggatgacccgttgtgcttcaacacctggagaccagacagtttcacttaccaagggtctgtgggaggtggcggaggagacctcccactctcacttttgtctatctgagggtgagactgatgacaaggcggttggggggagggggttaccctaaagcttttgagagtcttgaggtccaattctccaggccctgcagtcacactgggctgattcatttagattcactcagtcacaactatttactaagtattgtgcagaacagttaacacagctgacctgagacttctatatccttagaaaggcctgcttgcaaggttgaccctaccgaatggcgtctaggaacccgaacagtaaacagttctctaggctgatgtaaaacttttcttctggtgatataagcagctctggtactgagcctgtacaaataaagtggcttatgctgaacacctgctttctactgggagtccagaatctgggtacatggcaggcagaagttcctacatgaccagcccccaataagacacttgagcactgagtctctaatgggcctccgtggaggccagcacttcttgtgtgttgttgtgattccatgctggaggaattaagtgcctccggtgaaactccaccaggagaggattcttggaaactcaggcccagtttcccctggactttgcctcacgcgcctttccccctttgccgactttgctctgtgtacttttgttgtaataaatgtcagccattgagtataattacatactgaatcttttgagtcctcccagaaagtgacatagcccagaatcaggttatgtaaatcggacctaaagactctcaaaagccctagggtgaccctccatggtgtagggtccccccgcatcccatgcaagtacctaatatgtctagcactggtctaggggctggtgatgccagacaggacagaaagacgctgtgccctgtgggccttttatcctaatttggagggtgtggacacacagataggccaaataaagtaacttcagagcaaggtaagaactatcaagaaaataaaaaataaaacagaataatgggctggagagagccatctgagcagcagagtggaggtctgtgagggaggctaaggctgaagaggcttcttgaagaaggcgacttcagaggcaaatgaagaagagcagcgagagcacactgggcagagaggggggcagggtcaaaggcccagaggcagggcctgcaggcgtgttctagagacagagaggggcaaggcggagtagcaagagcccaatgcacagggggaggtgggttcaaaggggacctggagaagtgggtgtgggcatgggggtggccatggccgcaggcctcacagtgaagactgtctcctgagtgagacaggaagctgtggagggttttaagctagacagcattctactctaaatgacaggcactaaagttcatttggggtgctgttatagagaaaaaaacaaaccaagaagatgagttaagaggttgccaggggggctgctggctttggctaagcacctcatgggatctgagccctggggtgagtcactccacctctctgggtttcagcttccggattcctcaaatgcccaggctagaccaggaaagcttgtctggcccttccagctccaacagccgaggaatcacctggctcattcagtggcagcctggtttatcaagcgtttgcagcctagagaaccagaagctgggacgatggaacactccctttggaattagggtcagctctcaataaacacgaaaaacacaaaaagcaaaagagggcttaatttaaaagtcagaatcatagcaacaagaaagtaaggtcttcctctaagacctaagcattagattctaggactgtagactcttaaagaggaagtcaaggaagagggagaaatggagggaaggagggaagaagggaaggaaggaaggaaggggaggagaaagagaaagagagagaaagaaagggaaaggagggagggagagagggagggaggattggttcatttcaggctcattctttttcctttatttatttttaaagcagaacattttctttcaagggaaatcttactagtacaccaaaaatacagaacttattttaaaaagcagtacacaggtatctcaggcagtcaaaatcttcactgttttgtaaaatggcatcactgttgcaaaacaggaatgcacactgagaaacagaacctcactgacagtgcccactctacatctaaaatctttctttaaaaaaaaaaaaaaaaaaaaaaagccctggccaggcacagtggcacatgcctgtaatcccagcactttgggaagccgaggtaggcggatcacctgaggtcaggagtttgagaccagcctgaccaacatggtgaaaccttgtctctactaaacatacaaaaattagctgggcgtggtggcgggcacctgtaatcccagctactcgggaggctgaggcaggagaattgcttgaacccaggatgcggaggtggcagtgagccgagatcacgccatggcactccagcctgggtgacaagcgcgagacttcgtctcaaaaaaaagacgaagaatgggctcaccatgactatactgggtcagtgaaggacagtcctgacatctggtcaaccaacgccttctacccacatctggaaaggtccagcatctaaactggattgccctgattggtgagcaatacctcaaaaatgccaattaaaaattacttcaggccgggcgcagtggctcacgcctgtaatcccagcactttgggaggccgaggtgagcagatcacaagattggaagttccagaccagcctggctaacatggtgaaaccctgtctctactaaaaatacaaaaattagccgggtgtggtggcaggcacctggaatccctgctactccggaggctgaggcaggagaattacttgaacccaggaggcgtaggttgcagtgagccaagactgtgccactgcaccccagccttggcgacagagaaatattctgtctcaaaaaaaaaaattacctcaaatgttttactgtctaaacatcccctaagccaagtgagaaccccattggctccaaatgagtctgctttgctggggaacaaaggaggctgtcattgcctgagttccccacaaggtggcagccgcggggagacgagccaacgctctcctgcagcggcttcccgccttcccagctcagaaacaaactcattccaaaggcagccttgaaatgacacaaagcccggttctgggtggtagcccgcagagcccacctccacaagtgctcggcagaatcaggagtctataccatggtttggcctctttgcagtcccctgaatggctaaccttgaggggcctggatccgggcctgtgtgacaatccagggatgattcagggccgtgtgaatcaggctgccagcaagggccgtgagagtgggccacgaattcccagtgcgacagggtgggtcacagacctcgaggtcctttcagctgctccccccagccttcataacatggtaggatcctcgggtcagaagaccgagagagagagatcaggccccgtactgcttgcttccaccacgatgacggccaccctcggcctgctccacaagtgaaagctccttgggatagggtcgtgctcaccgggagctactccgcctccctgcaactcctaacctctggttctcactctagccttggagtcaaacagaataacctgttcccacagggcagcatccagatactcaaagaggctcgcaggccccaaacacttctcaccctttctctacaaacaggactcagtgccaggcctgtactatgtaaccaacagcctctgaacaaagctggggaaccaggtcatggttaactccggagaatccaaaaaactaaatctattggtctagaatttttccctctcgccatcagaggattatgttcttggtaggtatttccacatgcacatgcacacacgagtgcgcacacacacacacacacctaactacagtcaaatgtttagcttcccagcaaaagctaatgaagagagaatatttaaatttggcccagaattctaaaattaaagtgatcacagttcactgcaacctcaacctcccaggctcaagtgatcctcctgcctccgcctcccaagtagctgggaccacagacacgccccaccacacctggctgattttttattttttgtagagatgggggtctcactatgttgcccaggctggtcttgaactcctagactcaagtgatacacccactttggcttcccaaagtgctaagattacaggcgtgagccctgagcctggcctgagagtcaacttttccactcaggcaggcagcagtctttagagatgatgtccctccagcctgagcacgggacagttggcctgtgagttcaaggggcttaggagaaatgggtggaagttgcacaggggaggcacaaagacagccacagtctaagctgttccctgcagggaggccaggaagagaccaaccctcctacctgtaccctacattggtcagaacactcctctgtgggcttctctgtaagggatgcccttcagcaaccaggaaacccctctcctctcttccttcctccaggcccatcaaagggcattcattcaggatacctgggacaagaaaatcaactttcatgaattacaagagaaagtatattttaaagacaggggaaagggcaaggaggaggagagagaagactctcggggcctgagaggtttcccaaatagattagcaggacctaggagaacatgtgcactgccctggtcccaggaattctacctgtaaggctcaaacttcaaaacatgtgtgcaaaagaacacaaagacatgtgtgtccactgaaacatggtttgtaacatgggaagatgttgaccaccaagacgctccacacagaattcgattaacacctgacagacaacaaaacaagcaaggacctttttgtatgtgcaaattcacagaaaatgtaaggaaacccatgatatattgtaggatttttttttaaagcaggtttcagggaataaaaattaaactatatgggtattaaatgtgacattaaaaaaaaaatctacaaggatacacatccatcccaatggtttacacagaggatggtcatttccacaaagctaggctggatctgagtaggtgggtggctgcccacattggttgaagattttttttctattttaactaaagaatacacactattttagtaaagaaaaaagatgcaaaaacaccctctacttagattccccaaccaagccttgtcagggtcttctgggcattcttgacacagcctagaagaatccaagaaggtgcactcggactgcccaaacccagagatggggatgccaggcagaggccctccccagcaaaacacacatatggacaaaacacctgtgtgctgctctcaaccatggcgccccctcccctagggctgcctcatttcctctgagataaatcatgcagagggccgggaagccccacaaatccctcaagcaaacactcaagtcaaacagcaccatttaccctgcaagggcctcttcaagtttacaaggcgtgggaggaacccggcaacaaaactgcccttgtccagagaggttgacctttgcccttgggcccagcggggagcaagcctgtggccatccccttatccccgcttcctctgctgctggcctactgccacctgagcatcccacagccaggcatccactccacgcctgatgaaggcaagggggcccaggatgccaggacgcggggctggtcgcccagcagctctgagatgctcccagccctgctccctgtggcagccaggcctcttctcctggtggggtctggaggtggtgtttgctgagaggcactggtccagctgaactgacctgggggaccccaatgaccaggatgcatccccacccccgcccctgctgccaaggaccacaacggtaggaaaaggagagcagggaatgggctgcaaggtgggggaagaagaccctcccctgtgaggcagacaggaaagggagagggggacaggggtgggagggagacctcagtctgaatgtctgtaaagctgagcaggtgctcaagaaagtcagagaacgggagacaaggaaactttacgcttcttgagggcagagtgctccttctaaaaaaataatattttcaattaaacaatttcttgtagagatagtctatgttgcccaggctgatcttggactcctggaatcaagggatcctcctgctccttccaaagtgctgggattacaggtgtgagccactgtacccagactggatttctctatttatgacaaggtgaaattctgagtctttttttttcctctctgagttataatttacataccacacaaagtatgcaattcagtgtttaatatattcacaaggttatgaatccacaaagttgtgcagccactaccactatctaattccagaacatttttatcaccccaaaaagaaaccaatacccatcagcagtcacttcccaaaccccaagcccaagacagccacaaatctgctttgtgtctacatagatttccctgttgtggacatttcatgtacctggaatcatagtttgtggtctttttgctggtttctttcattggctgtcatgtttttgaagttcatccacactatagcatggatcagtactgcattccttgttatgctgaataatattccattgtatggatagatcacattttatttatccattcatcggtcagtagacctttgggttgttaccggttttgggctgctatgaatattcacacctcaagtttctgtgtggacgtatattttcagttctcctggacacctaggagtgtcgctgggaggtcacctgttagctctgtttagttttttgaggaatcactaggctgcctttcacagtggctgtatcatttattcccaccaacaacatatgcaggtcccaatttctacacatcctggatgaggcagatttaaacccagacttgacaggattagaataatatcattaacgaccacaacactgactgagcgcctcatacacacgggcacgcggcgccagtgccttctacgcagtgtcttcatgacagccatacagaccaattctcctacactgagatgtgccaacctcgtgctttctagcaaggctgtggggcttcccttggaccgaggtggagccacatacacctctgaaatgatgattctctcaaggaagtatagaatccaaactaaaccccaaggcaaaaggttacctgagccaagcgtagaccaagaagaacaaactgccggcaggcaaaacagcaagaaaacaaagcacacagcagggtgtaggtaaaggccgggagaggccgcctgccctcaggtgggggaagttaccacgcaccccagggcagagaaggggctcaaacccttagagggccatcccctcgggcagcttcctgggagctttgttttgacacagcaccgccatccttacctgcttcacacgcaagattcctccacaggatttcttttgaggttaaaaatatttttgcctctttagaaactgaaaacctacagtctttaaatctgtttgctccaggaagctccactgacatgcacaaggaagggtccctgcagggggaatgggttgtgggcagtactgaccagagctagcacggcactttctactctctcatttcatccttagagaaatgctccaagagcaccacccccacctcctgaatctataaagggtgggaagcatgttgtcacagcttctctgtgccatgcagcaggtgcgagaagggacagtcttcctgctgccggctttccattaccaaggctcagtcaagacctatgggctaaataccaacttttgccccagccactgggcctgacctcacacgaccaattcccctaatcagagggcacataaaaaatacttctaatagctccaagtatatccatcttagggtctcttgctgagcctgccctggttactccacataaaacctcaatcaatatcggagaaaggaaaataaacagcaactttttcaacagaagcaagtttttcaatggaatacagtttcattggaatatggaatactccttttatctaaacaattaaaccttaaagccattaggcaaagcagagcaagacaaggacctacactagggcaggtcgccccagaggggatatcacagctggcatggaaagaggagtgggtcctggcatggcatgaggagaccaggcctgacagagagaaggcatggggtggaagagcccacaaagggtcaggaggagatgggaacaggatgggggactgcagagggcatgggaggcagctacacatgggggattgaccaagtaaacaaattaagaataacaggaattggctgggtgtgatgactcacacctgtaatcccagcactttgggaggccaaggtgggtggatcatgaggtcaggagatcgagaccatcctggacaacatggtgaaaccctctctctactaaaaatacaaaaatcagccgggtatggtggcatgtgcctgtagtcccagctactaaggaggctgaggcaggagaatcacttgaacccaggacgcagaggttgcagtgagccaaaatcacactactgcactccagcctgggcgacagagcgaactctgtctcaaaaaaaataaataaataaaataacaggaatcacatttgtcactgtttgtttgtttgtttgtttgaggcagaatcttgctctgtcacccaggctggagtgcagtggcgcaatcttggctcaccgcatgctctgcctgccgggttcacgccattctcctgcctcagcctcccaagtagctgggactacaggtgcccaccaccacgcccggctaattttttgtatttttagtagagatggggtttcgccatgttaggatggtctcgatctcctgacctcgtgatctgcctgcctcggcctcccaaagtgctgggattacaggcgtgagccaccgcacccagccttgtcactgatgtttttaaaggaagttacaaaaataaaagaggtggaaaccaaaatgaacctgtggtcttggattagaattgaaaatgtcaatgcgaactcatggctttcaatctacctgtctgatatagaaatacagatatacatatgtgtatgtatgtatgtatatgtgcctgtgtgtatgtgtacacttagctactccctacttctttccactaagagggccgggaaacagtgccaacccaagctacaagcacatccagcaattggttggctgtgttttttttatcagagacagcgtctcactccttcgcccaagctggggtgcagtggcatgatcatagctcactataacctcagattcctgggctccaatgatcctcctgcctcaacctcctgagtagctaggactacaggtgtgccaccatgtccagctaattttttttttttttttgtagagatgggatcttgccatgttgcccaggctcatctcaagcaatctctcaccttggtcttccaaagcgctgggatcacagatgtgagccaacgtgcccggcccagcatttacttctcaatactattctccattaaaaggaatgaggactacttgggagaaatggccagtctccaggggctgggcctacctgctgctgctgggcacggaggtcaccgatctccttctggtcctcctcgtggagccgcttcatgtcctcccatgactgctgcagcaggtttcgctcccgcagcagctgcccattctcccgcctcagcatgtccacgtcatccttcagccgagtctggtcactcaggagccggctgtggagtgtgctgaaacacccggtacatgctcagtgagccccagccagcccctcacaccccgccccaccccagggcatcaccagcctcaggtcccaacacttcccgtagatacagcggacaggagccaatggcaggtaggtctgtagcactcagaggcaagccaaaacctgctaacagcccaattccagaaacatccaaatcaccacttacaaacctgacaccaaaaagggcacatgtatctccagggaagggagacaggcccctctggtacagacctagtgcctccaaatactggggcctggacagatatcagcaggtgggcaggcaaagaccctcagagggatgctgggagaccaaagggaaacaccccttgggcctaccctacaggaagaagctgcagtagggcccctggacagagacccagaggcctgcctgagccctgctgcatgttctgaatcactttcatgcctgccaggtctctgaagctggcaataagatgtgaaggattaatagccttgttttacacttaggaaaactgaggcccaaaggcacaaatccacctgctgtaggcagactgcttgctcttgcacagggacaggactagaaccagaacccctggctactaagtccagagaaaagaagggcaaaggcagctgtctgtgggtgttggaggccctggccaagcaggcctcactcactggtagaagtcagtctccttggccacctcctcacacctcttcaaggcgttggtgtgctggttctgcaggctctgcaggtccgacatggctcgcacgcactggatcttcagcctctcatagtcaggattcagcctgtggtagggcctggcccagagagcgaatggccccatgaacacaggccccaggattcacacggatagaggaaccaggtcctggattaggccagcccagtggttccccagtactggtcttctatgcaccacacacacctgggtgtttgttaaactcagatatcctggcctcactcagacccacagaatcagaatccctaggatggagggagccgtggttgcctgagctccctgcatgggcctggagagctaagaaggtgccaacttgttctgcaggagcttccaggagtctgtacaacaggtctgagtccaccagaaacctgtgatgaaatgtctcttctctgtaggctcggcgtgacagctcgtgcctgtaatcccagcactttgggaggctgaggcaggtggatcacttgaagccaggggtttgagaccagcctgagcaacatggtgaaaccccgcctccacaaaaaaaaatacaaaaattagcctggtgtggtggcatgtgcctgtagtcccagctactcaggaggctaacgtgggaggatcacttgagcccaggaggtcgaggatgcagtgagccgagatcacaccactgcactccagcctgggcaacagagaggatcctgtctcaaaaataattactaaataaataaataaataaataaaagtaaaatattaaagaaaagaaatttctcctctctttagaacaatgactctcaatcttgggtacacattaaaataccaatgcccaggtcaattacattagcatatctgaggataaaacccaaacgtgaggattttttaaaaactccccagggtattccaatgtgcaaccaaggttaagaacactggccatgagcagtgatctcagagtggggttcccagacctgcagcacagtatcacctgggaacttgtcacaaatagacattctcaggcctagccccagccccagccctcctgagtcaggtgttctgaagggagggaaagagaggcaatgatctgtgcattaacaagctctgtggatgattctggtgcatgctcaagtttgaggaccctttttctagagcagaggtcagcaaactttttttgcaaaaggccacacagtaaatactttaggctttgcacactacatagtttctgttgcaaccactcgactccacctttgtagcaggaaagcagtcatagacactttgtaaccaatgagcatggctgtgttccaataaaacttcatttataaaacaggcagtgggcccgtgggccatagtgtgccaactctcatgtgctagcacatccacgtcttcactcatcctgccttcgggccaactgactgaggggcatatcctcatgaatacaagctcagggatcaggctctgcagctctggcataatcccagaggcacaaagtgcagaggcatagacccttactcctgaaggaaagaggtgaaactgaagtgtttacaccaagcccccctcccctccagacctctaccagcatgggagctaaaggataaaccactctctggccctcctccttcccagaaagtcctcttagatcatgcaggtagataaagactctctctgccccaccctatgggccacccttccctggtatctacctctaaatcacaacaaaagcagcaaacattttcttcaaagcaacaaagacaccaggtacaatgtgctctgtttaaaacacatcatgtggggccagacactgtggctcacgcctgtaattccagcactctgggaggccaaggcaggaggatcactggagcctagaagcccaagaccagcctgggcaaaaaagaaagaccctgctgctacaaaaaaattaaaaaaaaaaaattagttgggcatggtggcacacacctatagtcccagctacttggaaggctgaggtgggaggttcacttgagccggggaggtcaaaactgcattgaaccatgattgtgccactgcattctagcccaggcaacagagcaagaccccgtctcaaaaaacaaataaaacacatgtgtgacagggaacaattaatatgtttaccaaccacataaagcttcactcaacttaggcaggtctaggagacagtggtagggacacacacacacacacacacacacacgagctgactttgcacacaagcacaccactatcaggggccttgccacatgtgggatggggacctgccccacaagaagcctgtgggtcctgcccctgggaagcatttctggacatgaggtgggggaaaggggacactcaggcagcgcagcctggacccccaggagccaggggtgtttgggggtgacagcaccagcatcggggtagtaatcccaaccatggggcctgggcaggggagacggcgcaattactacctcttgtcaaaggccgtgccatgcgtagcaaaggccaggcgcttgcggagctcgtttctctcccgggtcatcagccgcagctgaatggagaggttctccaccttctcattcacttgctggtcagtgaggaggggtggtggggacggcgccttcccggtagtgcctgtggaaggggaataataaagtgaacttgtgttcatctggcattcacgaggcgcccggtgctgtcctgagctgttggcttgtgttagctattcgtgacccaacaagtgggtcctcttagcattcccctttcacagatgagaacactgagccacagacggtagcaggtagaactgaaagtgagtgcagggcatctggctccagcatccaagcactcaacaacccccagtaaccaccccagcaaggaccctgaagacgcgcactctctccccaacctggctttcacacctccaggatgcgactgttttggccgtgatccttgcatcctcccctggtttggaaatatcagctgttacccaccactaagcctggcacatggagcaggacagaccaacctgtgccctgaggagagtggaaggcatggctcgaggagaaaggcacacctgaaatccaatgacgctactaaggaccagggcagctggggcccaagggccgtgtccccgccctcctcgaccagggctggacagtgcacggctccctttttgcaagccgtccacccgcctgaaagacctgcccaaccagcccaggcgtgcaggctaagaggagggctgctggctcccagctgaggtcagtgtgacgcaattcaagttggtcctgatgcctccaggctacttaaccctcaccagccctcatcaaccaccctaggactgagtgtcctacagggagccccacaccttatgctcctagcaggcaacagccaccgctgccaccaccacctctgataagatccaaatccatctctaggaagaaagcacctcatcccaggagaagagactaatccatggtgcttttatattgaaccctgtcaatatgtctacctgatatctcaatcaacccttagagacccttgttggggtcagaggagctcacagcaaccatccaatttgtggatgggatctggcaggctgactcgtgtcaggggacacagtgtctgttccgcactggacccacaacgcacaaagggcataggacatgataggtcttctgattctctgtgctgtcctgaccacccctgtcccactgatccttgttggtcaaatgttcatgcaaaccaagagtcccccaacccaagacaaaagcagtggcttggggccttccagaagggccagggaggatagggagctcagggccaggcatgacaagccagaccacagtgggaggaggatcctcaactcccagtgctgtgcttttcagtcttttcaggttgtggaaccccaaccacttgactccagcaccccctgaaatgcacgacagtcatgtgccacataacaacgtttcagtcaatgatggtggaccacatgtaggatgtggtcccataagattataatagagttagaaacaaaagaaatatgtattaaaaaaaaaagattaaatcacatctctacaaaaaatacaaaaattagccaagagtggtggctcatgcctgtaatccaagcactctgggaggccaaggcagacggatcccttgagctcaggagtttgagaccagcctgggcaacatggcgaaaccccgtctctagcaaaaaataccaaaaaattagctgggtgtggtggcacgtgcctagagtcacagctacttgggaggctgaggtgggaggatcgcctgagcccaggacgtcaaggctgcagtgagccgagatcacaccactgtattccagcctgggtgacaaagcaagaacttctctctaaaaaaaataaattaaaagattaccatggagatgaaaaattcctgtcacctaatgacgtcttgttgatcctgaccctctgtagccctaggctaatatatgaatatatttgtgtcttagtttttaacaaaaaaagtacaaaaaaattaaacatttttaaaatagaaaaagcctatagaataaggatataaagaaagaaaatattcagctgtacaatgtgtttgtgtgtattctttttgtgtgtgtgtgtttttttgagacagggtcttgttgtcacccaggctggagtacagtggcgcagtctcagctcactataacctctgcctcctgggctcaagcgatcctctcacctcggcctcctaagtagctgggactacaggcatgtgccaccacacccagctaatttttttgtattttttgttagagacggggtatcgctatgttgcccaggctggtctcaaacttctgagctcaagggatctgcctgccttggcctcccaaagtggtcggattacaggcgtgagccaccacacccggcccaatgtgtttgtgttttaagctaagtgttattacaaaacagtcaaaaagttaaaaaaatataaagtttataaagtaaaaaagttacagtaagcaacagtttactattgaagaaggaaaaatattttctgtaagtcgaatatagcctaagtgtacagtgtttacaaagcctacagcggtgtacagtcatgttttaggccctcacattctctctccactcactcactgacttacccagagtaacttcaggtcctgcaagctccattcatgtaagtgccctgtacaggtggaccattttttatcttttattctgtactgttgctgcagcttttcttttctatgtatagacacacaaatacttaccattgtgttacaactggctaccgtagccagtacagtaccatgctgtacaggtttgcagctcaggagcaacaggccatatcgtgtagcctaggtatggggtagataccatctaagtttgtgtaagcacactcatgtttacacaacaactaaattaccaaatgacaacgcatttctcagaatgtgtccctgtcattaagcaacacagactgtgtttaaaagccaccagcatcatgacagccaggatttctctgctccaggccgcacctttggggtcaaaatattctttggcggtgaggccaggggtcagcatttcctctccccaaaggggtctcctctgcagcttcgaagtcttcccacacctttccaccaaaagaccctgagcttcactgctgcccccagcagttttgtgggtcaggtgggtgatggtgctgagtcatctgactgaccataacctacctgactctccaacaagtggagcttcctttgaacgtgcctgctactcaacctctaaccaagcccagggggaggttatgttccaggcattgatttcaccttcacaacaacctcacaagtgtgtactgataacatcgtccccatttcacaggtgataaactgaggcccagcaaggttaggtaattgactcaagtgcccaggcagtctggattctaaacacatgcacttcaccctcatgcctcggtgcctcccaaataacaaccaccagtagcacacaatgcaagcctggcaggttttgggtttttttggttggttttgtttttttgagacagagtttcactcttgttgcccaggctggagtgcagtggcgcgatctcggctcaccgcaacctccacctcctgggttcaagcgattctcctgcctctgcctaccaagtagctgggattacaggcatgcgccaccatgcccggctaattttttgtatttagtagagatggagtttcaccatgttggccaggctggtctcaaactcctgacttcaggtgatccacccactcaccttggcctcccaaagtgctgggattacaggcgtgaggcactgcacccggccatgcctggcagtttttgaaatgcttttcatacattatcccatttcgatcctcataaggtaaatatcactgttatcctcattttgcacatcaggaaacacaatcttaccaaggttaaatagtgtgtccaggtcacagagctatggaatatggaatatggacctctaaatgatcctagaacccaaggtattaacctcaaaacttgcacatttttggatcttaggacctctgtacttatctggcactccaaagagctcttgttcacagatgttatgtctaataaaatttacaagattagaaattaaaaccaagaagaatttttaaatatttacttattttttaaaaaatcaaaactccattatatattgacataagattttttatgagacattaaccaccctttccattacaaaacaaagcaatgcggcaggaacagcatcattgctttgcattttgttacacaggctgtttaacatccagcttcacagagacagctggagtctcatctctgtaatgtcacacacccaggatggaatctttagaaaactagactctacacccatgtgaggatggaagcagaaaagaccagtgacatcctagtatcattatgaaaacagtctcacctcacgagccctctgaaaggacctcagggacatcaggccacactttcagaatggctattctatgctatagtcaagttcaagaaatagcagagaaacatcaaatgtccagtttcacaacagaaaagcaccaccaggcccagtaacctgcctttggggagacaagaaattttgaattttcatccccattgtataaacgaggcaacataaagatgcagccctggctttcaaagaagctggagagaggagaggaggcggcaggacagaaggaggggctcagagccatcccaacacaccccatctctgtctccagacgtctcagtctacagccatgaggacctgggcgtggctggccacacagataaagtagcaacgacatgtgccaagcactgcccaagcactgggttctgtgctaaagacactctaccttcaactcattaatctccacagctccctactggggttgtgctaggattgctccttgagaaacacgtcagaaagactacatggctaggaaaatgggattcccatgcacactcagctctgacgccaaagccaacacctcaaccactccacaacaatgcctcctaatagggaaggattctcgttccacttctcttggcccaaaggcttgagcatacaggacacatacagaaagtaaggtcaaccagacccaagatccatcacacatcaggctctcagacccagcagaaagtgcagccgatgcctccggccttttgtaattgggggatggggagggccaaggagggccacaggggacctcatgaccaatctcaagatgtgctacgcccagaagttccaaaagaacagcaagggttgcagaaaatcctctcaatccccattcaactgaagtttttgtctttttacttgcatctagaggttgacagatattctgaaaatgatgcagtcctaccatccaaatggttgtcaggatccctcaaatggccaccaagaccaaattctacagcaaaggagctcactacttcccagcagagcccatcttatctctctccctaaaattatgccctctactgagttaatctgtccctggacattccctccactgacccttgatctaacccctaagggccacagggaacaactggatttcttgtatgcaatagacctgcaagcatttgaagacaaccatgaagttcctttaccaccatatgcccatcagaatggctaaaataaaaagcaatgccaccaaatgctggcaaggatacagctggattctcaaaactggaattctcaaacactgctgatgagaatacaaagtcatgcagccacttcagaaaacagtttgacagtttcttataaagctaaacatgcaattgccataccacccagcaatcccattcttaggtattttacccaggagaaatgagaatttatgttcaaacaaaaaccagcacacagctgtttagagcagctagggaatgaataaacaactgtgttatgtccttatgatggagtattactcagcaatgaaaagggatgaatgactaatacaactgcggacacacacagggtgtgggggaagctggaatgccctgcgttaatcaaaagaagcctgactctaaaagctacatactacacaaccattcatatgacattctgggaagggcaacactacagggacagaaaagagatgagtggctgccaaggactgaaggtggggaaagggcagattgcaaaagtgcagagggaatttttaagatacagagggcagtgttttgcatcttaaaagtagcaatggttgcatgactatttgtcaaaacttgaactgtatacttacaaaaaatacattttactgtatgtaaattatatctcaatgaacataaccttaacaaaaaaaaatttcttttttgagacagggtcttgctctgtcacccaggctagagtgcagtgacacaatcaaggctcactacaacctccacctcctgggctcaagcaatcctcccacctcagcctcccaagcagctgggactacaggggtgtgctaccatgcctggctaattattattatttttatttattgtagcgacagggccccactatgttgcccaggctagtctcaaactcctgggctcaagcaatccttctgccttggcctcccaaagtgctgggattataggtttgagcaaccacacctagcctatttttttaagaaaaccaaactgtgatgccctgaatgaagccatcatcctaagagtgatgttgacaggtaaagagatgaggaccaacctcctctgctgtcactgtggttatttacagtaaactttttaaaaacaggcaaaacagaaactaacataaagctgggttgtcaacaaaagcctccaaagtagctgccaacaaaagcttccaatgcagttctaaccttgtgcagttgttcttctggactcaaatgcaaagctgtcaactctcccgtgacctcaggctttccttacccaagtctggcaaccactggagaaggaggcagattgtccttttccttttggtgttcaggatcagatttcagaggtaagggatttggtttggactaaaatggcccaaaacaggaagacaccagatcaggagcaggctctggatggagacaaagagcagccagccctgcgctgctcttttcacccccattttgtaaaggaggcaacaggaagacacagccctgccttacgaggaagctggaagaggagagaaggaagcaggacagaaggaaggggctcagagccgtcccaacacaacccatctcagtctccagccatgaggaccttggggcggccagcctccctctgacctgggtgtaagaaggagggcagaagggagtgtccccatcacaggaatcctcagctccttcagttgccctggctgctatggtcaccaccaccgaggctcagcaaatgaactggcagctgggtggatttctcagccaccgccctttgtcctgggctccctcactgtcatgctcccactgaccctggaggcgcatccttggtcttacagctgggcaggtctcacctttgcttccaggccctgtatgcctgtgcttccaggagccagagagatgtccaggtaaacttcctggccacctccaggccctggctgcccgggagaggcaaagcagtggcagagcacagtcatcagagcaccacgtcatcctcacctacaactcaggacacccagagccacagtcatcagagcaccacgtcatcctcacctacaactcaggacacccagagccgtccaggaaagacccaggccctgcctggggtgaacgagtgcttcttaaagcacctaagcttcactagagaacctgctaggcaaaatttcaggtcccacccagacccactgaatcagaaaccctgggagtaagtccctgcagcactccgtgtggtaaaagccctccgggtgattccgatgcctgctagagtttgagaacctctgttccagaccaaagttgcatttgcatatttctcctttgttttactggctatccagcagccactgcctttaaagaaatcccccactgatgtccttgacaatgaaggcctaagggggacacccctcttagtcaatgagtacatgactccagttcagcgtttccccagcttggagtgaaaggaggttagattccaatgctggaagcccaggccccagatctccagccagatcaaagacttgctttcgaacccttgactcagggtctggttttcagaacccaaaccaccataagcagccatggccaactacttcccagctgcatctagtccagagcacttttcctggaaggcccagtccaagggccacttcctccaggaagctttctgtgattcccctcatcagaactaactgcttcttcccttgagttacttctttctttctgctctacacagaacagaatagccagtcgtgccagacagtgcctgtctccctggcagtgtgataacatttggggccgtgttcaccgtgatccctatgagtaccaaacacctgccccacaaggaggaggcattcccatctctgataaattggctttgcaaaggattacccctgacccaaaagtctgggccaggaatgaaggatcagaggtcacagggcgtcagtggcagcccccacttccctgatggctcaccccaccttcccctgtcaaccagaagaagcactttcaaggaatcttccctgggatatgagagaagccctccagcaatttctcctgccgataagcctggagacctctccatttaataagaaatcttctgctatttcaatcttcatggaatttaaggctggctttataagtgctgcccaagaatgtctcttctcctccttaaaacctccccagttttccaagatgagaaataaaaggctactgagaaattaggtcaggatgaatggggaggaaaaaagtactgattgcctgaaacgagtgtgcagtccccaggcagatccaccaggtagggtcgggggcaggtcacaacaacaggcgcaggaagcgggggagggcctcggggaagctgtgtgtgcttagctgatgaaaactgcccgaggaggccttggcacaaagacctgctgcctttaaggctgttggcaaaggtgtggcgagttgtgagtagggccaggctggagatccgagacccgacagaccgcctgagagaacgctgtctacacgccccaggcttcagcctccaatttcttctcatgctgaatacaacctgccattgttttcccagccgtttccatttagggagatgtaaatggaaaagtggaagtgatgtttttattataaggatcttgctcttgccttttctcaggttcctaagatcaccatgtgaccttaccagcggcccctcctgccagggcggtgtgtgcttgcaaagacttctgcctctcatcaggtgtggctgagccagcaggaactccctggcaggtgctagagtgctcccagccagggccagccccaccaggcactccaccccgagggactggtacaagcctggtacagacattctggttcccttctcagggatgaggttgggccagcccatctcaaactggagggctattaagctgtagaaaccctcagcgtttctgatgcagcaggggtgggaggaggctcaaacctgcatctctaataagtgccccagtggtccagcgaccaggctttgtgagccactggtttcggcacaaacaagcagccaactgtggtcaatgaaaggaggccatactgatggactctggaacaggttcctttgctcataagaaccccgccttcttcttctgccactcaccgcagatggctacagagcacttgaaatgtggtggatttgcctgagaaactagaaatttaaatttcattttaattcatttaaatttaagtagccacctgtgtttagtggcgcccatactggacactgcagacctggacactgtcaggtctggatgtgatggctggagctgctgctacagacaccccgccatgagactgtgtgaagacaccacacagaggagggcagagctgcatccccatgtactggctgacctcagcacagcctcatatgggagctcatacatttcctgattggttaaggtggtatgagtgggtgttccctgctgcctgcacccaaaggacaatggcaatctcaagcagaagagcaagagaagcaaaactcggttccctgtgaactcaagaggctttgcccagaagggatgcaaccagttatttcagcattaaatatccagacacagacagtacagacccatcctgctccaagaaacacatcagagcactgcactctgcctgcctgtgatgcccaggaagagcacagagatactgttgacggctccatcgcaaggactgagtcagcttcaggtgagtgcagaaccaactggtgggtcacggccatgacgcttcttccagaatatgctggggtccagctgcccaagaaatatcttcctactcaggctgggaattccaccatcagcagtaattgctatgggttaggcaaatacccctctctggaatccccttttagaatgcacatgtgcctaggaaaggtaacgatttaacccttgaaatgccgatgggaatgagtttactgattgctatctgttagacagatattggtgaagggtgaaaaactagacaggtcagaggagtatgctcagggcttacccagtccaccttaaaaagcctcaccttccccatctactgatcctgactgccccactccatgcacttcctgaagggtgagtcccacattccaaattccaacaatcccatcattccattgatatgtctccgggcaccaaaagcaggcagaacaaagtaataggataccgttgggagctttgaattgcagtcccagaagggcctgccctgagccctaaacaggatgagggttatgggaggaactgtgtttttatgggtggagttgtggccccccaaaagatgctaaagtcccaatccagtaaatgtgaatgtgaaccttatttggaaaggtcaaagcgttatctttccgaggcgcatttgcattctaaaaggggagtcccgagagggacactgctcagcccacagcagttattgctgatggtgaaatagtctttacagatgatcaatttaagatgaggtcttgctgccgtaaggcaggctcctaggccaatctgaccagtgtccttattaaaaggggaaatttggagacagacacacatggacggagaacatcatgtgaacacaaaggcagagatcagtgtgatgtcggcaaaccaaggagcaccaaggattaccagcaagccaccagaagcgaggagagaggcccgggacagatctctccctagcgccttcagcctgcgtggcctcactgacactttgatcttgggcttctgtcctccagaactgtgagacaatcaatttctgctgtgtaagccacctggtctgcggcactttgttatagcagccctagaaaactaagatggaactcgccggctggtcactgtcttccctcttatcacactaccttcccttactgcagctacttatttaactgtttcccaccaaaagaccctaacatccaggagtgtggggcccacatctgcctaattcgccactacggcccaagcccacctctggcacactggaggtgttcaagatgtgagctgacatatgaaagagctgtcctgactagttctagaatctcaggcatgtgactccccctcccagaatgtcaatttccccatctctctgcagagggaaaagaaaataattggagtagatgacctctgtgagtccttcgggctcaaaagatggccgggactcaccactgaaggtgtctgcatccatcatggtcagatcaggccatgagaaaccccactagaggtgctaaacagagggaatgggtcacagaggtgtgggaagcctgagaaaccactgcggccttcctgctggacttcagagaagggctggcctcattttatgggctttctgaaacccatattcagagaaacacacccaattcagcatggactggcaatgcctatccccaaggaaactccaaaaggggtgagtctcctgggcagtggtcactgagttactacaaggcctttggggttggggtggggatggtgggtcaacaggctcccctagaagccctgtgccctgacaaagtaaacaatggcaaaacatgtgcttcccagcactcacctccccacctccttctaacatcagaactgggtttctgatgatgggagaaaatgtaaatgaaatcaacggaaggatgatcctgtgagtaatctgacaagggagaaccagcttcctctcccatgaaccccagctgccttggctttcacccagacccctggcccacccggtgtcctccccagacagtggtactcacccacactgctgagggagctgctgctttctgagtctgagggcatggtggacaggacgctgtaggtagaacctggggaaagaggggagaccatgttactaaccccaaggggtcactcgtcttcaccccaagccagctgatcatcagtcaatgccaggccatgagagctacatgcaccaggcactagaaatccacatccacgggccaagcagaggaggcgcgctcagcagatctggacttcggtgtttctgccaggcctcccacctcactttatcggcccctcctgctctgggcaggcgggcagaggggaacttggagtcagtcagctggcttcttgttgggacatctggggaaaggcttagcaagggagtgacatgccccaggtaaacatggggtgtgggggtttcctccacatctctagcaatatgattctggcttccatgcagagggtaacagagcagaaattaaagaacaactgaactatctgttctttctctgactgttctgctctttaggttctaactgtattcaagctcagttcttaataatttacttagtatctgcccccttattaaaagttactcctaaaatgatgagcaattgtaccatcaccaaagccagagggtagcacttttttttgtccacacttaatgttaattcctggttgtggacacacaaccactgtggtttggtttgaattcaaatatcttcaaaaccagatgttaccctcccagcaccgggaagcccagtttctgaacctagctctatgtaggtgcccatagctgggtcgtgctgagcaagtagcttttgttttctggaactctgtttcctggtctgcaaaatgaaggagttcaaccagatggcttataaggtccctaccccatcccccatcccccatcccccatcccatttcagcaatttccatgattaatggaaacagaaggtacactttgctcatcaagactatggatgacataaaattaaaagggagggcaaactgactcagagactaaattgggagtggacaaagcataacacacagagatggcaggtcagataaaacaaggacaaatccagtgttttgttcttggagccaaaagaactatacaatgaagagcggtatgtaccaggccaagtgggtgagctggagatggaatttttgcaataagggctttgaacaagccttagggctctggcatcagaaagctgccaagaactaatgagatcctgggctccacaacaagaaatgtggaggaccacatttaaggagctcccagcagggcacggtggctcacacctataatcccagtgctttgggaggccaaggtgggcagattgcttcagctcaggagtttgagaccagcctgggcaacatagtgaaactccatctctataaaaaatacaaaaaattagctgggcgtggtggcacgcacctgtaatcccagctacctgggagtctgaggtgggaggatcacctaagcccagggaagtcaaggctgcagtgagccatgatcatgccactgcacttcagcctgggcaacaaagtgagatcctgtctcagaaaaaaaaaacaaaaaacactcttccactgcaattcttgactagccaccctacacgcatctttggacgggaaagaggagaaatgaagaaatgggggtaaatgggggagcggggcaggggagggagatgcactgtaggtgggaggcccctgggggacaggagagaccttgaggggaaagcagggagactttgctggggaggtgaggaccatgcaggagggcagagagatagactgcaggcaggcgagctagcaggcgtgtccatcagaaaaagagatgaagggggagagaaaaaagagaaagcaagcaaaaagcaactttggtaatggcaagcactaggacaggcgtgaccggcaatgaccagtagcctcattatcacattttcagagactctgaagaatctgaaggcgttgagcatgggctgaagagaatgactggggaatgggtaggtgtcttgtctctcaatacgactgtcagaagggattagatttgttcttgatggcctccagcagccaaaccaggagcagcgggtggatgctggagaaagctgcatctctaaacaggtctggatggccacggtcagcactgccaggtatgaaaagcctgagggtgagggggtgagacagtgagggaggcccagcactcagtggcatggatgtcatggggaagtctgtgcatctgaagggagatgaaaccagaaaacccagttcagccttaaaattctatgatcctgctaataatgaataacccatgctccacctcccatatctgaagtccaacccacactattagttttgctgtacattcaatatctctgcatttttgtctcaacaaaaacaataagcatcacacttttttttttttttttttttttttgagacagagtcttgcactgtcgcctgggctggagtgcaatggcgcgatctcggctcactgcaacctccacctcctgggttcaagcgattctcctgccccagcctcctgagtagctgggattacaggtgcccaccaccatgcctgcctaattttttctatttttagtagagacagggttttgctatgttggccaggctggtcttgaactcctgacctcgggatccaccaggcctcagcctcccaaagtgctaggattacaggcatgagccaccatgtctggcctgcatcacatgtttttttaacccatctctctttctatatcatacacattacatgttgcttcaatatctgtgaaataaagtcaaatgcaattcgggcaatccattgatatcttcaaagaacaagaacccaacacaatgcctattttctaaactcaactaccattttttaaatagtattttttctttatgggggcaaggaaggctagccactgacatgttggtggattgtttttggaagacgtctactcaggaaagcaggcacaaataaatttccccactctcacctccagaaatctctatgctcaacccatcccagcttacgacactggcagcctgcgctccagatgcctctgctggaacgctcccctctttcttactcttggcatcagcagtgccccttcttccagtaaactgcccctcctcttcaaatcgtctctctcctcccctgtggcaagtttccactgttaattaagcttggcagatgcccttccctctctccgcccacctacctccctggctgggggagtccacaggccaagcgacacgttctgttcctcttccctgtccctgcagtcctgactggcctctggggcctaaccagggcagcgtgacatctttgtgtgcatctctgggcatcactcccacccccaacccagggagctggcagggctcctaggagctggtggggggagtggttaaaattggacaggacccagtttttacaatgttcccagagccttggacgtcattaagggggaaaaaaggcccaaagacgacattgtctcggtcatgctttgtctctgcggttattgttgtcctaaaggcctgtgtggtcaggacagtcaggaaaaggcaaaagaagccactgtcccccaaagtcacacggtgtcctttcaaggccggttgcttccatggggcggaggggcaggtgtcggcgtcatctacctctggggtttcgccatcaaatttggagtcaaatttggtgctcctcatcttctgccatggcccaatccaggaggagacaatttccccaggttctcctgaaggcacctccacccaacctgccctgaaacctaggatgggctgctgtggaaggagaaacagtgtggagggacattctctacctcacagagtgcccagggctaagggggactgtaggatcagcctcctgatgtgtgtgtgtgtgtgtgcacacacacacacacacacacgagaggagggcaccaaccacaaacttgtgcaagctaccaagtaccatgcagaggtgctgatgagatccagagaaagttggatgatgtggaaacatttccagaaaaggggagcttgaggccaagtttagacgtggacatgtgggccagagcgtgatataaggagattctttactatcaaaggaactacctgggcaacgtaaactcttattcagcagatgagggtggggtttcagaatgcatttctcacaagcccccagggcacatgctctacacactggcccagagctggagtccacaggtgggatgcacatggaagctgcagccaaaaccctgggagaggtggaaggaagccactgggaggaagccagcctggtgaccctctgggactggcccacgggcactgtctgtgtcctttccaagagcccagcccctgataattctgtttaccccgtgactcagtgccactgggtcacgaagaccacttcaaaagaaattccaggaaaaaccacccgaacaataatggaatgccccagccctcccaggccccctcccatagaccatgaggcccaagagagatggaagcacgcccccaacacaccccttccattcacctggagcttgtaaaggccctggtgactcacgcttcctcttcgtgaagctcacagtggctgaaggaacttgttccagccttgaaccagcacacagagttctccctgtcctccagaagggcccaggcagaaaggcagagagctgacggctcacggtcacagggaggccagcaccccctacctcaatccccagggaaaggagagggagacaccaagctgctactctctggagctctggggtccctgaagacagagcaggaagtgctgcctgggccccaggaggacagtcactttcagggcacctgccacatcctgccgccctcctccagctcacactgaggaaccacagcctgacgaaccacagcagaatgaccgaaggtgcccaatcgctcccggactcacacgtgtcagccaggtttccaacacgtgccccccgcctagcatggcactgggccaggttcgggagaaagaatggcaagccaggggctcaagagcctggaggttactcatctgctgtgagtagccttcagaagaaggcccttctctctgagccaaacaataatgattgcagcacagctggggccaaactgcttggagttaactcccagcccagccccttatgagctgtgtgctgttaggtaagtcactctgcctctctgtgcttccacatacttatcagtaaaatgggatgatagaagtgcttatctcttagagctgtttgaggataaactgatttaatgcaggttgagtatccctaatccaaaaatctccaaaatctgaaactttttgagcaccaacatgacaccacagcagaaaattccacacctgacctcatgtgatgggccagtcaaaatgcaggcgcaggatacagtttattctgcttcctcaaaggaaaaacaaaattatcttcaggctatgtgtatataaggtgtatatgaaatgagaatacgtttcacatctagacttgggtcctatccccaagatatctcattatgtatatgcaaatattccagaatctagagaaatccaaaccccaaaaacacttctggttccaaggatttcagataagggatattctgcctgtttgtgaaaagtgactgaaacagtacctcgcatagccggtactctaagtgttagctggtgttattatggtcagtccagacctgcagagggcccttccaactctgctgttcaattcctcaattacctacatggaaagctgtactagagtgacaagtcacacaatctacaagcaaactgctgcactgtatatggcactctcaagaaaaataatagcagctaataggtactaagcactactaagtactgggactgtgctaagcactttgcatgtattgcctccattaatttccataacaacccaaaggttgtcattattagtcccatttcacagaggaagaaactaagagttagaaaaattaatttgctgaaggtcgtgctagggctactaagagcacaaacaggatacaaacccaggcagtctaccccagcgcctgtgctctcaaatcctacacacaatactgctgcccggctccacagggaagagcagtcagagaggacttcatggaggcaggggcctggagctggccctgaaaggtggtggccttggataagcacatgagaagcccgatcagcttgcaggagacaacaggcggaacccatttctctggaagggtaagaagtctcagagcagggctggcttgggccaaggccccccagcctctattccctgggaatgggctcacctcctccctgcccacctccccacaccgagacaacactcaataggcattctgagctgagccacttccacccaagtgggaagaaagagaaggagctgtggcttcatggcccccattccatacccatgcctgtgctgcctgcagaggggagtcgcagtgtgtgggcaagcctgcactcaagagccactcaattctgtgaactgcagagatgaggaaggaggtgaccgtgaaagttgcggagtgctatcacctttggcagagcccaccttctctgttttaaagacctcctgggatgctggggggacagagggctcatatcctactattaggctactaggaagcctgcttgcagaaccatgctcagttctcaggagggaagaaaggtggcagggaaaaaaaaaagaaaagaaaaaactacactcagggcagccccagcccctccctaggggctcggcctcctaccctttaaaagcacggcccaaggctacagacactgaaacccaaactgggaagcggacaaggcccagtatttcagggaggtataggttgaccatggccctggaatggagcaaccacagacactggcatgtcatcaaggaagtcctgctgatgcgccttatatgccacccgagggtgggaaaatcctactcttggtttgtaagttaagatttaatatttgttttcctcaactgagataatgctatagtattttccaccaagttttggaacaagcagcatcactgcgctaaaaaaaaaaaaaatcataatgatgtggattccccctatttctggtcgttataagaactgctcacctatctttaaaaggtaaaggtggccaggtgaggtggctcatgcctgtaatcccagcactttgggaggctgaagcaggaggatcacttaggtcaggagttcaagaccagcctgggcaatatagcaagaccccatctctctttttttttttttttttttgaaagagagtctcactctgttgcccaggctggagtgcagtggcacaatcttagctcactgtaacctccacctcccaggttcaagctattctcgagcctcagcctcctgagtagctgggactacaggcatgcaccaccatgcctggctattttgtattttttagtaaagacggggtttcaccacgttggccaggccggtctcgaactcctgacttcaggtgatccaccccaaaatgctggaattacaggcatgagccaccacacccagccaatcccatcttttttttctaagaggaaggaaggaaggaaggaaggaagggagggagggagggagggaaggaagggaaggaaggaaggaaaaaaaaaaagtaaaggggaaggggcattgcccagataattggagatttaacctcaggtatgcagtgagatctgtgtggggtggcaggaaggaagatgatggctgccgagctctctgtccattcttttttttttttttaaactttatattttaaaataaatagagacagggtctctctttgttgcccaggctggtctcaaacttctaggctcaagcaatctgctcgcctcagcctcccaaagtgctgggattacaggtgtgcgccaccacacctggcttttgtgtccattccttaacacattccctaaccccttcccactggacttttgaggccatttataaaataatgaactaaattgcctgaacctgagaaaactctcgtatcaattttgccatctgtgactcccctcccttccccacccaaaatgccccaaggcaaaaatatgtaaagagagggaaaacaaaacatgtgcaccccagaattaaatcattcagtaccatgcaagacccttcactcgctaactacaggactggttttggtctttttctttacttttttttttttcctcttttaagtggcaagtgacagggactaaaaaaaaataaaataaaactagcacataaaggaaagatggaagtttgttgaatttcgagggatgaaaagagtccacagttggatagcctgcttgtcttcatcagcgaagcaaaggctcctggaggctttgggatgagcacaaagcctgtgtctgatgaaagccaccctctttgttctgcctcccttcagagctgccgggctgcaggttggggatgggagcagggagggagggaaggcagtgggaggacctaagaccatcaaacctgacaccaggtgggaccacctctcggttcctgctttccatcaccaaaaccaagccctgctccctgctgtcacttctggccagactaagacagttctgcacctaaaaggcacaggaggaggcccaaagagggtctgattaaggaggaggatggggccatcgtgctatgccctggaaggtgggggtggaggggggacaacgaacatagccaagcctgacagcacccacaaggcgaggtgtgaaggagtggagcagcgcctctgccccgccaccctgacagcacatgtcacaccaaacccagacaggaaatctgagcagcaggggcacccaagaggcagccaagcctccattatgctccagccggacatcccccgggggccatgtctgccctagaataaacttctgataagccccagaagtcacaacaggcaggaagcagctctctgaaaggcaccgggcacccccggctccctcctgctctggcccggtgctcaatttccactagtcagtaaatggagaagaggctgcctccctcccacacaggatggagcgcataccttgcagagtacactgccctccaccctcccagggcaactgtagcaaggcaggctctgcgtcagaccggctggctcaggcctgccactcaccagctgtgtgacctcaaataagttgcttctactttctgtgcatttcctcatttataaaataggaagaatagtaggtgatgagaacagaatgagcaacgagagggaaagcccttagaacagagccaggcgcacagcaagcgatccacaaacaccagctctcgttactgttaccgtctcacaggctcctaaggaaggcagggcatggggtggcctctgcagtgtacacagacagcagatgctatggaagggacctggaggacagtcacgcagccttcccttgacttctggagtgttttgctggttagaagctctgcattgagtactctgtatacttcccatcaccatctccctcaggagctaatgcttccccctcaacccagccatgagtgtcgcctctcaatacctgaatacagctctatctatgcctgtggataaggaggcttcctctcccctcccaccattccacgtggccatggcaattccaagccatccccagcatcccttatgatttctggttctctggttcacaaagaaaaaaccagagcgctcacagtgtgcctggaatcataccaggcttgcacctccactcatccagtcctggctcccaccacctacatacagacatcagtcagtgccctgtaaaagatgctacgcattggtgggcatgtctgtccccggaaacacaaggcccactcattcgccaaacgctgggttaatgctgggtgaagtactgggatgcagcaggaagcaagatggacaaatccctgccctcatggagctcacatgaacagggtgacaggggcgggggagaaataaacaaacataaactgtattgggtagtaagtgctatgaagaaaaatgttgcagagttaaatggtaggtggtgggggtggagaggagatgtggctattgtacagcggtggcaggggtctctctgggcaggtcatctttccccagagacctagaggaagcgtggagtgccagaggagggaatagcaagtgcaaaggccctggggccaccccatgcggggagacctgtctgctgtgggtggagggacctggaggaggatgcagatgaggtcacaggggcaataggacagctccaggcagaaccttatgggccacacagaggatgcagggctttattcagagtgagacgggaaaactctggaaggttctgagtagaggaaagccatgatctgacttacatctacttaggctcattagatgatttgttgaatgttgtccacaagcagggaagcatagaaacaagtcagacagcaaactcgcaagtccaggggagcaatgctgggggtctggaccagagtgacaagaatggtgttggtgagaagtagctggatttgagggatattttggagcttttctttctttcctattccacatttggcttggagcagagctgaaaggatctgctcataggcccaatgtggaataggaaagaaagaaaagtcaaggatgactccagggttcttggcctggaaactggaaggatgatgttggtccttgctgaaagggggaagcctgcaggaaaaacagatgggggagggagttggggaatcatgagttcccgcggggcctggtcatgcgtgaggtgcctacagacacacaagggaggtgtcaggcaggcagatggatgtacaggcctcaagttcactgacaaggtcatggctagagatgtaatctgagaattgtcagcatatgcttagtatttaaagtgatgagccttgataaaatcacccaaggaaggagtacagacagcaagggcagtggagaggtccaaggaatgaacctgagcatgcaggggctaagggaagagaagagaaatcaaccaagaagacagaggagaagtgggtagtgagatgggagagtcgaccacacaagtaaagaaactgaacacagccgggtgcagtggctcacacctgtaatcctagcactttgggaggccaagacgggtggatcacctgaggtcagggtttcaggaccagcctggccaacacagtgaaaccccgcctctactaaaaatacaaaaattagccggccatggtggcgcatgcctgtaatcccagctactcaggaggctggggcaagagaattgcttgaacccaggaggcggaggttgcagtgagctgagattgcaccactgcactccaacctgggcaacagagtgagactccatctcaaaaaataaataaaaacaaacaaacaaacaaactgaacacaactgcatgtggtcaggtcttaagagaggtgctcagatatgcccatgttgcttaatggtgaaggtaagacagacacacaatcctcccgactcctgatcaagctgaatctgcactccacctaccccctgaacttccccagttatcaaggaggctgatggaaatgaggcagagcattagggagacccttcagtgtatactaggcatcctacatggcacagctcatgtttttgttgttacactctactcatatcaggtaacatttattgagtacttgttgcaagaaaggcactatttgtatggattatttcatttaattctcccaacaatcctacaaggtgggccactatcaactcaccttctagatgaagaaatgtaggctcagagaagccaagtaacttgcccaaggccacaaagctagtaagcagagggtcccaactcaagcaggactctcatccactaaccctagaccttttttttttttttttttttttttttttgagacaaagtctcactctgtcacccaggctggagtgcagtggtgtgatctcagctcactgcaaccttcatctcccgggtccaagtgattctcctgcctcagcctcctgagtagctggggttacaggcatgtgcctctgtgcctggctaatttttgtatttttagtggagatgggatttcaccatgttggccaggctagtcttgaactcctgaccagacctcctcctttctgacaagatcagaaaaagtgatactcactagttccttctcccactggatagaaaaagatgcaagcaggcatccctcgcccagtgtcaacactcagggaacaggagatacctagtaatcactactggcaggtcaggagctcttctccaagcaggcatgctatctcgtggccagcatgcagcactgtggccaaggccatctttccaacagaaggaaaaaagggaagcatgagaaagaagggttccagtcacctctgtcacagctcagctgccagccttgtcctctagtcctggcttcaacctctctggccttgtcactcctctggccgtggatttctctggtccccctcagaagagactagtactgtctctggaacaagctagataaatatctccatcctgggtctttagaaggcagcaagaaatggagtgggccaatggagtttcaggaagctgtttatgattctgatgcttagaccaaatgcaaaagaactgtaaaggtgtccctcccccactgtcccttcgtgccacaccatcccataatggcatgttccattaatctcagctcaaggtaagctgagtcatcagccagagaaaatgatggctctgggaactgcccaagtcacatggcatgagctgggcattaggcaaggacatggcatcccaggcttcacaggtcggggacattctgtccacaaaggccaaagagggcaactacaaaggaaaagtcttatctaagacatcagcaaacgggtgctgtttctgccccctctttcttcaatgtcatctacactgccctcctcatctacttcgtgggctgcattgagaatcactgaccaccaaggcaactcagcctgggtctgtagtagcagcaactagggctcctgaggtcatggagaaccccttgcccaccacaatattcctgctgagtttgaactcgtcaggacccctgccatagggcgggaggcacaaagtgaccccatactgtggaaagggcccaggatcaggagctggatggacatgggctccctctgctttggccacctcctaatcagtgaccaggagcaaatactttttctgagcctcggtgtcatttgcacactgaggctaaaagtctttatacagtcagtatttcacaggctgtcgtgcagagcaaatgaaatactggatgctgaaagtgcttcgtaactgctaataaatgatccatttttcacctcctcaggaggctcaggtctatctctgtccccgactccactgcaaatctttcccagtcttccttcatgcttctctctactttccactgtcagcctcttctcttccacaaactccttcttccttctactcttattcaaaacacaaacaacaaaaacaacaaacatgcatacaaaaggaaaaggaattaaaacgcaagaaggccaggtgcagtggctcacgcctgtaatcccagcactctgggaggctgaggcaggtggatcacttgaggccaggagttggagaccagcctggccaacatggtgaaacctcgtctctactaaaaaaatacaaaaaaaaaaaaagtcagcctggtgtggtggtgcacgtctgtaatgccagctactcgggagggtgaggcacgagaacctgggaaacagaggttgcagtgggccgagatcactccactgcactccagcctgggtgcactccagcgaaacaatgtctcaaagaaaaaaaaaaaaaacacccaagagcttcacctccatttctctccattagaggtgtccaaaatctctgggccctcagggtggaccacacctcacctagtttcacgcaattctacgctgactttcattactatgggtgaaagctccagcttctgggccttggagttcaagaatgcccagggtttttgaacacaggaataagcaagcaggtatgagcttcaggaacctgtctccagcaactgtgaactggaaggatggaagcagggagagcctggaagctgagagaacagttaggatgttcccacaagagctgcccttaactactggtcatggggtacgggtagggagagggcccaagaccacaggtagggaagaatggaggatggtgctgaggtttgtggttggggcatcccagaaggtgacacagttaacagaggcagaggattaaaggaggaggaatgagatcgttgaaatccatcaggtagaatgcactaaagaaaatccctgtgaagacagcctgctgacactcagaaactggaatgtggcaccacagagaaagtttcaggctaacacagtccactccagagtcacaccattgagcctgcaggatgtgagtgacaagcccagagtcactaattggtaatgtgaagcccctgggttagaaaaaaacataagactcaatttgaacaatgtcattgggaaagaaaaagaaaaaacagaggagagggctggatctatggaccccctaaacagtgactatgaagtaacattgttctttttttttttttttttttttttgagacggagtctccctctgttgcccaggctggagtgcagtggtgtgatctcagctcactgcaacctcccccttctgggttcaagcaattctcctgactcagcctcccaagtaactgggattacaggtacctgccaccagaagttggctaattttttgtatttttaggagagacagtgttttgccatgtaggccaggctggtctcaaactcctgacctcaggggattcacccacctcagcctcccaaagttctgggattacaggcgtgagccatcacgcctggcctgaagtaacattgttctaagtgtatataaagttcagaatctggggaaatacttcctgtgaagacaggaggaaaaaatgagtttctggaaaagacatagaaagatcacttggagcaggggtaggaggagcaagagaatgatgcatcctagaaggcaatggggtggagggagcctggaggggttggtctgccacaccaaatgctagggaggactcggaagcaaagaaacttctgatctggtcatttggaggtcaaagatgctatgcatggagtcaattaagcaggcaattgattggccctgtttctccatctgagaattgaagggcttggataagaccagaaaaggcacaaggtgcatcttgaaagagcagccatgcatcacaccgcctgcctgagtactgtgcctaaagccatacctcagctcactgggaaaggaccccacagtggatcagcaacgtctgccttgggcaagtcgggcaagagtatctcatccccggagcacattgtttctacagacctgtccacctccagagacatggttcatggtggtcggcacttagcaggcttcccgtaattaattactgattggaattaaactctgcaatctaatctgtgtctctgacatcctttaaatgactgtgactcaaggagcgctcagggaaaaataaaaggacaattatcttttttccatcgacttcttttgaggccccgagaaacagaaagtctgagagtttggctatcagaggcgctctgggcagccctgcccaaagcagatgatcctccaatccaagacgggccctcagatgttccaaacatgcttcctctccgataaagtaacaccgtccaggagggttcaccctcattttcacagtactcggtgtgcattttggaaatggcggacttcagaagtccattcctgaaactgctgggactctttccaatgttttacagaaaggacgctgcacacacttacctgcagacatccactgaggtatccaacgctcacctttgtcacacccagagcaggagtgagcttttaaatgagactttgggtactatacactcaggctgtcacctcctatccccccacaaataaagataaaacagcacaagcattcttcgccctaaaaccctatagcaagctttcatcatgacccattccacacctgtcatctcagtacattcaagtgctcacatgggccctcagctagagcatgagcccattcttagatgcctacgctcagaaaacaggcccatgctactctttgtttaaatgcagaaagaggagctccccctaaaacactccaagcaaaatctggacacacaatgccttcaaattgccccaagtcaaccacagaaaatggaagaggagatcacagaaggatttcaaatgcataaagggatgtagattatctttcacacgtgggcaatgctcagaaaagttgatcttgagtaacgagggaaaatatttcattcactatcttgtgcaaagagaaaaaaaccaaaatccacatccacgaccctggagtacagcaaatggaatcaaagtgtgccagcccccaaagattccagcctcctgcagctcctgaccctctggccatttgcagggagctctgcaggcagtctcatctcaatggactgggaccctccagcctgcaccactatggctgctctactctccctgccccctgagcaaggcaaatgcttagtgaaagtgtgaagagtaagagttgaatctgcattttctagtcagacttcagccctctcatagtttaaggggcatcccctctaccgtccagccctgacatcctacaggtgttcagagggggcgtgactgagccaggtcacacagcaagctggtgccagtgccaggagtgaaacaagcccacaactctgatgagcaggatgagaggaggaaggggatgaaggaagtgccctccagcgaaggcaagagtgcaggaatccctaggtagagaaaggtccccccagataagcacctggacaccctgtgcaggctgtgagagccaacagagaggggcagtcggtcaacagagcttctggccaatggctcccagcctggctgttcatcagaatcatccaagctgctctttaaaaatgctggaaaaaaataaaaataaaaaccaaaaatgtctcaggaccccttcctatccccaggaatcagcacctccagcattccaggcttttaagatgctgctcagagtctctggtgagtggctcagttggggaataccaccagggtctgcacacgcaccctgggcttcctgccctctgagcttcctgaacactgccactgaccctcagccagaaatgcttgcccccttagggtaccgttgtcactagagaaccgtgtgagagtagtaatgttgctttttttttttttggagacagagtctcgctctgtcacccaggctagatctcagctcactgcaacctccacctcccaggttcgcctcaacctcccgagtagctgggattacaggcacacaccaccaggcctggctaattttttgtatttttagtagagatggggtgtcactatgttggtcagtctggtcttgaactcctgacctcaagtgatctgcctgctttggcctcccaaagtgctgggattataggcgtgagccaacgcgccctgccagtaatgctgctcttatgggctgaagtgtattcccccaaaatccatatgttaaagccctaaccccttctgcagttcctcaaaatatgactgtattggaagataaggtctttaaagatgtaataaagttaatatgaggccatgagggtgggccctaatccaaaatgactggcatccttataacaagagatcaggacacagacatgcacagaaggagaactgcatgaagaactgcacggagaacatggccatctgcaagctaaggaaagaagcttcagaagaaacctgcccatctgacgccctgaccttggacttccagcctccagaactgtgagataatccatgtctgttgtttaagcttcctggtctgtgatactctgtatggcagccttagcaaactaatacagttgcaaccatttacccatgctctgtgcaggcccttccaatacagacatcacccacatacactatctcacttaaaacttcagcccccaggacaaacgtattgctgttagccccattttacagacaagaaccccaaggctctccaagatcaaggaactaacccaagatcattcagctagaaagtcaatgaccagatgcacccacctcccagccctttgcctgtaactgctcctgagctgcctgagtcctcagtcctctctgccatccgtcctgggcccactcagcagctgcagtcctaccccacctggatgaacactgtctgagcccactgtgccttctttcccagcctcaggcccccagcagacacttcaggggaacactgacttgctatcatctgtagtttttgaaactttttctttcttttattttttaaataagcactgttgctttggtagtcagaaaaaaaaattaatattaaagagaaaaaagctaacacggttaagagtttctattgaatctgtagcctgtgtggaaagaaagaagtgatcaaaaggaatatatttggaaaggctactaagaataaaaacaaacaaaaaaaatacaagctgcccttgccaatgtcccatcagctgagatgagataagagattcatggggcagaagtaaggctgctgaggccagagatcccagccaggccatctccagaaaatatctatttttaaagtcacgttccatttcatcacatttcagaaaaacaaagaagagaccttgagggacagacaaacaggctccagagccacacgcctttgtgtgtgctcacagcagcagcagccgtgcctacagccagccggcgattttcatctgaaaaactcagatctctcatggcagagagagttccacaccgagctgccatcatcatgcagcccaacaaagcagcaattttcatatttcctagggcctgctgggctcccaacttcttagtttaaatggaaactgtcagacaggattttgtgcaaacatgcgttttcctcgggggcaaacattctgagcctacaacttgttctttcattttgagagctttttgtccatggtgactacatcaaagatgagaggtgggcggggagggctgttggggagcaccagagaacagagcaaatgcaaagtgcagggagagcagaatgaattactaggaggcaaagtgcggcaggaacttatgtgcctggcctcctcctgggcagcagcctcagaggaaagaccttggctggctctgctccccacctctcctgcagcccctgcgtggacagcccagtctgtgtcagcacctcttccctcgggtgacctacaaggtcctggagaggaaaatggtagcaaagaatgtgcaaaaaaccatgatgacagaagacagcagaattcccatatgaataggattaggtaagaaggggttaaatgtgttaatattcatcaggcggagctttgcgacatagttttaggcaatggtactgactcttctggaatcattttaaagggccactcgctttttcattataagtccattcactggagcctcttaagatagtctcaaaagacagataggaatgcgcccaaatccacctgcgcaccaacaccgtgtgccaagcaaatggaatcctcgggaaaggacacccattaaggaccatcccaaaccccgttaatatgtacatgttcctctcaagctttatgcattaaaccaagtcaactaatattttccaagctcttttaagatgtgtggtcttttatatgtgggttgtgtgtgtgtttgaggggtagtgacgaagacacccccatcaagataactgaagaagaactgcccaaactgaaacattcaaatctccaaacgtctccattccccctaggtgtttgcatttcagtggataagatgaacacctggctgtgaagcccacaggtaacctcccaggcctcacaagcccacaggtaacctcccaggcctcacaagcccacaggtaacctcccaggcctcacaagcccacaggtaacctcccaggcctcacaagcccacaggtaacctcccaggcctcacaagcccacaggtaacctcccaggcttcacaagcccacaggtaacctcccaggcctcacaagcccacaggtaaactcccaggcctcacaagcccacaggtaacctcccaggcctctgccaagcagaaccaatgaagtctgttgacacaagtcactagggaaaaaaaaaaaaaaaagtctctgcaactctgtgctccccattatcagagaaaatgaggtctgttctgggcctcccagctctgagctggctgccctgggtgcagccttccccaaaaactctgggtatccagccctcacccgtgctgacagcgcactctgtccaccagctcatgacaaaggccacttgtttcccatgagtgtccagaacagtggctgaaccagtcaacccagtcggggactgtggtcctgctggatgggcggtgacaagagctcactgtgacctcagcagacaattagcaaggcggtgtcgagttactgagctccagcaggtcacctgctaggctgggagaatggacagaatgcaggttccagacccaagaaggggttaggcagggtcacaggctacttcatctgcctccgtatctttatgctaagcactgcaccctctgacattggagggcaagaaaagaaaaggtgttacaaggaggaggctagaacctatcccaggagtaatctgagaattgagccagtggttgacaaccatcctaggaagtatttggaaatgtgtggagacatggtacggtggacacaatgatagggaggggcactgtaggtgggagccagagatggtgagcatcccaaaagtgcagaagatcccaaagccaagagcatccactgagatatactgaagtcagttccatctaccccagctgctctgaccatacctgaaccactgtactcagcacaaagccacaacaaatgtggaaggcagggaagaaccaagagttgcaagaagaaaaaaaatacaacatgcccaaaaggtggtgatgaggaaaaggggaaacttagaggcagattggggccaaaaacctatagacaacagctagcaggatttaccaatgagaacggcaagcagcttctcaaagagggatgcccctgccaacacggatgctgagctgcagcaggatgtcttcagctggagggcgctcttgagcccatcagcagccaaggtctacctgtcctacctccaagcctcttgtgctcgtcacttcctctccactgccacgatgtggccacacctctcatagctcaactcatctcatccaccccacgattcaccttgggtctctagggtcccaggtttgccatttaccaccacgggcaaggtacataatacctctctgcacctctgattcctcctctataatggcacacagaggatgaggtcaataattacactttacggccgggcacggtggttcacgcctgtaatcccaacactttgggaggccgaggcatgcagatcacctgaggtcgggagttcaataccagcctgaccaacatggagaaaccccatctctactaaaaatacaaaattagctgggcatagtggcgcatgcctgtaaataattatgctttacacttggatgtctcaaggtagcgctggagtagttattctgagctactggaatatcagcgagtgccacctccagagggagcttcccagagcccagccctgtaccatctctgagcttccaggagtccccagctctccagccgcagaataaaacctgcctggaagctggcactggagggtctccatgggcccagcctaacctgtccacaccctcccagggctcccccttctaccacccacacttctggccagactatagtgccacttgcttatcacacccagcccattcccaggtgttcccattcagttttctgattccaccatcactactgcctctaccaacatcccaaccgacccttcaggcccagctcaaatgagacctctccgaggagtttcccagatccccctacccaggaatgacctgctcccctatctccctatgcatgcctccctatggttctagctgatgtctactaggcctggcttcacctatgaggctggggtcagggtggtttcatggatgtgtgaccttgtgcagtctcacaaggctcacaattggcttcgcactctgctgttgccatcgtgaaatcctcaatgatttatgtgccgcaaggagctcccaattttcattttgcactgggcctgcaaactgcaaactgcagatgtggtcctgctgaggacttctcaaggatgaggctttggtttatctctgcatctcacagactgcagcagtgactgggacacagtaaggacttaacaaaggagggaaggtggtgagtctccatgtctctttgttctgtgagcagctgtcacctcacacagctcattattcataggctggtgagctcacctctgtcccccaacagacacacacacacacacacacacacacacacacacacacacacgagaagaaagcaacaattcagctcagctcattcccaaaagccacattccctccaaccccgctacacatcactcccacaggacatcacaaaaaaaggtcgctggatcctactgaaaatgcagcccctcagcacttcatctcaaacactttctcccacagcaggtggctgagggctggtgtgctgaaaagctcacattctgcatgcgggaacactgactccggagccatccggctctgctgcttgctggctgtataactttgaatgagtcccctagcacaaggcccagaaagggggaaccctcagggatctggctgtccccagccctgcccctctctcagactcgaccctgcctctttctgcaggttggctcagagacacaggcccccagggatcacagcaccctgccctcatcatctgcatttatggtccccacaagtcccagactcgggaggacggacacacccacaggccaaacaaggcattaggaacatgggatggcacagcttcctgggatgccccagcttcccgggatgccccagctaatggaatcgcacccagtcctggctctgatcgcagtagcacatctgacacgtgccctcaatccctccctacctcgtgacccataagcagccttttggcacaggcacacagccattagtcaagcaacctgtgagaaaaacactgcctggccatgcaaaacaaatgtaggtggcccattagaaagtgaggacttgtttgtgaaaaggtacatgtatggaatgcaacagcctcctccctctgtatctgacttgggagcactttcatcataaaattttggttgacactagatgtgttcttacttgtaagacagcacagttatcaggaagagtcacagaatgtcaacaacagaagggaccccaaagataaagtagtccagtgccccatttgacagatggggaaactgaggcctctgtgttcccagggccccagcctgctccccttggacactgcacctgtgtactatattgccaatgactgtttacaagacacctcgcacaccagacagtgaattcctggagaccagggtggtaccttcatctctgctgccctagcttccctcacagggccaggcagccaggagacacccaataaaggattgctgaatttcaaaacaatacgtgtacatgataaatatatacagtatttgtccattttaaagggtaatcaagtttttaaaatgaaaataaaggattgctgaataaatgaacaaccagagaggcggccaccagccaaggacaaacaaagctgaatctggaacactggcttcctgctgtcctctcagactaaacgcagtaggtactgggtcactgggagaatggcaaggccagtatgctgtgtgtgcagggacagggcacccccaggttgggagccaagcctagtcccagccctgcctctggcattggcattggcgtgctagccatttgaccaccagagcagcccctctctgaagctcagtttcttccattcttgattgcaggacaaataaacgtcaccttacctacccaccagtgtctcagcaaggaaggagagagagaaggaaacgtcaccttacctacccaccagtgtctcagcaaggaaggagagagagaaggaggtgaaagtgcactgaagacctaatacacaatgtatacttaagcgggactgtcaggggacaaaggtattcactggggaccccctgcccccacccagtaatgctgccacattttccttatccaccagcccatttactcctccataaccctgttaggtaatgagaacagacatctcagccccactttactgaagagaaaacaaggtcgagagaggccatcgatagtgtctgtcctccagtggccctgccaggccaaggggttgggggcacggcaaagggctccaggagtccctgcccgccccagacagcagcacctgccaatcttgtgtatcaatgggcagcagtgctgggctgtgacttgccaagtccatagtcagtccctgaatgccatagggaagcatctgctctggacggtcccgtgcttgggggcagaatgacataagtccaaagtagttcaaacggaccagcaaaaagtaaccaaaacatagccaacggcctgtggactagaagtcagtgcagacaccattacctggttttctaattctccctggaggaaactggatcaatgggggatgggggaagggacagcagtttttgaccccctactccctgggcctgaacccttcccagagctgagtcctcttctccactccctactgtctccctacccggcgcgtggcccgcatggggccttcccacaggtggactgatttttctgtccctcagaaccagagccagtggacaaaacctccgttcccaaactccaagccaccaatggaaggcctcacataggaagctgtgggtggaagatggtgcgtttctactgcctggtggttttagatctctatcgcctactcagaatctgaaccctagcctgtgtgtgtgagaggctgcacgtgcacatacaaaaacagcaaggtatctacaaggggggtcaggattgcagaggggctacctgtgtgagctctggagcccaactgcctgcctgggaatcccagcttacccactgactagctgtgtgactcagggcaagttctttaaccactctgtgcctctgtctgcacctcactctccttgcccctaaaacaggggtaagcaaagtacccacctcccaggatttttgtgaggctaaaatgagataacacctagcacacttgccagacaagaaaagttctatttttccccagcacaatgttaatagggttgcctctgggattttgtgtgcttttctttttcttcttcattaattaaattttctacatgaatgtgcatgctttattgtcagcaaagaataaagctttttttttttttttttttttgatggggtaggaagaacagctcagaatcccaagtaaccctttcttttaaacacagaggatggaagcagccctctctctgctggtctattttaggatcttctggatgggcaaggagttctactgcccaaagcagcccaaccttttctgctccctgattcccagcgtaccccttccccacctctgcccatccagaaaaactcaaatctcacctcctccaagaagccctcgctgctagctcagcacctctcttcctcctggggaacaaggcctttcctcactctgccctcccctagctggcactatccactccagaggtcttgtaccggtctctgttccaggggcaaggggtttgccaagaccccagcacagcggtcttgaggggcagggccaccttccttcctatgtcctttcaaagcactcgctctgcttttcttcttggaacttcgatacaaccttatgagaggtggacatgggttcagggaagaaaagtgatgagcaggtcacactgctggacttaaccccagtctgaccaagtccatcagggctcactctgcagccccaggctgcttcccatgggaggctcacagcaggcactcagctgacagaccctcacccgcagggcagcactgccctggcccatcatacatctcttcctccaccctgtccccgccaatgccgtttcactactcacgccccttctccttcctccccaggatttcccttctcctctggctgtgctttggtctgcagtgaccctagctgatgttctgaaggtgttcagagctaaggaggccagtgaccccacatcaaaaggggaaaagagagaaaaagtttctgagctttgtaaaagatgctactggtttttctctgttttatgtcaaataacctgtaacactcctggcaatggtacatttgagccctgagtatagaaaagaatttggcaggacagtttaaaatgtccagacttgaaggtgtcagattttgtaagtgaagaaattcagaacacagaagcaaacctcaattcagggacactggagaagtccctcagctgttcagaccacagattctgtaaaaaaaggatagcagatgtccccagatctcccagtcccctcccaagtttcaagaattctaaggctatcctggggatatcagtagtcagcgtaggctgggcgcggtggctcacgcctgtaatcccaacactttgggaggccgaggcaggcggatcacttgaggtcaggagttcaagaccagcctggccaacatggtgaaaccccatctctacccagggctcaaatgtaccactgccaggagtgttacaggttatttgacataaaacagagaaaaaccagtagcatcttttacaaagctcagaaacttattctctcctttccccttttgatgtggggtcactggcctccttagctctgaacaccttcagaacaaaaattagccaggcgtggtgatgcacgcctgtaatcccagctactcaggaggctgaggcacaagaattgcttgaacccaagaggcaaagtttgcagtgagccaagatcccgccacagcactccaggagactgtgtctcaaaaaaaaaaaatagtagtgagtgtaaatgtctatatcataacaacgtgttctaacaaagatctgtcaaccatggataatccagattttatttggctagtataacgttagcataacaaccagttgcaacatgtttcttcagagcctagatttttaaaaaatctataaaaggcaggtatagggcaattagagagatttaagaagaactatagactagaggatataattgcatcagtgctgaggttcttgggtctaataatggtggtgtgtcatgtaggaatatgtactggtttgtgcatacttcaaggtttaggggtaaactgtcctgatgtccacaacttttttccaaatgaatcaggaaaacaagttttatatggatacatctgcagagtgagaaagtaaaaaagcaaatatggcccaggcgcagtagctcactcctgtaatcccagcactttgggaggccaagggggggtggatcactgaggtcaggagttcgagaccagcccagcaaatatggtgaaaccctgtttctactaaaaatacaaaaaaatttgccgggcatggtgacgagaggctgaggcaggagaatcgcttgaacccaggaggcagaggttgcagtgagctgagatcacaccattgcactccagcctgggccacaagagtgaaattccatctcaaaaaaaaaagcaaatatggcaagctgttaaccactggtgagtctcggtgacgactaaacaagtgtttatcgtactttcccttccattctttgatggatctgaacattttcaaaacaaaatgtcagagaaagaaagtatcattaaaatgtttaaaacagaaaattcgaagaaaaataatcccactgcccaaataattctataaaatatttgttgcttactgcaggaaaaaaaaataggcatcaaaaaattaaaaagccaggcatggtggctcacacctataatcccaacactttgggaggctgaggcgggcagatcacctgaggtcaggagttcaagaccagtctggccaacatggtgaaaccccatctctactaaaaatacaaaaattagctggatgtagtggtgcatgcctgtaaacccagctactcaggaggctgaggcgggagaatagcttgaacctgggaggcgaaggttgcagtgagtggagactgcgccactgcactccagcctgggcaacagagagagactccatctccaaaaataaataaataaataaataaataaataatttttgctatttaacaattgatttaaaaacaagtgagtaatgttgtgctactgctgccatgtttcatgtaccccaaaagggaaaatatcctaagagaatctttcctcttaataaactaatgtttaggcaaacagataaaaataacacttgaagaaaaaatctggttggctcatgcctgtaagcccagcactttgggagaccgaggtgggtcaataacctaagcccaggagttcaagaccagcctgggcaacatagtgagaccctatttctacaaagagagaaagagaaagagaaggagagggggaggggggaaagggagagaaggggaaagggggagataggaaagagacaaaagaaaagagaggaaaaagaaaaagatctatcatataatttcttagtggtagaattaaagaaaaaaaaaaggatgtggttcccaaaatgagggcctatacaaacacaggagacatgatgaagtttgaaaatattctatccaaatattctggtccccttgtctctgtgtcactggagagtggtagaatttccaggcaggttctatctcctttcccatagatagcatagcccctgaggctccccagagaccctccgaagtcctgtgattgcccattcaggagtgtgggaccaccaaacactactcaagaccagcatggcttcaaggaagctttggcctcagggtagctgctgctaccacaagcaccttcctcccaggagccagaacagccttctccatcagcgcaggtgaccaagtggcacatggctcacttggccaccacgcttaggccaaagcagccctgcatgtccccatcaacctggcctccccaaagacctggattctgtttccacatctccaccctctaccacacgtggactctgcagttccctgggacttcacttttcttggagaaggagagagaaaaagggaagcaaatcctgaattgctcgtaggatttaaaaacctctccacagaggggagctggggacaaggtaggggagacagtgctagcagcacaatctgaggacgggtcccctgccagccctccgggcacacagggagcaaaaggagaggcagaggcacatgggagcaggggctgggagatgctgcatggcgcaggctgtgggcttggctattaaagccagaaaaggcctgcctcctcctgccaatagagttatcttttaatccgaaccccaatgacaccacctggcaccagcgcaggagcagctcctgacggcacacgagtcacgcggctgggccccgcgtctatcccttcaggtcagggcttgccctgagtgctcctgaggaagtgggcccctgccccctccatggcctggctcctgacaggcctgtgcatgcctgagagggccaggcaggcggtaaggaagtagaggaagctccgtgctgtgcaaggtcaccaaatgctagatgcaaagacccagaaagggagggcactcacccaaagtcacccacgccgggacggggcagcaatcccaggattctcctcctacccagatgcggcaaagaggtttgcagcccaggacagctgttatcaactagccagtgctggaaaacagcaggtagcaccccagacctgccactctccacgtactcagacaactcatggcccaatctgaagatggctttcctctgaattctcccacatctgtgccctcctgcagggcttggtttctgaggtcccatccgccttgaagttggcaagggctagggtagcatgtaacctatctccctagtaaggatggcactgactctgctgtggcagcatccaggccaggcagccatccaggccctcccagactgggggagctcagcacctccagaggcagccacctcaccacagaccaacacaccctgctgcagcgttcttccttgtgggcaatggaaatctgccagcaggaactggtagcagaaaactccccaaagcctgctccaattctccaccccagtacaatgggcgtgccctcaggattccaacagccaagggcaaaatcccgactcactggcttgggactctgggcaagtgacttactctctctatgcctcagttccctcatctgtaaaatgaggagagtagtggccttcatcttagagttgctgggatgagatgatccttgcaacctcccggggcacacatgagtggtcaacaaatgctttctatggctacactacaatgcacagttccacaggctcaaggcccagctttctgcccctctcctcatactcattccactttctcatgaccagacttgtgctcagcaagtgtccactcctataggttcgctcaggggtagctggctcaccagggacacattttaaaccctggcctcttcctccaaaacttcagctcagagccttggcaagccatccctgccgcccactggagatggctgacgagaaaaccagaaagagaccatgaaagaggaaggctcttctcactcctcactcatccttatcttggaccagtatcctccacacaacaccaacacccaaacataacagcaaatggatataatcttatcaatttcatcctccacaaccttctacggctccctctggcctaaagtcaaaaagccttaccccagactttaaaaggaagagataaacacttagtgaacatttgactatgtgtcaagttctctgctctacagtgtatatatattatatcatttaataactccctctaaaattcgtcttattgcttgcatcttacaggtgaggaagctgaggctccaagacactaggcaacttacctaagcgtcacagctcagaaacagaagcagatttggaggccagatctgggaggccacaaggctgggtccttggcacagcctctacctcctctccaggtcatctcctgcaacccctccctgacccagccactgtccagtcaccacggtgcccatggtcacctggcacacctggctgtgtcctacattaatgcatatcctcacgcttctgcttctcctgcctggaacgcacctacctatcacctaatgaacttctactcagcccagaaagctctgctctcaagttatctccttcaggagacagaccttcaccccggggcccccttccataagagaaaaacgatcccctttggctgggcatggtggctcacgcctgtaatcctaacactttgggaggccaaggcgggtggatcacttgaggtcaggagtttgagaccagcctggccaacgtggtgaaaccccgtctctactaaaaatacaaaaataaagcctgggcacagtggctcacacctgtaatcccagcactttgggaggccgaggcaggcatatcacgaggtcaggagtttgagaccagcctgaccaacatggtaaaaccccatctctactaaaaatataaaaattagccagatgtgatgacatgagcctgtaatcccagctactcaggaggctgaggcaggaggattgcttgaacccgggaggcggaggttgcagtgagccaagatcgtgctactgtactccaccctgggtgacagagcgagactccgtctcaagtaaataaataaataaataagcaagcaagcaagccgggcatggtggtgcacgcctatagtcccagctacttgggaggctgaggcaggagaatggcttgaacccgggaggcagaggttgcagtgagccaagatcgcgccattgcactccagcctgggtgacagagtgaaactccatctcaaaaaaaaaaaaaaaaagaaaagagaagaaaaaagaaaaacaatccctttccttggatgtgtttcccaagcgcccacagcaaggcacaacttatcagtccccaagtcagctgtgctgccgtctgctccctaatgtggaccattcatcctgactactacagcacagtacgtttacttgaagaagtgaataaatgatgttccttctgacttacagaccaagaaacagggccgtcagagcagacttgacctttacagggacaactggtaaacagcccatctacagtagcatcctggaggttacacctggcaaagagttaccccttggctgggtgcacctgagcaaacccatctggactaacgccggtgtcaggaagtagcacatccacacagtgcagctatggccctctgaggaaagactgctgcatcgcatcagaaaggcagcatccgtgacttctgcggtccacgctgacgggtggggaggcaccttggggcctccttcccgcactgcagacaatggctgggaagcccacaccccagcctcctggcactctcacttctaggcacaggatgcagcaacccctggcaaaagcagctcctctttgctgacctggacataaggacgccaggacccacagtgggcctgagccaacagcacccggctccaacggtggagcagcccaaggtccccctggggaagggctggaaagacgagctctctgtcctgacccacttctccctgcacactcttcccagatctggcctggcccagccagaaagccaactatgagatccttctcatcttatgacattagtaagagaaatactcactcgtatgctggtattagcacattagactccccaaggccactcccactttacagaggaacaaagtgacacccagagccaagtccctaaactgagctcctctcactcgctgccaccgagctgcactcacaccacagctctcccttagagggaacagacaggtgtggtctctgtctcccttccaggacaggcttggacactgaggagatgccgtgcctatttcccaaacaccgagtaaaaggaacccctggggtccagcccacacccaggttctgattcacagacctagggtgaggccaaggggtttaatctttcagaagcttccccagtgactctgaaaaagccaatccaaagactgcacccggggaaccccaagcgtgaacccaggactgctgtttcagcccagcaatttgtatcaacagccgttcaaagtccacaccctttgacccaacagcaccacttctaggaattcatcctgagaaaataaagaagcatacaaagatctatagcatgaggtgatgcaccgcagcattgtaagtacagaaaaaatgggaaatctctacatctccaatcaagaagaactggtgacataaatctcaatcaggcaagactgtgctcccattaaaaacgagccattgagggccgggcgcggtggctcatacctgtaatcccagcactttgggaggccgaggtgggcggatcatgaggtcaggagatcgagaccatcctggctaacatggtgaaaccccatctctactaaaaatacaaaaaattagctaggcgtggtggcatgcgcttgtagtcccagctactcgggaggctgaggcaggagaatggcgtgaacccagcaggcggagcttgcagtgagccgagatcgtaccactgcactccagtctgggcgacagagcgagactccatctcaaaaaataaataaaaaaataaataaataaataaataaataaataaacgagccattgagcatccctcattctgggcgacagagcgagactccgtctcaaaaaataaataaataaataaacgagccattgagcatccctcattcaaaaatccaaaatgctccagaatcccaaactttcagagcatcaacatgagatagtaacacctttgcattctgatggttcaatgtacatacactttgtttcatacacacaattatttaaaatagtgtataaaatcaccattaagcagccgggcgcagcggctcacgcctgtaatcccagcactttgggaggccgaggcaggcggattgcttgaggtcaggagttcgaggccagcctggccaatatggagaacccccgtctctactaaaaatacaaaaattagccgggcgtggtggcacgtgcctgtagtcccagctactcgggaggctgaggcaggaggactgcttgaactcgggaggcagaggttgcagtgagctgagattgcaccactgcactccagcctgggtgatagagtgagactctgtctcaaaaaaaaaaataaaaaagaaaaataaaattaaaaatacaattagccgggcatggtggtgggcacctgtaatcccagctactggggaagctgaggcaggagaatcgcttgaacctgggaggcagaggttgcggtgagccgagatcgtgacactgcacttcagcctgggcaacagagtgagactctgttttgaaactccatctcaaaaaaaaaaaaaaaaaaaatcacttttaagctatatgtagaaggtatatatgaaacataaatgaatttcatgtttagacttcggtcccatccccaggatatctcattatgtatatgggaatattccaaaatccaaaaataatcaaaaatcggaaatacttctggtcctaagtattttggataagggatattctgcctgttacagcatcagacctaaaacttggagcccacttcaattagtgcaggaaggactgcagatggcatctacatacaccatgaaggtgatagaactccttccctgacatggctgaggttctacttgaatattcccagaaaacaagagctctcgcaattccttaacagtggtttctggcaattaaaaggctgctctaagtcaagtgtggtggtgtgcacctgtatctcagctactcaggaggctgcagtgggaggatcagtgggaggataacttgagtccaagagtttgaggctgtagtgcacaatgatcacgcctatgaatggccactgcacttcagcctgggcaacatggcaaaacccccatctcaacaaaaggaaaaagaacatgttgctcctctcattctgtcttgctgccaccatgttagaagtgccttttgccctccaccacgattatgagacctccccagccatgtggaactgttcataggcggaagggacttgccttgtctcagatgagactttggactgtggacttttggattaattctgaaatgagttaagactttgggggactgttgggagggcatgattggttttgaaatgtgaggacctgagatttggaggggccaggggtggaatgataatgatttggctgtgtccctattcaaatctcaactgaattatatgtcccagaattctcacgtgttgtgggagggacttacggggaggtaactgaatcataagggccggtctttcccatgctattcttgtgatagtaagtctcgggagatctgatgggtttatcaggggtttccgcctttgcttcttcctcattctttcttgctgccacattgtaagcagtgccttttgccctctgccatgattatgagacctcccagccatgtggaactgtaagtcaaattaaacatcctgttcttccaaataaaaaaaaaaacaaaaacatgttgctcctaatcctgagcagagttttactttcctgaaggtaaaatctcctggctccggccgggcgcggtggctcaggcctgtaatcccaacactttgagaggctgaggcgggtggattgcctgaggtcaggagtttgagaccagcctgaccaacatggtgaaaccccatctctactaaaaatacaaaaattagccgggtgtggtggcaggtgcctgtaatcccagctactcgggaggctgaggaaggagaatcacttgaacccgggaggcagaagttgcagtgagccgagatcgcgccactgcactctagcctgggcgacaagagcgagacttcatctcaaaaaaaaaaaaaaaactctcctggctccttgtcatttttaaaaatattttcatagagatgagttgtcactgtgttgcccgggctggtctcaaactcctgggctcaatcgatcctcccacctcggcctccaaaagtgctgggattacaggcatgagtcacctcatccagcccatcttcctgtcttatgtagtatcacaagctcaataaacacgtggaatggagtggttgttttcctagaccattcatactttttccactatggccaagatgagaatatgggtttttacaagcactgctgatgcatattcacaatgccatctttaaatcaagtgtttgcgcacctcttccttccacaatcacctagctaatcatccttgtccctacgttaaaaacacccttgtccctgctgtgtcaactatcacatgacctgaagttgtccctccccacctggtgaccttaacagctatgtaacagcatgggtaactctttaccaagaccatttctgggtgaacgacctgcctgaggttgccagctcagccaaggcacaaggtgccacagagttgagtgatggagcacagccaagaccctcccctcaaagacagcactaggatgggaaagagatgtatttatttcctcttctctctctcgtcttatttatttccttttattcccatttccctcccctcacccacagtcaaccattctcttgtgttaatctgttcatattcttgcaagatgggtattgttctatatcagcaatctacataatagcactgcaccatccatgctctatttcttatgttttcactgagcactgtgcatttaaatacatcatgctgcctgccacgtgtgcttctcaccagtcacttggaattgctgcaagggactacagactcatacccacccattatacccatttgctctgcaggaatggacatccagctctacctcaccaccacaaacaacactgcagtgaacaccctggaccttccccttaggacctgcatgagaacctggggaactgacacccatgggaggggcttctgggtcagggctttgctggtaccctgccagaggctccaggacagctgcaactgcaaaggcaagagttcctgcatccccacacccactgctgataggcagcatccagctttctagttcccaccagtctaagaggtgaaacaggatcgagctcaaggttgtgttccagtatggattcttaccaaacctgactgaaccgtacctgctaagggaatggcaggaaaagcacttgtaccgtaagcatcactggtgtgaaatggaaacaactgctcattgataagtctccactgtgaggcctcactttcttgaatcgtcagggacttctggaacacaaatgtcatgcactggcctacaaaatgccatcaatcccaccttctcccactggctgaggctcctcccaaggaggtcgactgttcaggatgggcagcaacagtgctgcgctccacttttttttttttttttttttttcctgagatggagtctcactctgttgcccaggctggagtgcagtggcacaatcttggctcactccaccatccacctccccagttcaagcgactctcctatctcagcctcccgagcagctggaagtacaggcacgtaccaccatgcccagctaatttttatatttttcagtagacatggggtttcactatgttggccaggttggccttgaactcccgacctcaggtgatccacctgactcaggctcccagagtgctgggattacaggtatgagccaccgcgcctggcccagagctccacttttttatttgcaatcacatcatccttctattgatgacttacctgcagctcacactacacaccactcaccacgtgatctgacaacactgaagcagtctatacctgttcaatgagtactagcaaggtcaagttgctctaaaggttgctaaacactcaatctctgtgcttgcttacttcatcacagaccaggaaccagaagattgcaaaccagcactggtctgtagaccacaccctgagttgggggtagagtagggagaaacaaaccaaccaacccgccctggatgtcatggctgggctcctgcccccctatgccacttaaacagccatggaactgggacaatcataagaatgaaaataactgggccggcgcggtgactcatgcctgttatctcagcactttgggaggccaaggcaggcagatcactttagcccagaagttcaagaccagcctgagcaacatggtgaaaccctgtctctataaaaaatacaaaaagtagccaggcacagtggcatgcacctatagttgcagctactcaggaggctaaggtaggataatcaattgagcctgtgaggtggaggtggccatgagctgagatcatgccactgcactccagcctgggcaacagagttataccctgtctcaaatacacacataaatatagcagcttacgcttacacagtacttaccatgtgccacacactgctgtcaacacttactaacttatttaaccctcacaatacaaggtcctgttattatccccattccacagatgaggaaaccaaggcacagagagagaaagcaatttggccatggtcacggtaagtggcagattcaggattcaaacccagtatcttggctcaggtacaggctcttaattactctcctaaactgactcctgagtaacccggccttccttacctgtttcctcacttgtaaggtcaggtaaggacccctaaaaggttgctggtgagatcaaatgagaaaataaatacaaaaataataaagtatcctatgcaacacaacacctaccacctacacagcatacaaccacccatgtgtggccatgaacctgcagcagccacctacctttcacacaagccacaagagggcgagggagtcacggatcccactgcagaggtgaggacatgaggcctggaaagcagaggtaccctcagccccctctctccttagccatgctcttctcctccccaaagagacagccacaacacaggaacatgtcccacactccccagaggacacaccaactctatttccaaacatccccactgtaactctcagagttgaaactggggagaacgctggctttccaatcctcctagcaactcacagacagccagtcagacacctcaggggatcctgggaaggccagccagtctacatcctcacctacccacctgcggccaccgggtcctccttcacacatcacagaccacccatcagcctcccacccaatgccaacccaacccattcccctctccagccccagcagcctcacaagagaaccagcccagagagaatgactggaaggacagcagaggctggttggcctggcctcatttttccagcacctgctgagcgaatgctccaatcagaagccctgaattaccagacaaacccgccagtcacagaatggattctctcccaagtcctgctctgtgctctcccctcgccaggtctacctccctccttccagccgcctgcctatgcccagctcaccatacaccctccttccttaggcactgaaacttcaagcagcctcacctgtctggcactatctgtactactagatacccacttgttcaagttttccaacaagacaataaactcctggggggtggggggagagaagccatcttctttgttgcccttctgagaatctgatggatttttagacacaaaaacacttgccatgtgctataaagcacaaaatggaaggtgagaaggaggaagtcagtataagctaggctgattattttctggtatttctaaaagctccacaatagagcaattaaaaaggaaaacctttgaaacacaacagcaggatatatatgttccagctaaaagaacgaatccaggttggaatattgttcatggtagatatctttccatctttgcatgctcagcacttagccgagcctggtaaagagtagtgaccaggtacttgctggagagatagacagataaactcttgtcagaatctgggctccaccctaaagcttgtgttatctcatgcaaggagaagacactgtgaccagctccactgagttctcatgagaagcctgaagatgagggaggttacagaaaaccaaatactgcatgttctcactcctaagtgagagttgaacaatgagaacacatggacacaaggaggggaacatcacacaccagggcctgtcaggggtgggggtctaggagagggatagcaacagaagaaatacctaatgtagatgacgggttgatgggtgcagcaaaccaccatggcacgtgtatacctatgtaacaagcctgcgtgttctgcacatgtaccccagaacttaaaggtattaaaaaaaaaatgagggtggctgaggacaaaagatcaagactacatgaaatttcacaacttcccacagaaacaaggacagctggtcaccgttttgttctctctccctgggctcacaaaatcgggggaaatgcaacaagatacagaaaggtggtttgccattttctagcaaaaatgagtggggggatacataggcgcatatatactcacacccacagcccctaaactctaaaccgccatgggtttagctccgtttttttcaggagaaggactcaaaaccagcacattttggttttgtttactttcctgctttttcttggatccagctcctactgagattggctatcagggtgggtcccaactcagtgtccacggggccttatcctcttatctttataaaaggcttttttccctgggacaagaggcccggtggcctcattttcctgcctgaactctgccctgtgactaagcaagaagaagccacggcagccagcacccagagtttctgctgtgtcacaaaaaggagtcatgggtctccctgccagcatcagacccattccccgactcagcactcaatttagatatcacgtcctacgtctacatccagaaagcccccagtgtgacagatgctcagaacacatctgctgaatgaatggacgaatgctgtgacgaagagaggtggagaggtaggcaaggctcagaccacagaaatggtcacagggtggcctgcagtaccgagtaaaggtagtcattatcaaaaaactgacaaggactccagggcttgcctagcctctcagcagctgatggccctgagcaggctaccaaactctactggccgagtgtgcccatctgtaaaagataaatatcaattgcagaggctgataaaagatttttttcattgatcaggaattaaaggctgtagctcaagtccagaaactgggatgctgtgtcacttgctcaccctcactgtaaaggctggtgcccacaaagccaggagaatgtcaggaaaaactagccacggatctgagacttcccacccagcctgctcctggtaaagaagtcttggaaggaaccccagcctgggaagagacctgtttctcatttgtaaaataaggagtttgggcaaagtggtttctaagatcccttccagccatggcattcaacaatcataggctccttaagaaatgtaggccgggcgtcgtggttcacatctgtaatcccagcactttggggggccaaggcaggtggatcacctgaagtcagagtttgagatcagcccgaccaacatgataaaacgccgtctctactaaaaataccaaaaattacctgggtgtgatggcacacgcctgtaatcccagctactggggaggctgagacacaagaatctcttgaacctggaagtcagaggttgcagtgagctgagactgcaccactgcactctagtctggagtgcagcctgtgtgacagagcgagattctgtctgaaggaaaaaaaaaaaaaaaaaaaaaacataaacaggaaaagaagttctggtcagatgagaagaaaggttacttggaatgagaatagaggttaccatgaatactgaaaaggccactatatattttttttaagaattaaagtgttttattgattgattgattgattgagacagggtcttactgtccacccaggttggagtgcactggcccaatctcagctcatgcaacctctacctgtcaggttcaagggatcctcccacctcagtctcccaagcaactgggaccacaggcatgcgccacagctaatttttgtattttttgtacagatggggtctccctatgttgctcaggctggtctcgaactcctgggctcaagcaatccgcctgcctcccaaagtgctggaattacaggtgtaagctaccacacctagccagaattaaagtattttaaagtattacttcttacgttaaaatatgtaaatagaattagattttgtttcctttgttttgctatcaccttcctcaatattggctggaaagatctttactacatttggatagcagattggcaatggtcaaatatgtgcagatttaatttggggactcaggggtcatcttagagccagggaggtaccattcagacaagcaaactggggtggactctgaagaagaggtttgagaggcatgccacatctataaaaatcctgttggcagggaaaacacaccctggcttgaggtggccaccagggcagcagctctgagtcagagatggccatctctaatggcaccgctttccacacgggcagccctgcagcccccacggcaggctgcatgttagcaggagcttgtttacgcataaaaacgaacagttctcttatgcaatagaggggtaaggcaaacaagtgataacattttcttaaaaaaaaaaaaaaacaggctgggtgtggcaactcatgcctgtgatcccaacactttgggaggctgaggagggaggatcacttaaggccaggagttcaagaccagcctgggcaacacagcgagaccccatctctatgaatttttttttttaattagctcagcatgatggtgggtacctgttgtcctagctactcagggaggctgaggcaggaggatcgcctgagcccaggagttcaagattacattgagctaggatcatgccatcaatcatgacagcatgggcaacagggtaagaccctgtctctttaaaaaaaaaaaaaaaaaaaggttaatttttctatttatatctatctatcaatttatttatagagatggggtagggtctcactatgttgcccaggttggagtgcagtagctattcacaggcatgaccccaccactgatcagcatgagagttttaacctgctccatttctgacctccttaggcaacctggtggtctcctgctcccagggtcaccatattgatgccaaactggccacctgattagcatagcacactacagcccagaactcttgggctcaagcgatcctccctcctcagcctcccaagtagctaggactacaggaacatgccagcatgcccacaagaataatttttcaaaaaaaaaaagtaaccactgctcactgcaattgaccttctgatgggattttcactctgctcctccccacatcactgtcctggttaacagagagtggtttttactcgccacaaagtggctatgtgtcttttttaaaagcacagttcatcccaagaggaaacctacaaaggaagcaggtgaagacaagagtacccagtgaaaacaccatctgcagcctctggctccagcagtggctcaccaccccagctcagctcacgcaaagcaaggtgaggctttcaggtggtgcttccctctcccacatggggagcatcttaaaccaaaagcaagcagaccagtggttttcaaactgggttctgtgaactgtggagaaccccagggaaacctgtggaggagcctcaagaaggccacaagctcaagggacaagctccaagcccatactccccatcagtgcctctctcgtctaatttacagatctggctctcacctaagagtgcagttaacaaaaaagacctcatggctaaaaaaaataaaaataaaaaacttaagtcataaaagacatttacactttgtacgtgttatttcatttaattgtttgcatcagccctctgaggaaaccatggctaaacagtttcaggattgcaagtcgccacctagaacagtccactccagagctggatagcaccaatcatttttaaaagttcttcctgaaacaaccggcctgggcaaggggagctgccagggattataaaacagacttcagagacaacatcaactaaatgcagtgggtggcccttgctaaaatcctgattttaataagccaccaataaaatgacatctttgagacaagcaaaactgagcatcacccgggcaacttgataacattaagaaattattattaatgcctcatctcttagagacacatctttaagtatttataagaaaaatgacatgctgcctgggatttggttgggagagatgggtgattgttacattatcctctctgttcttccacatgtgtgaatgtctttttcattttttacttttttagagctggggtctggctctgtctcccaggctggagtgcagtggtacactcagagctcactgcaacctcaaactcttgggctcaaccaatcctcccgcctcagcctcccgaatagctggggatacaggcagtgtccccttgctcagctaatttttttttatttttgtagacatggggttttgccgtgttgcccaggctggtctcaaactcctgggctcaaggaatcctcctgtctcgacctcctaaagcgctgggattacaggtataagccaccatgcctggctcttgaaagtctttaatagaattttaaaaggaagaaagacagggagggagaatggttcttccttaaaatgaactcaattctacctccaagtaccttctggcaatcagaccatgttcagctttctgggatcaaagagaatcaggtcttatcacataccctgcaccatctgaaaatgagcagcatctaagtccctctaagtatcctttcctcaaaaacaagctcttcaaggtccttttggaactgaactcacaggtcacagcaatgccctccttaaaaatgtgggcttcaggaccaaagaattgtgaaggtgtcttttgagcagcccagagaagcatgggcctcctcgtccactgcaggcctctgccttgggcatctcccatttgaactccaagtatggcctatgccctgggatgcctcctgattccatgcacaggctgggagcttgttctctactcagggacaagctacccccagtagctccagaggcggcagcagcagcttgctcctgtctcacctaaatcatctccaccctcaccaaagccctgggtgaatattattagcccctcttctacagatggggaagagaaagcaggcccaggaggttaagcgacttgaagtcacacagcttaggagtaaagagctaagatttaagccccagtctgtgggggtccccaagagtggactcatgacattcagatgtctccagtcccgcagccttgctccctggctccaaacccaccaagaatgccccctgggtcattcatccatgtccttctcctcccaggagtaacataacactctgaaagcagagaccaccttccccacctcctagcccagaacctcccaggggctcagcaaagagttgcccaaaacttaaccagtcccagacctgcagccgccaaaccaccaggatggctctccacaaatctttccaaggctctcccagaaaccccaactgtggcccaaagcccagttctcttcactcatttctagtctctagagcaattcaaagaataatgatcacaaaaccaggcttcattcttggcgaactccataggggaaacaggaccagagaagacacacatctataaaataatgactactagccccagaatcacatgtgactatttcagctggtatcagaatttaaaagactaggggctgggcacggtggcttgcacctgtaatcccagcactttgggaggctaaggtaggtggatcacgaggtcaggagttcaagaccagcctggccaagagagtgaaaccccatctctactaaaaatacaaaaattagctgggcgcagtggcaggcacctgtaatcccagctacttggtaggctgaggcaggagaattgcttgaacccgggggacgaaggttgcagtgaaccaagattgcaccactgcactccagcctgagcgacagagtgagatgccgtttcaaaaaaaaaaaaaaataggaacgtttagtgttttggtactctgaatgagagggctaggggaaacgtaaaaaaatgatggtatacgttgatgctccagtttcacacattaatgttttaatttcccaaaaatgcattcctcagaacactgatgtcgcaagatgctccatgataaaggactctgtggttaaatcagtttgggaaacactgcctaataaagccactctagtgaagccccaaagcacactggcttagccctctcaaggggcctgcagaaaagaacctagcactgcctggatgcatttgaccacagaacccttttagggcatagcaacactaacatcccagcaaactagcagttagaagatgtttctttgggaaatgctgatctaggccttttgaaagaaagtctcaatagccttgttatcccggatttgagactgaaaaaccaaaccaatcctaaacgggataaggaggaagtatccaaagagcaaaaataacgaacatgcttcaaggcctttagggatgaagatgtaagtactgaaaacacaaagaaaatgtgtgaacattccttggctgccagatatgaatgccactaggattgtttggttaatgtctggcctccaaagagtcacatgtaggacaggtgtggtggcttattcaataatggattgtttgaggccaggagttcgagaccagcctgggcaatatagtgagaccttgtctctactaaaaataaaaaaaaaattagctgggcatggtggcacacgcctgtagtaccaactactcaggaggctgaggcaggaggattgcttgagcccaggaggttgaggccacagtaagccatgatcatgccactgcactcagcccaaacaacagagcaagaccctgtctcaaaaaagaaaagagtcacagataactactgaactgtcctaagactttccaaaccatatctgaaggaagaaaaaaaatttttttttttgtaagacagagtttcgctcttgttgcccaggctggagtgaaatggcacgatctcagctaactgcagcctctgcctcatgggttcaagcacttctcctgcctcagcctcccaagtagctgggattacaggcacacaaccaccacgcccggctaaatttttgtatttttagtagagatggggtttcatcatgttggccagctagtctcgaactcctagcctcagatgatccacccgcctcagcctcccaaaatgctgggattacaggcatgagccaccacgcccggccaaaaacaatttttagaagaaaaaaaggaaagaaaatgctatccacccccatgtcagggtgctgtgaacagtatggatttccttaattaaaactcagagtaaacagtatggtaccttctcaaaaaattgaacacagaattaccatatgacccagcaagttcacttctgggtataaacccaaaagaagagaaagcagggactcgaagagatatttgtacacccatggtgtcatagcagcattattcacaatggctaaaaggtgaaaacaacccaaatgtgtccatcaacaggtaaagaaacaaataaaatatagaatatatatatatatatatatatgaatattattcggcctaaaaaaggaattttgacatatactaaaatatggatgaaccttgaggactttatgcttagagaagtaagccagtcacaaaaagacaaatctgtattgacttcacttataaaagatacctaaagtagtcaaattcctagaaacggacaacttgagaggccaaggcggccagatcgcttgaatccaggagttcaagaccagcctgggcaacatggcaaagccccgtctcttaaaaaaatacaaaaacaaaaaatcagtcgggcatggtggcgggcgcctgtagtcccagctactcaggaggctgaggtgggagaatggcgtgaacccgggaggcagagcttgcagtgagccgagatcgcgccactgcactgcagcctgggcaagagaacgagactccatctcaaaaaaaaacaaacaaacaaaaaaaggagctgggtgtggtggcatgtgcctatagtccctgctactcgggaggctgaggtgggaggatcaattgagcatgggaggttgaagctgcagtgagccatgagtaccaccgcactccatgcattccagcctgagcaacagagtgagactccatctccaaaaaaaaaaaaagaagaaagagagagagagaaagacagcaagaaagaaagaaagaaaaaaagagacagacaggaaatattcatataatggtgactgtcaaggtctagggggccatgtagttattattcaataggtacagagtttcgattttgcaagatgaaaaatttctagagatggatggtgctgatgtttgcacagcagtgtacaaatacttaatgctggctgggcgcagtggctcacgcctgtaatcccagcactttgggaggccgaggcgggtggatcacctgaggtacggagttcgagaccagcctggccaacgtggtgaaaccccgtctctactaaaaatacaaaaattagccaggcgtggtggtgggcacctgtaatctcagctacccgggagactgaggcaggagaacccaggaggcggaggttgtggtgagccgagatcatgccattgtactccagcctgggcaacaagagcaaaactctgtctcaaaaaaaaaaacaaaaaacaaaaaacttaatgctactgaatttgtacacttaaaaagttattaaaatagtaaatgttatatatatttttccacaataaaaaatggttcaaggccgggtgcggtggctcacgcctgtaatcccagcactttgagaggccaaggtgggcggaccatttgaggtcaggagttcaagaccagcctggccaacatggggaaaccttgtctctactaaaaatacaaaaaaattagccaggtgtggtggcacatgcctgtagtcccagctacttgggaggctgaaggaggagaattgctgcaactggggaggcgaaggttgcatgagccgagatcgcaccattgcactccagcctaggtgacagagtgagactctgtatcaaaaaaaaaaaaggttcaaatggtaaatttcatgttatgtaaattattatcacaattttgtttaaatcctcaaagcaaatgggttatgagccttagtgtgaaatgaacgtcaaggtcaacaggaattatctaccaagggtttagagggatagactgccaacatgggacgctccaaacatctctatttggtttaaaatgtttctgtagcacttttgtggaacgcagtctcaaaaagatcaatagagatacaccgttcagaggaatgcagtctatcccaggtaaaaggcgaaaaaaaaatccaatttccccccagcgcaatcccatttaagattcttccctgctgaacacacatagcatccctactgtccaggccaacacgcagctcagccctctttctctatgtttgctacctctgtggctcacatcttcccagggtttcaggaaacgactatagagccccctcgcatggggcagaacatacaggtggttggaatgaggtgggacaaaaaaaaatgagacaacggccgagagtggtggctcatgcctataatcacagcactctgggaggctgaggtaggcggatcacctgaggtcaggaattcgagaccagcctggccaagatggcaaaatcccgtctctactaaaaatataaaaattagccgggggtgatggcacacacctgtaatcccagccactcggaaggctgagacaagagaatcacttgaacctgggaggcagagggtgcagtaagctgagattgcaccactgcactccagcctgggcgacagagcaaggctccatctcaaaacaaacaaacaaaaaaaaaactgaaacaaaatatttatcctactctgcttactttttcaggaaatggaaaaccagagtatcaaaaaccactcaacactaacattaaatcagattaacagcaatcctgatgtagagctggaagggcccccaaaatcgagtccaacccaatcacccaacctccttggaccaaatgccacctgggaagtgctcaaaaccccacaggaatgagcaagtctcccgtcaatgctcaacctcttctgttttgactgttgaactgggggaaaaaaaaaaaacaagcaccaggaagctaaaaggctctgccaaggtcaagattttgcagttaggaacagatctccagttcagggcttttttttttttttttttttttttttttaaagaaaagttcctcagtattcttttgaggacatcaagttgacattcaaattctatgtgtagaaagggaatgactttctactcttagacagcgtgggtgctccacatggctcctggcagccagctccacaccaccagtacctgatgggcaaccttgggaacttcagacatcaatgtcacaccacctgcttccatcacagacataccgtgggcggtgatatccctgtgtacatctggggcttgctcaagccttcctcctctcccacagcctctgccaccatgaggtcaccacttaggaatctgcatgtatatttgaagatgatctggacaaggatacatcattcactctacacacagctgactattcattcgttcaacaaaaaattatcgaacacctatcttgtactaggctctattctgggcatgaggactataacagcaaattcagctcagggaggacagctctgacacctgcttggcatagtatacaaggagctcccacagaaccctcagaaacaccaggagattcccagttttctggttctaaggctagttgctgtctactactgccactgttgtgctatattactcagggtaacaaaatgctcttccatttttcctaccatggattgtcaaatagcacagtgaagtagttagtgttttaattactttgtagaggagataagctcagaagggttaaaaaccttgctcaaggtctaaaaccttgtaaggtctgatcattactacctagacccaccatcccactccagcaatgaccgcctgtgctaactgtattatcgcacaaaggtggtaatgcttggagtggacattcatctgctcttttacctgcgtgacatcgctgctgcttgtcttcctttagacaactgctctgcctccctctaaaaacccacatagtgttggaatgggctgccaatcacagtagcccatcaccttaccctggggttccactgctgggcacagtgccaaagctgagccagtcttagtcctctagccctggccacagtgaccgggcctcatgtggacacataacactggccagaccaatcagaatcctaccatgaggtttgtctgcctgggctgattggatagagctccctttcttccctggtcaggggctgtgaacctgaacagaggggcctgaggtcatgttcagacccgtgggaaaagcccacagcatcgatccaagaggtcaaacgtcccaaaggccagtttccaccatccatccaaaggttgtggaatattctaagtcaatacatttctctttttctacctaagatgatctgagctaagtttctgtcattttgcaataaaggtaccctgaaatgatacacagataaaatctgcccttcacttaaaaacctcttctcaaccattaatttcaaatgactctgccacttcctcttaaataacacaattaaaaccacctaaattagccatgcagggtggcatgcgcctgtaatcttagctactaaggaggctgaggcaggaggatggcttgagcccaggagtttgaggctgcagtgagctatgattgcaccactgcactccactgtctctaaaaaataagtaaataaacaaacaaaagaaccaaaagaaaaaccacaacagctggagcttttacttatgtcccttgccctgctgaccctccagggcagaggggatgaagaaaaggtggctggtacccgaaggaagtggagagagaacaaaaggccaggcaacctctgctgaataataaataacccacacctgacaatcagcacccatctgcattagtcccactagaaaagcctggcagggttattcccttggggaaaaaaaacaaacttccagctctaatttctgacagtgtacaatgcctaaattcaaacctcccactcagcctagccattaaggtcctccagattacctctgcatccccaattcccttccacccagagccaaggccaaacccctgctctgctcaggctgggtaaacacatggctcctctctatggctcagcctgtgcggtccagcctacgcagcccacacgtcctccctccatggctccatgcattcagagcttcacttcaacaccaagtcccagcacattcgtgaagctctcctcggcttctccagcggacgctgctggctccattctcttaagtttgatgaagcaagccagccagttcactaggaaagtaaagaggaggcacaggaggtgtggggagtgggaacgagaaggaaacatcaggcaatgagcacgcgagaggtccagccaagttctgccatttctgcctcccaatagaggcctggtgggaatgacttgaggagtcccacatttagatggtaatgagagccactaaaggtgaatgagagtatctggggaaagtgtgtagcataccgagttttttataaaagaaaaagcctgtttgtgcatctctatcagttgacctgtctcataatgtcactctcatgagcgtcccattcccccaacaaggcggcaagctacggactagaattacatcctgtgcaccccggcccctgtctacaccccagccccacctgggccaggcacttcaatgctcccggtgacagaggcaggcagtgcagcaccattagccccatcttacagatgaagatactgaggctcaccccaggggcagggagttgagaatcctcaagggaaaaaactcaggtgtttccccaaatcaaagggaaaaaacaaaggactgcatggggctccaagtgaccaagctagacttggttactgggaaaaacaagagacccaactgagccactcagaagtaaacaattctgtcttctccctaccaccagctggggcaaaggtgttcgcttgttccccgcagatccatgtatcaaatccgggacaaaagaaagctacataatttcagagtcccacagtgactggaaatgtcctgaaattgtagtgggaaggcctaaccagggaacaggaaaaaccaccccagacaaggaatcaggggcactgggcttggccttgactcaggcacctttctgccctgcgacttcttccttacagacagggccctggaaccaaagatcataagacaccactcatctccctggggctgccacagagttaatgagatatgaagataggacacaaaatcctgaatgacaatgccctatcaataccggaataagagccacacctccaacaaaaaaaccacaacacagtgtgtctcctagtcactccacacccccaggcctgagcgtggtaggtttaaatgtctggggatctaactcagcaagagttgccccgatgggttgggtttgctcacctgcccaccaacacccaggcacatgtcctccccagtttccttccagttccaggccccacgtggtaggctgctgccgatgcagactccctcagcacccaagtgccagtgggggatgggcattctggatcaggagcccacacagggtgtggaatccatcaaggaagctcctaggtgggtgatggcatcatctccaacagagaatcggtgccaaagcagccaccccttgacgctaaggatcccagggagccagctggttcctctctcaggctccgcaatggcctcgaactgaggccaattcaaacccagagctgctgcccagagcacagagtggaaatcactcaggagtggaaggaggcaggaccaagtgctgggttttcctgactatggctcctcaaggaagaagacttccattccttcagccagagccgctctcttatgcactgagctttgaccataaggaatacttcctggctaaaagaaaaaaaagcaaaaaagtggagacctacaacacagcaatttacccttcacaaaggagcctcccctgcgccggggcagtggctcacgcctgtaatcccaacacttttgggaggctgaggcaagcagatcgcttgagctcaggagttcgagaccatcctagacaacatggagaaatgccatctctacacaatatacaaaaattagctggtgtggtggcatgtgcctgtggtcccagctacttgcggggctgaggcaggaggatggcttgagaccaggaggcggaggctgcagtgagccgagattgtgccactgcactccagcctgggtgacacagtgagaccctgtctcaaaaaaacaaaagcccccaacacgccactgtttgctgacacaccatgtcaccctcttccccaggggcttcaggtggcatcttgccataccaaatgctgtcctaacttttttctttctttttttttgagaaggagtcttgctctgtcacctaggctggaatccaagggcaccatgtcaactcactgtaacctccacttcccagattcaagtgattctcctgcctcagcctcccaagtagctgggactacaggcgcccacaaccacgcccagttaatttttgtatttttattagagacggggtttcaccatgttggccaggctggtctcgaactcctggccttaagagatctgcccgcctcggcctcccaaagtgctgggattacaggcatgagccaccacacccaaccagcgtttttctaatgcattaagtaaaatgaacttaacttctccttgaaaagtatttttctaaggatttcatgaccctctccaaagtcacataactctgcattgtggtaaaactggggtctgaaatcaatgccctaggggataaaatccaaaccctaatctctgccttccttagaggtcaagactagctcctagaacttcagccccatgaggccccacattctccaccagacacggaaagggtgagacctaattaatggcaattgatccatcaatcaattttcagagattaaggcgagcgttgattcacatgcttcccaacgcagacttccagtctgtactaagttctgtgctttacgaaagactttcagaaacagatcttaacttcttcattcagagatagattagatagatacatagatacaattaaaaagaaaaaaattactttgttgagatcccctctgtccttatcctcatggccacatctgacagtcccttcctagcatctcccaaagcactatcccaggaaaggactaggtttgcccagtaactctgacatgaccacaactggggggaaagaatgcaggtttgagggacagagatgcaagtcagaagctcaaagtggagacgggagggccaccaatgaaatgacctgctgtgtggccagcaatttagtctctctgtcagtttcctgcagctacaaaaattgaggttaagatggccaacgtaagagagctgttaccaggaatgccttataaaatcattcccttaataagtggggcttttaacagccaaataaatgggtcccatcagcctttgaccttcaggttgctaagggcagtttctcagccctctcggttcacttgtttttcttttatacatatatccttatttatttttactgtacctatcgattcactgttaaaacagggacaagacctagaaagatggcactttgtttcctggctctgaacaagttaaatcaaacaataggttataattcaaaattcctggtgcccaatactttctgagcattttaaccactccaagccagagttttctctctggcaaagaataacagaaagctcacatagtggcaacgacaactgaacgtgataaagcagagcgcctgccacaacagtagatgcccaataaatgctagttctcctcctccctcagtgccatgtcttcttcctccagctgccttgtctaaaaaggctggcttccacactccacggccaggccaggacaagcctaccacttgtcagaaactcccgccagtatccgttcctgcacccagacacacacttacaaatcagtcatccccaagaccaaagacacaggggttccaaaaggcaccctcaagggaaccagtcaccagccttcctcgttaagcagctctgtgctctcagggagagaacttagccccagcagccactactaggattttcccatggtgcaatgcaacttccccaacttttccgggcccagtttccaaagaaacccaggcaggcgttgtgcacaatcagccaccagtctgggagagactgggctctgagcagagaaaaaggagctgggacagccagaaaatgaaaaagcagttgtggccccggcacaggatggcagcgaccaaaacttaagagtaggggtcctggcccaagtcccattcttctggacggtacccttggttaaaggctagcacagggtgccaaagctagcggacggtgaggagcctcagaaaagggactgatggacatcctccgaggtaccccctacccgctactggacctggtggcccccggggaccctgtcgtcgaggcacctgagagtgaaggccttcagcggggggcattgttcacagcgaacggcgggactgggggaggcggcgggacttcgggatccgcgcaccgccgcctccccaactgggccagaggagcgagtccaccgaggccatcgccaggtggagcggcggccccggcgaggtaccctcggccagcaggagggagaagcggagggcgcgtcccagaggcgggggccaagggtctgccactcacccgcgccttcggcgggctgcggcggcccgacgacgccgttcaggtagagaatgggcagcaggtgaggctgcgtcttctccagcgccgcccgcaggtcctggaagtggtcccgctccttggccaagagcagcttgagcagcagctccgccttggcgcctcccgcctcctcgtccagctgccgccgctcgccgggactgagcgctcccgcggcctcgagcagcccgagcacggcttccacctccgtcatggcctgggccaggctctgctgacactgggcgagcagctcccggcgctggggctccatggtggcgggccgcgccgccccgccccgccggacgcctcccgggccccccgaggccggcgggcgggcaggcgagcacctcggcagcagccctagggcgccgggagccgtgaggcggcgggagccatgggccggggcctgggcgggctgggggcccggggcggcgggcggcgctcagcagcggccgcctcccgggctccggagcgcagccatgttggctgccgcggcggcgggactggaagaggaggaggaggagacggaggaggagaaggaggaggcggaggtggggacggcggccggggcgcgccccgaggccgggctccagccgggcatgctccccctccccctcagcctccgcgcgcgccgcccgccccgcgagaaaactcgccccgaaagccgggccgcgcgccgcccccagagcaagactacaactcccgggagaaagtcgcctgggccgtgtttcccaggctcccgacagctccggcccggctcggaggccgcctcggcccccgtgcaccccggcccggctcaccggggccccgcggccgccacccgctcccccgtggccacagccccgccgccgccggcccgtccctcctctctcccctccccaggccgtccctccgggaggcggcagcaggggaggaggggacgggcggaggggaggggtccccggcccgcccgctaggcggggacgcggcgccggctggttcccggtcccccgaggcccaggcgcagccgggggtgggggacacggagtcaggcctggcacgcggccagcccacaagctgctggagaccccctcatacaaatcttgcccccagtccagagggtcctaatctgagaactccaaaatacagcctggagacaaatggtggggagggtttcccctaaatttggacatctccagattaagacctccgccgaatccgtgaggctttccctctccaaggagctcctaagagaatttcccagtaaaatcgcctcaactgcggtaaataggctgttccccgcgccagcatttgagaagagctggtccccagagtgtaaaggagttaggatgttggcaggaggaaggatgtgtcgccggatgaggaaaagaaaggtgggtgtctgcggtgcagtccttggtctttctggcaagtgaggcgctctccccctaaatgtctcagagggagacaaatcagcggactaccttgcttcctttgatgacttggaaaggatctgcagtcccccttaaagcccaagaatgtcttctcttccacgacagccgtttgtggacacatactgcttacctccctgactgcaggacaaggtccttcaaagctggaactctgactgcgctcagtgatcccgcagtgctcctctgtagagtgggaacccaggtccatttcaaatatctacgttggaatgagtggatctcgctgggggtgagaggcactttgtctacccacactgccagtcccagccacatgcctcctcccttccctcaaaaagcagtgtcttcttagtctgcttcttcaaggggagaagtcgtttttatttatggaaacgaactcactatatggtagaaagaacaagagtatcagaatttgcactttggacttggactcccctctaagcagctgcacaaggtggaacaaaccaataatccttgctgatctgttttgtccttaggaaaaatggtggagggagaatattagatcaggggttcttagccttggcttcatgaataagctcaaggatgtcaatgaagcttttgacatgatctcaacttttttgtgaacatttatatatttttctggaatggggtccatagagttacaagttctttaagacctccagatggaccccaatatggcagaaatgaactatttaaagatacctgcctgctcccgtagtctgaccctctatggctaagcaaggttttagaggagtggaaggctggccattgcacagtatcagggttccagacaggctccctggctcttccctcccagtcctgctcctgagatatagttctttctggccgccacttcccttagggcaaccccagagcttaaatcatctgcaaggcagtcacctttcaggcacctttcatccggcacctgtgttcttagctggattaactagaaagctagttggaggaaggaaggtgaaagtggaggaaggggaaaagaggaaaagttggagacgaatctggcttatggttagaagcatattttttggccaggcaaagtggctcacgcctgtaatcccagcactttgggaggctgaggtaggcggattgcctgagctcaggagttggagaccagcctggccaacgtggtaaaaccccgtctctaacaaaaatacaaaaatttagccaggcatgatggtgcaagcctgtaatcccagctgttcaggaggctgaggcatgagaattgcttgaacccaggaggtggaggttgcagtgagctgaaattgcaccactgcactccaggctgggtgaccgagcaagactctgtctcaaaaaaaagaaaaaaaaacttattttttgagacagagtctcactctgtcgcccaggctggattgcagtggggcaaacacagttcactgcagcctcaatttcttgggctcaagcaactatcctgcctcagcctcccgaggagtagctgggatcataggtgcttgccaccacacctggctaattttttaaatattttgtagacacagggtcttgccacattgcccaggctggtcttgaactcctgggctcaagttatcctcccgcctcggtctcccaaagttctggaattacagatgttagttaccacccggaccaattttaggattcctttagccagtgaccttggtgtgaccttgtacttctgcagcattttataccttctgcggcacacccttgtagtgggtcgaattgtgttcccccaaaagatatgttctagtcctaattcccagtacctgtgaatgtgacttatttagaaatagggtctttgcagatgtaatctagttcaaatgaggtcatactggattagggcgggtcctcatccaataactgttgttcttattagaatagggaaatttggatgcagagacacagagaaaatgccatgtgaagatggatcagagacagaagtgatgcggctgcaagccaaggaatgtgaagaatggccagccaccaccggaagctaggggagacgccagcacagattctccctgagagtatccagaagaaaccaaccctccaacacctggatttcagacttctgaccttgagaagtgtgagccaataaaacaactgcagtggagtcagtggttcttgttttaagccacccagtttgtggtcattggttatggcagtcctaagaaactcaaactcacctcagcacagtggggaggtgagaaggacaaagacgggggtccctattttacaaatcaccctatcacttcactcttctactgcctaaggacatctctgtagatttacccacctttcctactttcttctggtcttagaaaaagagagctccttgtctttaaggagagcccttccatgctctggatataatctgtgtatccctctcctcccctgcacacacgcactcacacacagtctgcttctgctttggtttgggctccttctcatttgtcaaaaacaggcttgagtctccccattctcaagggtcctccctttcctctcatgtttccttcggaaacaatcattgcttgacattgggacctccacatctcatagactgctcaccgcttggttggtgctttacaatcagcttcttttttttttaattcttgtgtttgctttttttaaatttattttatttgtttttctggagacagagtcgcactctgtcacccaggctggagtgcagtggcgtgattttggctcactgcaacctccacctcccgggttcaagcgattctcctgcctcagcctcccgagtagctaggactacaggtgcacaccaccaagcccggctaatttttgtatttttagtagagacgggggtttctccatgttggccaggctggtctcgaactcctgacctcaggtgatccacccgcctcggcctcccaaagtgctgggattacaggcatgagccaccaagcccagcctatttatttattttattcatttattggagacaagagtcttgctctgtcacccaggctggaatgcagtgggctcactgcaacctctgcctcctaggctcaagtgattctcctgcctcagcctcctgagtagctgggattacaggtgcgtatgaccacacctggctaatttttttttttttttttttttttgagacggaatttcactcttgttgcccaggctggagtgcaatggcatgatctcagctcaccgcaacctccaccttccagattcaagcgattctcctgcttcagcctcctgagtagctgggattacaggcatgtgccaccacacctggctaattttgtatttttagtagagacggggtttctccatgttggtcaggctggtctcgaactcccaacctcaggtgatctgccctcctcggcctcccaaagtgctgggattacaggtgtgagccaccacacctggccttaatttttgtatttttagtagagatgtggtttcaccatgttggccaagctggtcttgaacacctagcctcaagagatccacctcttgggcctcccaaagtgctggattataggcgtgagccactgtgccccgccctatttatttatttttagagatagattcttactctgtctcccaggctggagtgcagtggcaccatcatacctcactacagcctctaactcctcaagtgatcctcccacctcagcctcccaagtagctgagactgcagacaccatcatcacacctaggtatttttttttttatttttgtagagacagagtctcgttatgttgccgaggctaggttcaaactcctggcctcaagctatcctcctgccttggcctcccaacgtgctgggattacagacattagccaccatgccccacctataatcaggcttctgagcacaactccccatagaaaactgttgtctcccatcctgatgccacctccaggccttatccttcacacctcctctactgtcaactctgctgggcttcatccactggggacatcttgttctcccaccttcctctccctcccccctggctcctttctctctaaggttgactcttcaatcctcttctgtccccatgctccttccctcctgcagaggagctggacagaaatgagctcagtgcccagctctgacactcactggctatgtatcctggggctaggtactgtacttcccggagcctcaatttctgcatctctaaagtggcaataaatatcaccctttggtagggttattaggagaagtaaatgataggacttatacaaagccctccacaatgcctggtgtctggcaggcatataaactccctaatgttagagcaggcaactcctgtaggtcagaatgcctgactgaaatgctggcttggcaacttatgagctgagcgatgttgggtaaacctccatctgcctcgttttcctcctgtgtgaaatggggatgtcaataatagtatcaaagtagctagtgctgaatccgtggtaagtaccactgttcttttggcttccctctgcgaggaaagactccacagcatgtagcaacaggttttgaacagatgtttttagtttcatgaatgagtggttgtggactctagctgaaagatttccatttagcttgtcttcagacagtgaggcaggggcccccagtaccttgttatctgctgtatctccacagcactgtaccgggcatgtggtaggtgctcaatagatagtatttttaattaataggtgaacatatgaatgaatgaacaaactaaagagttttgcattgaggccctacttcaaaataatatcaactaaaaatgggaagatggggaaggaaagtacctcaaaaaggagaagtggctgggcgccgtggctcacacctataatcccagcactttggaaggccgaggcaggattgcttgagcccagaagtttgagaccagcctgagcaacatagtgagaccagagtctataaaaaataaaaaaggagaagcatcagaagcaaaatgagagaaggtcacaaattctccctggtgccacaggaaatgggtggcaggttgggaacttaatgcagggaccatgaactctgcccactgcagagtggccactgctggggcgctaagcaccaggagctccaccctgtcctgctttgtcctgctgataaacttggcctaccaggccccactgctcttcctagctgctcaggtgactgaggaggaggattacttgaacccaagttcgaggccaaacagggtaacatagtgagactctgcctctaaaatatgttctttgggtaataaaaaagaaaaaagatgcccctgctcagaaattcagacctaaactgatggcaccaaggcaaatatagccctgagggcacagtcccctcaagctttctgcaagcacagtgctgtctgggagcattaactctttgactctgagcccattcttcacacttcagcttagatgttaacctttaggaagccatacttgccttaccaatctccttgaaaagggtttggtgtctctgctacatgctctcattgcaactttttactccctttattaaggtttatcagtgtgtattttttgtttgtttttgtttttgtttgggtttttgtttttgttttttgttttttgttttttttgagatagagtctcgctcttgttccccaggctggagtgcaatggcgtgatctcagctcactgcaacctccgcctcctgggttcaagcaattctcctgcatcctgcctcagccttccaagtacctgggattacagatgcccgccaccacgctcggctaatttttgtatttttagtacagatggggtttcaccatgttggccaggctagtctcaaactcctgccctcaggtgatccaccccactcagcctcccaaagtgctaagattacaggggtgagccacggtgcccggcttatcagcataatcccagctactcgggaggctgaggcaggagaatcgcttgaacctgagaggcagaggttgcagtgaggagagatcgtgccactgcactccagcccgggtaacagagtaagactctgccttaaaaaaaaaaattgcgtttcttttctatattcctgtgataaacagaatagctccccttccaagctcccaaaagacaaccatgctccagtccctggaacctgtgaagatgttttgttatatggctacagggacttcacaaatgtgattaaagttctgtactttaaaatacggagagtaggccgggcacggtggctcacacctgtaatcccagctacttgggaggctgaggcaggagaattgcttgaacccgggaagcagaggttgcagtgagctgagatcgcaccactgcactccagcctgggtgacagagtgagactctgtctccaaaaaaataaaaataaaaataaaataaaaaagggcaagtaggctgggcacggtggctcacacctgtaattccagcattttgggaggccgaggtgggtggatcacccgaggtcaggaatttgagaccagcctgaccaacatggagaaacccccgtctccactaaaaatacaaaattatccgagtatggtggtgcatgcatgtaatcccagctacttgggaggctgaggcaggagaattgcttgaacctgggaggcagaggttgcagtgagccaagatcacgccattgttctccatcctgggcaataagagtgaaactccatctcaaaaaaaaaaaaaaaaagaaaaggaaaaaataaatacataaagtaaaatagggagagtatccttgagtatccaggcaggcacaatctaatctgataatgtgagctcttaaaagcagagaatttcctccacctggaggcagtagaaagggaagtcagagagattccaagcatgagaaggatttgactggtcactattggctctgagatggaggggcccacatgcaaggagctaagagtggtccccagctgacagccagcaaggagccaggaacctcactcttacaatcacaaggaactggattctggcaacaactgaatgaccttggaagtggattcttcccagagccctggagaagatcccagcggctaccaccttgatatcagccttataaaagcctgagcagagaaacctgccaagctgacctggacctgtcatctacagagctgagaaatactaaatgggtgctgttctttttttttgtttttttgtttttttttttttttgagacagagtcttgctctgtcgcctaggctggagtgcagtggcacgatcttggctcactgcaagctccgcctccctggctcatgccattctcctgcctcagccttcccaatagctgggactacaggcgcccgccaccacacctggctaactttttgtatttttagtagagatagggcttcactatgttagccacatggtctcaatctcctgacctcgtgatccgcccgcctcggcgtcccaaagtgctgggattacaggcaggagccaccgtgcccagccttaaatgggtgctgttctaaggctctaagttggtgggtttttgttatggcattaggagaccaacaatccccaatgagctatgagctctgtgggagcagaagagacatcgacttgttcattattgtaccctctgtacctacctgcctagatattgcctaggacactgccctaggcactcaaaaacaccctgtgataggaagaatggaaacctacccttccaccaggctttgcttttggagaagttatctgtggcagaatccattattccactagtgattggagggaacattttcaaataaagatactggatacagggctttctctgcaggctaagtgagcagaggccccactctggccttggattttatgttttaatggataagctacagctgctccctggagaaacagatcctggcggtctgctctgagtgtgcagctcctttggaagtacacaaggctgccaacaagagcatgtgtacatgtgtctgtgcatgttagcgcatgcgtgtgcacacataagtgtccatgcactcacattgacaagagtgtgagggcactgtgagcaggagaggaaccatttccaggtgcctgtgggtgtctgtgagtgcaaactgcacacgtgtgagtctgaacacgtggatgtgtgtgagcagaggagcagttgtttctaggacaggtttcctgtcccacatgggaaattgcacgtggcccaacatccgagatgcaacatttaaaaggatttccttccagagtttcttaaaagaatgaactcccccaggatgctgaaaatggaattctatttaggaaaatgccatattgcacacacctttttaggaatgctatatctatgaaatgaattatgcctgtttgttaaaaattaccttcaacttggctcttggtagcttctcaaatcatgaagacatttttcttccagactgcttttgttgttagttcaggaatggcccagaggcaaatatcccaggattttaaaacagagaatctggctgggcatggtggctcatgcctgtaatcccagcactttgggaggccaaggcaggtggatcacgaggtcaggagatcgagaccatcccagccaacatagtgaaattccatctctactaaaaatacgaaagttagctgggcgtggtggtgcatgcctgtaatcacagctactcgggaggcagaggcaggagaatcccttgaaccaggaagttggaggttgcagtgagccgagatcacgccacagcactctagcctggcaacagagcgagactccgtctcaaaacaaaacaaaaaaaaaaaaaaaaaaaaaggaatctgagagaggcccagacctagtcatgaatcttgcccagataccaaggacaaggcaagattctgagatgagagattcaaagcctttgagaacctcagattaatccttagaaaggactaatgaattattaacgatgaaataaataaaaatactatttattaagtgcttactgtgtgccaagttcttggctaagccctaaggctacctaacctcactttgcaaatgaagagctaagaagttgcttgcccaaaaccacacgtcaattattgtcaaaactggagtgggaattcaagtttatcacctcaattctttgcagcaaccctgcgaggcctatgccctagctcctcagctgtcatcccttcttcctgttaaaacattcctacaatgtgtctcttttacaggaaccagtttgaagtcacagctggaaaggatctgacactgtgataacatcatcctggttacttctcccaaaggattgacactttaacctgaggcctgaacagccttctcggtgaaccccagtgagccaagcagattatctcctggtcagcctagttttccaatgcacaatgcctcatgcattgtgagagtcacctcttcagaacaacataccactccctcaattcctcaagaatattcactagctccccattgcctgcagggcatccagagcttggctgtcttctaactcatctcctattgcttggcccaatgctccagctactgaccctctctgtcctccaccaatacaatgtgccccttctcccccagggcccacttctgcctcctctttgcctgtccaaactcctctcattctctagggccaggaaactcctactgaccttgcctttccctcccagaagtcctgatgtgctatgctttgaattgcctcttcctcttttgccattatctattgccttgcatcatttgtaagtttggcctgggatgtctttgcctcccagacatgctagggacagggaccctgtgctgttatttttctcatatccctcacagtgcctatgacagaggaaggcctggagtagatgcttcagaaatacctgagaattgaaaaaaccaaggcaagggaaagtgtgccaaggggagctctcatctttctgttctttaggtctcagtttaaaggttatttttgcatatccccaccttgttcccacctaccccacaaatgaccaaaattggattctatgagcagtcattttccttcctggcattcatcacattttatacttttttttttttttttttttgagacagagtttcgctcttgttgcccaggctggagtgcaatggcatgatcttggctcactgcaacctccacctcctgggtcaggtgattctcctgcctcagcctcctgagtagctgggattacaggtgcactcagctaatttttttttttttttttttttttagtagagatgaggtttcaccatgttggccaggctggtctcaaactcctgacctcaggtgatctgcccacctcagcctcccgaagtgctgggattacaggcgtgagccaccgcgcctggccatattttatactacttttatgtgactctgtgtttgctgactgctttctactagactctaagctccacagaacacctgttcggttcacctctatatccccagtatctagcttgatgcacaataggggctcaaaactatttgttgaggcagggcatggtggctcatgcctgtaatcgcaacactttggggggccaaggaaggatgatcacttgatcccaggagtttgagaccagcctgggcaacatagggagaccctgtctctacaaaaagtaaaatgaaattttgccgggcatggtcccagctacttgggaggctgagatcggagaatcacttgagcccaggaggtcaaggctgcagtgagctatgattgtgccactgtactccagcctgggtgacagagcaagaccctgtctcaaaaaataaaaacaaacaaaaacctcacctacttgttgaaagaatgaattaggaagggagaggagattacttgttttgggtatttgtaattgtcctcaggaactctccataagaacacttccatttttcagtctagaccagggactcaggtctgagaggaccagtatctctagggtaaatataaccccagccacaaagcaaattgaagcagtccccctttcctgagcactaagtatgttccaggcactgtactgagtgctttgcccacaggccccagttactcttcaccacacccatagaaagtaagcatcatgagcagctccatcatacagatgagggatctgaagctgtgcatttctacccctcccagcctttctagttgtgtgtggttcccatcttgcaggggaagaaaatctcaggagtggctgagaagtcccagaagagcttttgcacatgcatcaaaactgcccctatcaggcccggtgcagtggctcacgcctgtaatcccagcactttggaaggtgggcggatctcctgaggtcagaagttccagaccagcctgaccaacatggtgaaaccgtctctactaaaaatacaaaattagccgggtgtggtggcgcatgcctgtaatcccagctactcgggaggctgagacaggagaatcacttgaacccgggaggcagaggttgcagtgagctgagatcttgccattgcactccagcctgggcaacaagagtgaaactccgtctcaaaacaaaacaaaacaaacaaacaaacaaaaaactgcccctgccttccaaggaaggaaagccagttcctggggaataagccagaaatcaacagtggccctgcctgccctgccggtgggtgcagacatgtggaaaccagatggaaagggggcccatgggcccaatcagactcttggaggtgatgagaatgccccgaagccagaaacagctggctagaagagacgggtgtagcttgggaattctggtgtgggtaaaacagaaacccccctgggcaccaacccttccacggcattcagagtccctttcacccacacctctattgttcctccttttctccatgtagccattgcggtaccaccattccacactgaggctcagagaagcaagtcagcctgctcaggatcatgaagctggaaagtgatgaaatcaaccaccttaaaacaactccccacaggtgggggcaaggctgacccctttaagcaaacctcctttgtgtagaagcagcagctggagaaacagctgccagatggaacactggccttcactttccagctgggagccatccagctctatgcagctttactggaggagttccttggaggaaaagctcctccatgggaggcctcgtttaagcaaacacggtcacatgaggtgttgcagcagcagcaggccaccgcagagatagctgcttgggtgcagggccatgaagacctctgagactgaacatacaaatgggcaatggccagactatatttaaaaatagaactccaacccacaacctgtagcaaccaattcagaaagctgacccaccattggcaaccaagtccaggaagccaaacagtctctgcggcaatcagcccaaaatggccagaacttgaccaacaactgacaaaatgcccagaacttgaccaacaacatcctaatttttgccccagtgtgcaacttaggaccaattggaggaagccagatgtgctcccctaaccagtcacataggatgtcccgcttctaataggcccacctacagcttcctgatgtcaacagcctccaatcagggcacacccaaagcctccccttttcccaccacaaagcttctccacttccctgcccacctttgaggcctctgacaaaggcaagtgatggtagctgactcccttgctatagcaagctctgaatcaataggctttgctcattttcatgtgggcttcgtttatttctatacctcctagttgcttaattgttttatgacttgattttcttatctgtgaaatgggaccataattttggacacaaatcttttgggaggaaaatgccttgaattgcaggggagtccccgatacatccccactccctgggtcacctctgatctcagttcagctgccacataacccacctccctcttgttctgagcataactgggcacatctacatgcccagttccttcattttttcaggggaggaccctgaatccaagcaggaaaatgctgacttacccgaggtcctctcctccagaggtttttaatgacccagtcttgctctctggtttcctccctcctgactgcccaggaaagcaagcacatgagccttttcagcaactctgcagggtggggcttcaatctatggtgaaactgaggaggctaaaggaggaaaaatgcacacaggagtgagttaccaggccacagaagcttcccaaccaggaaaggccagttgtggcctgcatacggagctctgccctccatagggaggtttttcttccttggtttcagggagcgtgagccccacccaggttttctgaacctcttttattcagggaggctggctggctctaggagagtcccttttcccttcctggggttgtttccacccaagcctggctccaccttctcactgcaagacaaaagcaaaggggatcacaaatcacagtactcaccattctagtagtagtgtgccataatacacgatattaactacttttcatatatagaccctttcagtcctcagaacagccctctgatacatatatgtaccattattagcatgtccatttaacaaatggggaaactgagtcatggagccatcagatgatgtgcccaaagtcacacaaatagcaagtcgaagaacagggattaaaacccacatccagagatgagctctcaaacaccttatggtaccacttcagaatgttttcaaatgaacacaagtatgaataggacatggtcaagcgtagttgctcatgtttataatcccagcactttgggaggctaaggcaggaggatcacttgaagccaggagttggagacaaggctgggcaacatagtgagaccccatctctacaataaaataaaataaaataaaattagctaggcatggcggcacacacctgtaatcctacggagaggctgaggcgcaaggatcacttgagcccaggagttcgaggctgcagtgtgctgtgattgcgccactgcactccagcctaggtgacacagccaggtcctctctctaaacaatatcaaaaaaatcaaatactaatagaacagtattttgcgtgttccaaagttgggagcaggattcatttatatttcagagaaatgttgggttctttctcatttattcttagttcatttggcttccacaaacattcactgacccctaagagagataccgagagatatgaataaggccttctccgcctcagacctagcactttcccggggttgaggaggccactctgctaacccccaacccactcacttcagggcttcccagatggtgaaatatagtttacactcagaaaagagcaggacacacgtatcaccagacaacacacgtaacactggaagagctagttttacatccagattcctgggcttcaacctaggaaaagagcctgagaaactttttttttttttttttttttgagacaaggtctcgctctgtcactcaggctggagtgcagtggtgcagtaatagctcactgcagcctcaaatgcctgggctcaaggaatcctcccactttaccctcctgagtagctaggactacaggcacgcatcaccacatggggctaatttttaaaaaatgtttgtagaggcgggatcttgctttgttttccaggctggtctcaaacctgtgggctcaagtgatcctcttgcctcggcctcccaaaatgctgggattacaggtgtgagccactacaccaggccaaacctaattttttttttttttttttgagacagagttttgctcttgtcacccaggctggagtgcaatggcgagatctcggctcactgcagcctccgccccaccccaccctaccccaggttcaagcaattctcctgcctcagcctcctgagtagctgagattacaggcggctgtcaccacacccagctaatttttgtatttttaaaatttatttttagttttttgagatggagtcttgctatgttgcccaggctggagtacagtggtgcaaactcggctcactgcaacctctgtctcccaggtttaagcaattctactgccttggcctcccgagtagctgggattacaggtgcatgccaccacactggctaatttttatatttttaatagagatggggttttgccatgttggccaggctggtctggaactcctgacctcgtgatctgcttgcctcggcctcccaaagtgctgggattacaggcatgagccactgcgcccggccataatttttgtgtttttagtagagacagggtttcaccatgttggccaggctggtcttgaactcctgatgtcaggtgatccacccaccttggcctcccaaggtgctgggattataggcgtcagccaccgctcccggcaaaacctgaatttttaactagcatgctgggtgaattttatcaggacagtgaaccaggactctctgaaatcccttccccgggatagtcaacgaggctttcaatttaaacttgcatttgaagcttgcagagactcacactgacttacccaggccctaacacacagcagctgtctccatggttgcgccaggtagtgaaggatacagggcagcaggaaacgagtcccggttctcaggtggatcccgtgcttccacctctgttagagcccaggccctgagggcatagggccaaattgccacagagctccagagaaatctgtctctcccgtcccccaccctaagactgagctgctggaggaaagaggccaggtttgtttccttttattggttaactctcttcagtcgcccctttctcctgcagacaccttggggacttttagtaattgtcagctgaatgaataaattaatgacagagggagacagacgtgttaacagctaacagtaattcaagcagaatggagtaagtgctaaatagtggtggaatgagtcatgaatgctgacagggaaggaagagggaaaaaggcattcattctctccccctccactgtcaaaacagtgccttcactcttcctccctccatctctcttacaggcaccagagagcagaaaatgtatgtgtatagtttcaagaacagttccaaagcaaacacccatatagtcacccccatgtgctggcccccaggataagaaatagaaccttgccagaacctcagaagcctttcctggccccctccatgacatcatcattccccgcctcttgccctcatctaacttctaatctgattctgaggggaatcattttcttacttttcttttttttttctccttctttttttttttttttttgagacagagtctttcgctcggtcacccaggctggagtgcaatgccatgatcttggctcaccgcaacctctgcctcccgggttcaagggattctcctgcctcaacttcccaagtagctgggattacaggcatgcgccaccacacttggctaattttgtatgtttagtagagatggggtttcaccatgttggccaggctggtcttgaactccctgcctcaagtgatccacccaccttggcctcccaaagtgctgggattacaggcgcgagccaccgtgcctggctcattttcttacttttcttaatttttttttttttttttttttgagacagagtctcgctctgttgcccaggctggagtgcagtggcgcaatctcggctcactgcaacctctacctcctgggttcaaacgatcctcctgcctcagcctcccaagtatctgggattataggcacctgccaccacgcccagctaatttttgtattttttgtagagatggactttcaccatgttggccagactgcctctggtctcgaactcctgacctcaagtgatctgcctgccttggcctcccaaagtgttgggattacaggcattaccactgcctctggccattttcttacttttctttattgtttgactgtgaatgtctatgtcacaagacaagacgttgccttgttttgaatttatgaccacacgttttcttctgtggcttgctttccttgtgcaatattttttggacttttgcctgtgtcgatgcttgtggtggtaggtatacattctcactgctgcatggccgattctattgtgtaaacataccacaacttacttagccattctcctgtggatggtcatttggattgtgtccagtctttggcaattactagcaatgctgctgtatgtgactcctaatgcacacatctatttaatatatttaagaggaagtgctgggtcatggggtatgtgattttcaactttcccagctagtgcctaactgttttctgaaatgcatctgcttctagactgtctcatttgcagttcaacttactcagtagcactagggtagtctctcctaacaggtaataccaattgaactctcttagtttcatcagggtaagcgtttggggaaaggggaggataaaaatggttaggtgtggccgagtgtggtagctcatgcctgtaatcccagcactttgggaggccaaggtgggcggatcacaaggtcaggagatggagaccatcctggctaacatgatgaaaccctgtctctactaaaactacagaaaaataagctgagtgtggtggtgtgtgcctgtagtctcagctacttgggaggctgaggcaggagaatggcgtgaacccaggaggcggagcttacagtgagctgagatcacgccactgcactccagcctgggtgacacagtgagactccatatcaaaaaaaaaaaaagaaaaggtcaggtatggtggctcacacactagcactttgggagggaggctaaggaaggaggatcacttgagtccaggaattagaggctgtagtgagctattatcatacccctgtatgccagcctgggcaacagactgagtccctatctcaataaaaaaaaaaagaggagaagaaaaatggtgtatagagacccccgatgggagtaagcccaaggttcattggctactgtgacagtcagttaaattatttttttctggctgggtgcagtggctcatgcctgtaatcctgcactttaggaggctgaggtgggcagatcaattaaggtcaggagtttgagacaagcctgaccaacattgcaaaatcctgtctctacaaaaatacaaaaattagccaggcgtggtggcgggcgcctgtaatcccagctactagggagactaaggcaggagaatcacttgaacctaggaggcaaagattgcagtaagccaaggtcatgccactgcacttcagcctgggcgacagagcaagactctgtctcaaaaaaacaaaaacaaacacaaaaaaacccaaaataaaaaattatttttttctgtgagtaacagaaatccccaaataacagcagattaaacaaaacagaaatacatttctctcccacataaatgaaagtctgaagtcagctatccagactgatacagtgctccacgaggtaggttcctttgctcttgttccactgtctctgcaaatggcttgagctgcttgagctccagccatcacgtctatatcctagccaacaagaaggaggaaagacaaaaagaaatttttgtctctttcctttgaatacactttcagaaagtcacacaggcactgcatatattccagtggccagagcttaatctcacagaaagaaagatctgcaagtgatactgggaaatgtagtccttgttcttggtggctgtgtgcccagctaaaatccgggagtttcatgattaaggaaggagggagaatggattttgcaggacaatgaacaatctctgctatggatatccttgctcaggaaagcacttctgggtaggtctgcctaatgccctcaccacacacacttacagatacatatctcagaagtcgaaatggagagtaaagtaggtatttagcaatgccatgtctttatttattttattttatgttattttattttttgagacagttttgctcttgttgcccaggctggagtgtaatggcgcgttctccgctcattgcaacctctgcttcccagttcaagcaattctcctgcttcagcctcccaagtagctggaattacaggcatgtgtcaccatgccccgataattttgtatttttggtagagacagggtttcaccaggttggccaggctggtctcaaactcctgacctcaggtgatccgaccacctcagcctcccaaagtgccaggattacaggcatgagccaccttgcctgtcaatgccatgtctttaaatattacaagatatactctctgttcatctaggaaactgtggtgcccaaatggtgagtataattagttattttaggcaaatactctgctggatcatatggcaatttttttttttttgagatggagtcttactctgtcgcccagggtggagtgaagtggtgccatctcggttcactgcaacctcctccttctgggttcaagcaattctcctgcatcagcctcctgaatagctgggactacaggcacttgccactttacttggctaatttttgtattttcaccatgttggccaggctggtcttgaactcctgacctcaggtgatccaccagcctcggcctcccaaagtgctgggattacaggtgtgagccactgtgcccggcctggatcatatggtaattctatgttttatttatttacgagacaaggtctcactctgtcatccaggctggagtgcagtcatgtgatcatagttcactgcaaccttgaactcctgggctcaaggtatccttctacgtctgcctcccaaagcgctgagattacaggcatgagccaccacattcagcctatgttgaatttttttttttttttttttgagatagggtctcgctctgttatccaggctggagtgcagtggtgtgatcacagctcactgcagcctccacctggctcaagtgatcctcctgcctcagtttcccaagtagctggcaccacaggtgcacaccaccatgcccagctaattaaaaattttttttgcagagatggggacctctctgtgttgcccaagctggtcttgaactccttacctcaagtgatcctcttgctttggcctcccacagtgctgagactataggtgtcagccaccatgcctggtctatgcttaattttctgagggactgccacactcttttccatagcagatgcatgattgtacatttccacccagagtgcacaaaaatttcagtttctcggcctggcacagtggctcacgcctgtaatcccagcactttgggaggccgaggtgggcagatcatgaggtcaggagatcgagaccatcctggctaacacagtgaaaccccgtctctactaaaaatacaaaaaaattagctgggcgtggtggcgggcgcctgtagtcccagctactcgggaggctgaggcaggagaatggcatgaacctgggaggcggagcttgcagggagccgagatcgtgccactgcactccagcctgggtgacaaagcgagactctgtctcaaaaaaaaaaaaaaaaaaaaaaaaaatttcagtttctccatatccttgctaaggctggttattttctggtttttatttatgtttaaaatatgtatttatttacttatagagacagagtcttgctctgttgcccaggctggagtgcagtacagtggcatgatcatagcttactgcaggattgaactcctgggctcaaggatcttactatctcagcctccccagtagctgggactataggcatgtgtgaccatgcctggctaattttttaattttatgtagagacaggttctggctatgttgtccaggctggtctccaactcctggcctcaaatgacccacccggtttggtctcccacagtgctgagattacagatgtgagccactgtgcccagtctatttttaaatatattcttaaatttttcattgtaaccatctttttttttttttttttttttttgagacagggcctcattttgtcccgcaggctggaatgcagtggcacaatcttggctcactacagcctctacctcccgattcaagcaaccctcctgcctcagcaccccaaagtagctgggactacaggtgcatggcaccacgcctgcctaattttaaatgtcttttttgtagaggcggggtttagctgtgtcgcccaggctggtcttgaactcctgagctcaagcgatcctcccgccttggcttcccaaagtgctgggattacaggcatgagccaccgcgcccagccagatagtagccatcttaatggagtgagatggcttacttttaaacattatttctaaactgaacccagaccctggcatattagaggtggttacacagtgaacgcatttgacgaacagtcaaggtaattttgttttccagggtttgctccatgaataaacaatctctgagaggctagtatcttgtccaaggtcaagagcctgaatttgaattgtctgactgaaaggcagcatgttctctactagtcacctctctacctggttccaccctatgcaaggcaaacaaacgcagaagaaagaaacccattgccgtgcaaaatccagtgattccaaacccaaccagcccaccagggatgttctgggagtccgagctggggacaggagcacagccagccctagccagccctccccccaccacactcagtgcctggcggggcagagcgagtcacatttcagcctcactcacaggccagcttgaaattcggcccagccgccactgcctcctgagaactcctccggatgcctgcaggcttatgcggggctgagtcacttcctcaccttaattctcccctaataccttccctttctctgctgctttactcctggcaccactgtctgggtgtggaatgtctggggaagctgtgcaggtgggttggctgagctgtctgcccagataccacaaacatggctggggagagaggatgcaggggtaaaagtaaagccagatttgtctgctggctcttaagcgcatcctaatcccctcagtcagtttgatcttcgcaaacatgagcacaggtcaatatctctaagcttgggtcctgaggggctggtggaggatggagcagaggatggatgaagaggaacaggaagtgaggggagagtgatggctgctttggcttttagaaacttccatcccacattactttccctagggaagctcccacctcccatccctgggagaacagactgcatcctggaaggtcaagttccaggtcatgttaaatatgatggtttcctggatgagtctaaggacatatcattaatatcttcagcctatttccagaagtcctgctgttcctcttacctacatgtatgctgttcttccctgtgtacaacttaactttccttttcaggtttcggatgctttgtctgtacattgctttgtgtgtttgcctgcctcagcttgtactttcggagatagaaattgggtcaaagttttaatttttatttaagttattcatttatatagtttaaaaagtcaagggatggtgcaagatttatgaaaaagagccctctcccttccccttagcagagataatcatcttcaccttttttcttttttttttttttttgagacagagtgtcgctccattgcccaggctggagtgcagcgacgtgatctcggctcactgcgacctccacctcccggattcaagagattctcctcctgcctcagcctcccgagtagctgggactacaggcgtatgccaccatacctggctaatttttgtatttttagtagagatggggtttctccatgttggccaggctggtcttgaactcctgacctcaagtgatctgcccgcctcggcctcccaaagtgctgggattacaggtgtgagccagcattcctggccatcttcaatttttatagctcattcttttggcatttgtctccatttccctcaataatattattttattactacgtcatgatttttcagttttaggcactatttattgtcttccatacttgaacaacccatgcacccttcctggcctccatctttccactacagtcatacaataatttggttagagcaatagccagtttttacattaataccactatgtaaagactattaccatgtgatggactatgcacaattttttattttccctggagctaataattatctccgcccccaccccaattcatttacttagtttcctatgtgtttaatgccaagctctttcagttgttataatcttcccttaatactttcagatgatattctaccaattttattttcttgaagaaatctctcttagacatggctgggcacggtggctcatgcctgtaatcccagcactttgggaggacaacatgggtggatcgcctgaggtcaggagtttgagaccagcctggccagcatggtaaaaccccatctctactaaaaacacaaaaaattatctgggcgtggtggcaggtgcctgtaatcccagctactcgggaggctgaggcaggagaagtgcttgaatcggggaggcagagtttgcagtgagccgagatcgcaccattacactccagcatgggtgacaagagcaaaactgcatctcaaaaaaaagaaaagaagaaatctctcctagacatttctgaccttatctggtctaggctggttgtcctataggactgttgcattgtcgtcatcttgcaatctctttttaccaacatcctgggggattctctttatctatcacatgtcagattcctgtttccccttgtctttttcttggtttactaccttatcatccaggagcctcctgagtatataaacatttttttctgaaccttaaatgactcaaatgtctttttctatcttcaaccttgattgatagtttggttctgtagtcccagctactcgggaggctgaggcaggagaatggcgtgaaccaggtgggcagagcttgcagtgagccgagattgcgccactgcactccaacctgggcgacagagcaagactccatctcaaaaaaaaaaaaaaaaaaaaaaaaaaaagatagtttggttgggtataaaattttaagttgaatggctgggttccatggctcacacctgtaatcccagccctttgggagtacgaggtgggtggatcacttaaggtcaggagtttgagacttggtgaaaccctgtctctactaaaaatacaaaaaattagccaggtctggtggctcatacctataatcccagctacatgggagactgaggcaggagaattgcttgaagtcagaagatggaggttgcagtgagctgagatcgcgccactacactccagcctgggcaacagagtgagactttgtctcaaaaataaaaaaaaaaaaagaattatgttggagatgattttcctttggaagtttgaaagcattgcttatcttctaacttccagtgcatctattgagacattcaaggcactctaatgcctgacctcctcccctttccctttggaaacttgcaggatcttctctttgtcttcagtgttctgaattataatgatttgtcttgatgttggtctcttttcatccattgggccaagaaatcttgggcccttttaaactggaaatatatgtctccgtttttgaaaattttctttgggtattttattttattttattttattgagacagagtcttgctctgtcgcccaggctggagtgcagtggtgcaatctcggcttactgcaacctccgcctcccaggttcaagcgattctcctgcctcagcctcctgagtagctgggattacaggtgcctgtcaccacacccggataattttttgtatttttagtacagatgaagtttcactatgttggccaggctggtctcaaactcctgaccttgtgatccacccgccttggcctcccaaactgctggaattacaggtgtgagccactgtgcccagcccaggtgtttttttaatcatttcctccattcctttttctctgttgttttttgtttatttttgtttatttttttaatggaattcctattattcaggaagtggaattcctgtattaggcctctaattttcttatctattctctcctattttctgtgactatgtttttgtaagatttcctcaattttatattccaatccttctactgagtttttgatttctcacattatatttttaagtttaaagagctccttttttgtcctttgaatgttcccctaaacaaaaaaaaacaatagtggccaggcatggtggctcatacctgtaatcccagcactttgggaggctgaggtagaggactgagatcaggagttcaaaaccagcctgggcagcaaagtgagaccccatctctacaaaaaaataaaaaaattagctgagtgtgatggcatgtgcctgtagccccagctacatgggaggctgaagcaggagggttgcttgattccaggaggtcaaggctgcagtgagccatattcgcaccactgtactccagcctaggtgacagagtgagacgctgtctcaaaaacaaacaaaaacaaccaaaaccccaacagtattgtgtttttgtctcaggtttatatatttgcatatggaatgtctatataaattatgttcttgctgggcatagtggtttgcacctgtagtgccagttcctggggacgctggggcaggaagatcacttgagcccaggagttctgggctgtagcatgctatgccgatcgggtgctaagttcggcatcaatatgatgacctcccaggagcagaggaccaccaggttgcccaaggaggggtgaactggcccagatcagaaaaggagcaggttggcagtttaaattgcattgcattgaagaaataggtggtgggatcttgctgggtgtttgattagccctttctctgtcttgcttgtttgagcttcagcagaattcaaaatgactggcaataaggctgggaaggactctggaaaaaaacaagacaaaggcggtttcccactcgcagacagctggcctgcagttcccagtgggacatattcatcgacacctgagatctaggacgaccagtcatgggcatgtgggtgcaaatgccgcagtgcatagcatagccatcctggagtaactcaccacagagctacctgaactggcagcaaaggcatcaaaagacttcaaggtaaagcgtattacccttcgtcacttgcaacttgctgtttgtggagatgaagaattggattctgtcatcgaggctacagttgctgatggtggtgtcattccacacactcacagatctctgatggggaagaaaggacaacagaaggctgtctaaaggctgcctggattccttattatctcgagactctaagtaccttaccagctgtccagcgtggtgattccagtaggctgtatctctgtgaaaaacataatttcatctttttctttcttttttttttagacagagttttgctcttgttgcccaggctggagtgcaatggcatgatctcagctcactgcaaccgcctcctgggttcaagctattctcctggctcagcctcctaagtatctgggtttacaggtgcctgccaccatgcccggctaacttttgtatttttagtagagacgggtttcatcatgttggtcaggctggcctcgaactcctgacctcaggtgatctgcctgcctcggcctcccaaagtgctgggattacaggcgtaagccaccacccccagcccaattttgtctttttgtaattgtgtctgagcaagttggaagtttaattagctttccaactgaccaatttctgcattctagtcttaaccatatttaattgttactatggcttcaaagaagctattgattccaaagtagtgggttttgattgagttttttaaaaactggattttaacagtgatgcagaagttatagtaacaaacatttggttttgtacaggcattatttccactctggtgcataagctcaataaaggtcatatcccaaactaaaaaaagaaatggagcaggtcaaaactcccatgctgatcagttgatcagtagtgggattatgcctatgaataaccactgcactccagtctgggcaacatagcaagactctgtctcagaaagggggaaaaatatccatgtaagtattatgtctgtttttgatagtattgtgttcttgtttcagaaatgcatgtttgtttttgtttgtttgtttgtttttttgagacagagtcttgctctgtcgcccaggctggagtgcggtggtgtgatctctgctcattgcaacctccgcctcctgggttcaagagcttctcctgccttggcctcccatgtagctgggactacaggcgcctgccaacgtgcctagctaatttttgtatttttagcagaggcagggtttcaccatgttggccaggctggtctcgaactcctgacctcaaatgatccacccacctcggccttccgtgctcagcctgatgcatatttttaagatctcgctaagaaataataatgatagggtttttgccgtatttttaaaagttctcttttccctgcataaaatagttttctccaagtaggtttttccatttatttttatctctgcctttcatgttagagactttggtcagatgtctgatgacttggttatctgagtaggggcactaaaaagctgattgaaaagtctgagcacatggggagaactttttgactatgaacttcattgcagggtgatctggctgagccattcattgttatcagtatcttaggtttttgtttgttgtttgtttgtttgtttgttttttagctagtcagattctccaaaatacactctttcactgatcacctggagttacgaagccctgggagctcagtgaatgaagaaggctggggtttcacactacagctgtaaatgtttgcttaatcccctgcttgaagtacagatctctcttactagctgagtccagaatcctctagagaccatgcagtttactttcttccgggaataaactttatttatttatttatttagagacggaatctctctgtatcacccaggctggagtacagtggaatgatctcggctcactgcaacttccgcctcctgggttcaagagattcttgtgcttcagcctcctgagtagctgggactacaggcacatgccaccatgccacactcattttagtattttttatagaggtagagtttctccatgttggccaggctggtctcgaactcctggcctcaagtgatccacccgcctcagcctcccaaagtgctgggattacaggtgtgagccaccatgcccagccatctcctgggaataaactttaatctcccgccaattttctggatggcaggatatggggagggcatttggggtatataattttttcttaaattttcaaacagttctcttgttcttaagccccacgttcacctctaattctggtgccaattcctgagcctgttggaaattccacagagtaaatctggttacttttagcttcttctcctgttcagtttaggactcagctctcttggatctgctaaattagttgccacttattcatttgttttccagcttccaagagggcatagttgtctccattcccattgctaactcatggcccactctgcgtgtgtatgatctttctaggatctcaagtgaaaacctcaggtcttcgccaaggtctctctactctggctggggccaaactccaactctcctagccctgaaaagcctctgaaacttcaactcagctgtctagctgcagaggctattctctactccatctgcagagtcttgccctgtgtatgggagtttaggagtcagcgaagcctcaagaaggagaattttaaaataatcaacttctggctgggcgcggtggctcatgcctgtaatcccagcactttggaagactgaagcgggtggatcaattgaggccaggagtttgagaccagcctgaccaacatggtgaaaaccctgtctctgcaaaaatacaaaaattagctgggcgtattggtctgagcctgtaatcctagttacttgggaggctgaggcaggagaatcacttgaacccaggaggcagaggttgcagtgagccgatagtctgccactgcactccagcctgggcgactgagtgagattccaactcaaaaaaataaaataatcaactttggctaggtgtggaagctcatgtttgtaataccagcactttgggaggctgaggatggaggatcacttgagcccaggagtttgagaccagcctgggcaacatagtgagactgcatttctattaaaaaattaacaaattagcagggcttggtgatgcatacctgtagtcccagctacccgggatgcggaggtgggaggattgcatgagtctgggaggtcaaggttgcagcaagatgcgatcgcaccactattttccagcctggacaatagagggagaccccaactcaataaacaaaataaaatacaataactttattgatttaaaatacagtacgttgggatttaagatgagcaatgccaatctcatcgtattttagcctattgtaactatcactgccttagtaaaattactaggaaatggtctagggcaatttttttttaatgttcattcagagtgttggtgatgatgggtgagcttgacaaaggcattcttcaaaaataaaaactggccaggtgtggtggctcacacctgtaatcccagcactttgggaggttgaggcaggaggatcacttgagcccaggaatttgagaccagtctgggcaacactgggagaccccatctctacaaaaattaaaaaattagctggccatggtggtttgcacctgtagtcccagcttctcggaaggctgaggtgggaggatcacttgagccccaggggacaaggctgcagtgagctgtaatcgctccactgtgctccagcctgggtgacagagcgagaccctgtttcaaaataaataaatacaaaatgtaattaatatattgatatacttacaataaaactcactcatcttaagagcacagtttaatggcttttgatgaatgtaaacacatgtgtaaccatcaccacaatcaaaatatagaatatttttatccctcaaaaagcttccttgtgtctcaagaaggatttttatgcagaatttttgggtttctgctctgtgtctgcttcctctccccgaaatccctgttgcctcagcagccttcactctcatctgttttccccagctagtaacactgctagtctctccttggacactgtttcccatagtcaagaaaacgtcttcagcgtgaaagcaggggtgaactctcttagtgaccatagccctgtactggttgatgttgcatatctgcaaagagttatttactatattttgtccgggctttatattcacccacagcagaggccaaggaaagataaatatgatacccactactccatcagacacctccatcagacctagaaccagaggctttaaaataccttttttttttttttttgaaagggagttttgctctgtcaatcacgctggaatgcagtggtacaatcttgactcactgaaacctccacctcccaggttcaagctatcctcctgcctcagcctcccgagtagctgggactacaggtgcatgccaccacgcccagctaatttttgtatttttttagtaaagacagggtttcaccatgttgaccaggctggtttcaaactcctgacctcaaatgaagtacccaaagtgctgggattgcaggcatgacccacctagcctgacctaaaatagatttttaaatacacatttttcacattttcttgacatgctggctaaaacggggaacatgcagaaaacacttcaccaaagtctcttccttatggcaataaggagagcccttgtatttggagctctcctggtatcttgaagataatccaaagagaatgaatctagtggtgctgtattctgccacttcctcattgggtagcctctggccactcctggggggtgagtggtggtaggatgttgtgattgtcaaaccaactacctgggaggccctgtggggtgtgatttttatttatttattttttgagacgaagtcttgctttgtcacccaggctagagtgcagtggcgcgatctcggctcactgcaacctccacttcccaaggtcaagtgattctcctgcctcagcctcccaagtagctgggattacaggggcccaccaccgcccctggctaatttttgtatttttagtagagacggggtttcaccatattggccaggctggtctcgaactcctaacctcgtgatcacctgcctcggcctcccaaagtgctgggattacaggcgtgagccactacgcctggccagggtgtgattttagagtcagatggagcagggtttgcattttggctctgacatttactgtgtgcctggggaaagtgatggaatcactctgggcttggttttcttatttacaaaacagagagagtgataccaatcttggaggatcattagaagagttaatgatgtagcatatcatatgctcagctgagtgccttctacgtagcaacatccaatatgtgatggccactgatagctctatttatggacaggaagatgctttgtaccctgttaagtagttcataaacttggtggtcagcatcttttggacagcccagcgtctaaatcccccttcctccactgtgtgaaggcctccccttgcttcttgttccccaggacaggaatgatagatattcactgtccccgttcttgctctgtggtggtcagtgtggctcactggatgctcctgctaagaaaaacgggagaatgttatttgggtagtggaggcagaggcagcaccgggtcccttggcatggaacccagtgtcctaaccggaccatgccttgggtgggatccagctggactctgctgccagtaacccttgttttttgctcattttctcatcctgggtttccagccttcctgatgattctgtgagctgcctgatatgtttccaaaaacatgacaaaacaaagcttttccacttcattaaccagatttggtttctatttcttgttaccaggaactctgattaatacacttggcgccaaaaacaatgcaagttattaaaaacagggccatgaggtctgacacacctgtgggactgagaacgctaagtgaacacacttgttctcctggttgctctcttagccttaaggacaggcaactcatgaaaaaagaaaaatagccaagaaaatctgaacctcaggagtaaacaaagaagtaaaaattaaaacagatagggccagacacggtggctcatgtctgtaatcccagcactttgggaggttgaggcaggcagatcacttgagcccaagaattcaacaccagcctgggcaacatggcaaaacccgtctctactaaaaattcaaaaattagctaggcatggtgtcacgtgcctgtagtcccagctactcaggaggctgaggtgggaggatggcttgagccccggaggtggaagatggtagtgagctgagattgcatcactgcactccagcctgggtgacagagcaaggccctctctcaaaataataaataaagaaaataaaatagataacattttctcttgtcaaattgataaatgcccatacatagataaatacatgtgcatataatgaagtgataatagctggtgttggcaagggagcaagtgtcccacaaggcgacagagagagtgcacagcctgggccagtcccagggaagtccagcggagtgatggaaacttactatttgagaaacactttaaagacggcttactgttgtctgagccgtttttcttttttggagatggagtctctctgtgttgctgaggctcgagtgcagtggcacaatctcaactgactgcaacttccacctcctgggttcaagtgattttcctgcctcagcctccggagtagctgggattacaggcacccgccatcacacctgctaatttttgtatttttaatagagacagggtttcaccatgttggccaggctggtcttgaactcctgacctcaagtgatccaccagcctcagcctcccagccttctggattacaggagtgagccactgtgctcggtctctgagccgtttttctataggacaagagcagggacagtaattactcccatatgcatggtttttctgggaagtatgacttggctgtgcctttacaaaaaagtatggtaaaatatatgtaacataaaatgtactatcttcactgcttttaagtgtatatttcagtgaaattaagtacattcacattgttgtacaaccaatctccagaaccgttttactgttttcatcttacgaaactgaaactcagcacctttaaacaataactccccatttcccccaccccctacccatagcaaccaccattctatttcgtttttaccaatacgactgccctaggtatgtcatataagtggaatcacacagtaggtgtccttttgtgattggcttatttcacttagcataatgtcttcaaggcccatccatgctgtagcatgtgtcagaatttccttccttttcagggctgaatcatatttcactatatgtatagaccacattttgttttgatggacacttgcgctgcttctgctttttggctattgtgaataatgtggctgtggacatgggtgtgcaactatctattcatttgtagcctgggtaccagctcgggtcaccttcttttgatactttaataaaattgacttgaaatatacatacagccgcccactaccccaaacaaaagagaagggaagccttcctagaagttgatgtagtatctcaaggtgccccctgctccccatggagaccctgatgacaccacttctggagtgccaagtgctgcaccaggactctactgcttttgttctgactgcagcctcacgaggtgggcaaggccactgctgtcccatttgggcctctttacaaatgaggaaaagacgcacattttccctggcaaaactccagcttggacagcagagtagggagcacattggaggccccactcaggtccttggcatggctcccttgcacaaggtacagcctacactattctacatgacagccctgaggcaggcatggctggcaacccagccttactggtgagaaaagcgaagcacagaggtgaggagtctgcaaatttttttttaactttttttttttttgagacagggtcttgcctgttgctcaggctggagtacagtggcaccgtcgtgactcgctgcagcctcggcctcccagactcaagacatcctcccacctcagccttcgaagtagctgggaccataggcatgcaccaccacatcctgttaattttttttttctttttttttgaggcagagtctcactctgttgtccaggctggagtgtagtggtatgatcttggctcactgcagcctgtttcccaggttcaagcaattctcctgcctcagcctcctgagtagctgggattacaggcacgtgccaccacacctggctaatttttttgtatttttagtagagacagggtttcaccatgttggccaagctggtcttgaactcctgacctcaaattatccatctgcctcagccttcaaaagtgccgggattacaggtgtgagccatcgcacctggcctcacaccctgttaattaaaaaaattttttttttgtagagatggggtctccttgggttgccgaggctggtctcaaactcctaggctcaagttctcctcccacctgggcctcccaaactgccgggattacaggcatgagctcctgcgctgggcctagagtttgcaagtttgaagcctagggagcatgtagccggctttcaaatgtagatcttatttatattcacatatggtgaggccaggagatcaggatctgattgctatcgaaagaataattgttactcacagttcccaagtagagagggcgggtcataccaggcagggccaggagtggaggcctcagggtggtcagaaggcagagtcagggaggggaaaatgtaggcaggagcatttgctgtgtttctgagggaaggaatggtcgaggcagggtaggaagcaggcctagaattggctactgtgaataatttcagtgggcttgtcagtggggtgtaagggctggggaatagtggcctggagcgtgagaaccctggaagggccctgtaaagggaatagttggaaaatagactctggattggttggttggtatacaaaaggcatgctcacaagtgagtcccttaccatctctagccatgggaggggcagtttctctagggtcagcaaagccccaagatgtcaaacatcagaataaagacatgcttaatacaaagacaaagcctaggttctgaatccctttgccatcattttttaaccctttctctgtcagtggctttcaaacctttgcatttcttttcctctggcagggcaccccttttcctaagtgaaatcttgaggcagcccagtctgttaaagaacgctgctctggcagaagggaattgtggggagggaccctatcacctggcaccagttcatttttatttttaatttttttttgagagacagggtctcactctgttgctcagactaaagtgctgtggtgtgatcatggatctctgtggccttgagcttctgggcttgaacaatgctcccaccccagcctctcaagtagctaggactacgtgtgcacaccaccatgcctgactacccgttcattttattttattttttatttttatttatttatttttattttttgagatggagtctcgctctgtcacccaggctggagtgagtgcagtggtgcaaccttggctcactgcaacctctgcctcccgagttcaagtgattctcctgcctcagtctcccgagtagctgggactacaggtgtgcgccaccatacctggctaatttttgtgtatttttagtagagatgcggtttcaaccatattggccagactgatcttgagctcctgacctgtgaacctcctgcctcagcctcccaaagtgctgggagccactgcgcccagcccccgttcattttagaatcagtcttcaaggctgccccacggagagtcttctggtcccccttaacaagagcagaaaagtaaaaggataggcaggggcagggcacttggggtggctactcagtggttatgtggccctgggtcagtgccatccctctctcctttttaaacatctttattgagacataattcacatagtatacaattcacccatttaaattgtacaattcactggcttttagcatatttgcataattgtatatctatcaccacagtcagttttagaacattttcatcaccctaagaagaaactccttagctcaggggtccccaactcctgggccacagactggtaagagtaatggtccacagcccagcctgttaggaacctggccgcacagcagaaggtgagcagtgggcaagcgagtgaagcttcatctgtgtttacagtcactctgcattgctcgtattaccacctgagctccacctcctgtcagatcagcagtggcattcaagtctcatagaaccatgaacgctattgtgaactgcgcatgcgagggatgtaggttgtgccccttatgaaaatctaatgcctgatgatctgaggtgaagctgaggcggtgatgcttgccctggggagtggctgcaaatacagatgaatgttagcagagaagtttgcctgcacagagaccatcataaatcaattgcttgcagacccatatcaaatccccatcagtgagtggcaagggaaaattaagctgaatctggtggcaggttttatggtggcaagtgagtcaatgtacttcagttgcacagctgccttgaaagtatctttgagacaacttcaagtctctgtacgttctggattaaagtcaaggcagaatgtcctgagactgccagaaaaacactgaaaagcctgcttccgtttccaacatcctatccttgtgaagcagggttttcctcagtgaaccaaaatgagattatggagtagactgggcataagcaacacacttagggtatccctgtctcccaaaccccctagatgggaccgtctagttgcaggaaaacaagctcagggctcccactgattctacattatggtgagttgtataattatttcattatatattacaatgtaataataatataaataaagtgcacaataaactgttatgcacttgaatcatctggaaactacctcccatcctccagcagtctgtggaaaaattgtcttccatgaaaccagtccctggtgcaaaaaggttggagaccactgccttagctgttctctcaccctgatttctcctctcccccaaccctaggcaaccaataatctactctctgttgctttcaatttccctattctggacattccatatgaatggaatcatttactatgtgatcctgtgtggtcttctatgactggcttcattcacatagtatgttttcagagttcatccatgttgtagcatgtatcagaacttcattcctttctatgattgaataatatttcgttgtatggacagatcacattttgtttatccattcatcagttgatagacttttggggagattccatttttgggtactacggataatgctgctatggacattttcgtgccagctttcgtgtggaggtatattttcatttgtcttgggtgtctactagctaagagaggaatggccgggtcatgtggtgtccatatgtttaattttttgaggaactgccaaactgtgtctcaaagtggctgccccatttgacattcctaccagcagtgtaggagggttctgatttctccacatccttgcaaatacttgtaattgttcatctttttattccagccatcccagtggccgtgaggaggtatctcattgtgtgtgggtgttttctttttgagacagaatttcactcttgtcacccaggatggagtgcaatgatgcaatcttgactcactgagattacaagtgtaagccaccgcgcccggcatcagccatgtgtttttcaaaaaaaatttcttttttctattctgttttttgagacaggctctctgttgcccaggttggagtgcagtggcacgatctcggctcactgcagccttgacctcccaggcactgatcctcctacctcagcctcccaagtaggtggaactacaggtgtgcaccaccacgcctggctaatttttaatagagacagggtttcaccatgttgtccaggctgaaatttttattttttgttttttgagacagggtcttattctgtcacccagactggagtgcaatcttggcttactgcaacctccacctctcgggttcaagttattctcctgcttcagcctcccgagtagctgagactacaggtgcacaccactacacccagcgaatttttttatttgaaaaaaatgtttaaaaaaaatttttaggccaggctcagtggctcacagctctaatcccagcgctttgggaggccgaggcaggtggatcacgaggtcaagagatcgagaccatcctggccaatatgatgaaaacccgtcttcactaaaaatacaaaaattagctgggtgtggtggcgcacgcctgtagtcccagctacccgggaggccgaggcaggagaattgcttgaacctgggaggcggaggttgcaaagagctgagatcgtgccactgcactccagcctggtgacagagtgagaatctgtctcaaaaaaaaaaaaaatttttttttaaagagggtctccctctgttgcctaggctggtggtgcagtggcacaatcttagctcactgtaacctcaaactcctgggctcaagtgatccccctgcctcagcctcccaaagtgctgggataacaggtgggaaccaccttgcctggctccagtgtggttttgatgcacactttcctggtggctcaccttccctgcttctcttatactctctgcaaagggagaatccagaggtttctcaagttccctgaggggtgctgtcacgcccctttcctccctgtcaccacactccctactccccaccccccacctacagctgtgattctccatggtgctgagaggaacccttcgtgaactcaggatgtcaagctagagagaccttcatcttcatccagtccaaactgctaaactatctgacaggtgaggaaactgaggcccagagggatgtgggttacttaattaatggtgcctggcatgttagtggcagagctgggttgagaccagagaatccatgcttgcacaggggacaaggagctctgggtttgattctagactgtcgccatgactgtgccctccctccctccctccctccctccctcccttccttccttccttttcttccctttctttcctttcttctttcgagacagggtcacactctgtcacccaggctgaagtgcagtgttgagattatggttcactgcagccttgacctcctgggctcgagtaatcttcccagctcagcttcctgagtagtcgggattataggtgtgcaccacctccagctaatttttaaatatttttgtagagacagggtctcactctgttgctcaggcttatcttgaactcctgggctccagtgatcctcccgccttggccttccaaagtgctgggattacaggcatgagccgccactgccggccttgtgggccactttctgaacctttctgaacagcagtttcctcatccatataatggagatgatacctaccctatggggttgttttgagcatataaaatatttaatatagtaagtaaataacttatttaattttggaataattactatttaagtgcctatgataaaagaaagtcaaatagtacaaaggagtataacgtgaaaaagaaacctctttctccaaccccgtcctgggggccaccattaccaccagactcttgtcttttctgtcagatctcttctatggatataatggaagttatttatcacatgggaccttagagttggagatcattaacttgcctgcttttctaagctggtctttcccactttgccccttcaaccccccttcttgtggcagcacacaaaccgtgggcctcccttatttgtccagctcccccttcccaagccccctccacctggtaatgatttcctagagcgtctcccaggggtctccatggggacgtttcctgctccaatctccatggcaactcttcaggttgccatggtgacacttaagcgattatttggagacccttaaataaatcacccgtggtggtatatgctagacgtgtttggctctggctcttgtgtttggggccagggttggggcccaggcccgaaggcagaaaatgtggggaggtgggagatggtggtcagagcccgatgcccttggtctggccctgtgaggggccctctttgggcaaaattggaattgagccttttgtgaagtggtgggaggacaacaggcagttatgcttgtgcagtccttaaatagggagaccctgcagccagcaggacatcttaactctgatcaggatgggggcaacttggagctatgcagtaaccaagcagggattccactccaggcctgctgggctccaaggccctcactcctccttgacgtcaaattctaaaagggaatttaagatggaatccactccttcatatattcatttatttgaccgatgtgtttaaagtggctactatgtgccaggcactgtgtgctaagcattgggaatacagcagtgaattaaaaaacaaaacccctgtcctcatggagcttatattcgaccagcgagaggcagacaattagcaaaacaaaacatccatggccgggcgcagtgcttcatgcctgtaattccagcattttgggatgccaaggtgggtggatcacctgaggtcaggagttcgagaccagcctggccaacatggtgaaaccccatttctactaaaaataccaaaattagccgggcatggtggtgtgtgcctgtaatctcagctacttaggaggctgaggcaggagaatcatttgaacccaggaggcagaggttgcagtgagctgagatcatgccattgcactccagcctgggcaaaaagaacaaaactgtcccccctctccccatcccccctccaaaatgcaaaaaaaaaaaaaccacccaggttagacagtagtttcagtattagggaaggggcctagagaacagcagggtaagctgtggcacacactgacaccagggccgggttgggggggggtcccaggcaccgtcttggggctcagcttcaggtcccaggacaattcctgaaaggtaagagggtgaggtatggaaggagctagccaatacttgagactccatcagcagtgaccagctccctccgcgtgttctgcctaagcgatgtacaaagctttccagcttctagatgcctcacggatgcttggaagcagaaatgcatggctgagactttaatctccactatatagactgggaaacagatgcagaagggaggcagcctgccgaaggcaatgccgctaatggcaggcagaaaggtggctagaactggagtcatggctatcccagtccaggtccatttctgccagaccagtggatttatcaccagatctgcaaattcatacttccctgagtgctgtcttactgaataagtagcttatcttgtacatgaggaagatcatgttgtctatggggagagattgtgatttacctgtaacaccagtgtcaggtgattataccatgctccctgactcggagctttactgcaggccactcgggtcaggcctgttcctcggtggtggaacagactgcaaggtacaagaacaggcttcttctagcctccgacttccccagcccactggcactcctcccagaaatgaagtttggaagcacaggcctacttaaggcctggacaacccaaaaagcttcctgagaaggtgatgagactcgggtctggatacactgggctctcttcatgttttttccctttcctttctttttcttttttttccccctgaaacagggtcttcttctgtcacccaggctggagtgcattggcgcaattttggctcaccgcagcctctgcctcccaggtccaagcgattctcatgcttcagcctcccgagtagctgggactacaggcacatgccaccatgcctggctaatttttgtatctttagtagagatggggtgtcaccatgttggccaggctgatctcgaactcctgacctcaagtgatccatctacctcggcctcccaagtgctgggatgctgggattatgggtgtgagccactgcacttggccttttcttttttaaaaaaattagatccatatttttaggacgagttcatttggctggtgagttgttccatactccttggcagattccagcttccatgactaccatcctgcttctcttttctgagtgtggactatccaccttcatacaggtctcagggttggggccaggctagcaggaaatagaaaatcatttctggttagcctaagccccaggaagcatttactggaaagttcttggagagtaaatggaggagctgaatggccaacccctaggctatgtggctactgagcatgtgaaactcgctatgtgctaagtgtaaaatagacactggaattggaaaacttagtatgaaaataagagtgtaaaatatctcagtcatttttatattgattacatgttgaaatgacattttgggtacgttgggttaaataaaatgcattgttaaaattaatttctcattttttctccctaggctcaggtgatcctcccacctcagcctcccaagtagctgggattacaagtgcgtgccaccatgcctggataatgttttgtattctttgtaaagacagggttttgacatgttgctcaggatggtctcaaactcctggattcaagcagtactcctgcctcagcctcccaaagtgctgggattacagacgtgagctaccatacctggccaatactagatttaaaattacatatgggccaggagtggtggctcacacctgtaatcccagtactttgggaggccgaggtgggtggatcacgtgaggtcaggagttcaagaccagtctgaccaatatggtgaaaccccatctctactaaaaatatgaaaaaattagctgggcatagtggcgtgtgcctgtactgccagctacttgggtggctgagacaggaaaattgcttgaacccaggaggtggaggttgcagtgagccaagactgcgccactgcactctagcctgggcaacagatcaagactccatctcaaaaacaaaaacaaaaacaaattacatatgacttacataattactgtcatctatattactatatactacagtactgctggacagtgctgtgactagattaattccacaaggaaaagagccataggaatattgctcatcattctaaacccaggacctggtattggcgccaggatatagtagggggtcaaaaaagtgttatttgttgaatgaatgtttgacagtcacattttccatcagccctgaaacattttaaacagcctgcaaagggaatgtgatctaatttaaatgtcagtttatatatttaaaacaaaacaaaacaaaaaaaccccaccgtaactcaagcatgaaatttgcaagaaggggaaaggaaaagggagaatgaagggatcagggtctcagtctcttttttctgagggattagggggatattctgacctttgtcaagccaaaaaagaaaaaaagaaaggtcctgcccatcagaggcagagatacgatcatcctccacttcctgtggccctccccctctttctttgctaacagaggcgtctatttttagctaggcacatggccacccagagtccaaacattttccagcctctctggagctgggtttggctacgtaagttctggctcatgggatgtaaacagaagtgtcaagtaacttttgggaactttccttaaagggaagtgctatgtctctttccccttctcctggctggaatgcctagaacctcagcagccacattgaaccatgaggaatggtggaggggtggtgtagcagaaggctgggaggggcctgggtccctccccgacaacttggtgaactgtcgtatcagccttggaatgcctactgtggacttttcatgtcagaaaagaaaatcctatgtatttcaggcttgttgacttgcattttttggtcaccttgtcctaactggtgactggtgcctaccagccttacgttgctatcactggaagggaccactcaactaccttgagaacactcaagtaccttcccggacagggtctgctccaagatgactggatttctttaccatcagctgttgatttatttttttgagacagggtctcactgtgttgcccaggccggaatgcagtggatcttggctcactgcagcctccacctcctgggctcaattgatcctcccacctcagctgggaccacagatgtgagccatgatgcccagttaatttttttgtattttttgtagagatggggttttgccatgttgcccaggctgctaggtattgattaaaaaaaaaaacaaaaactggcaagaccttcagaaggtacaaaattagaaaggtacaatagaacagagtgaagcctgggcaacatggtgaaaccccatctctaccaaaaaaaaaaaaaaaaaaaaagaaagaaaaattagctgggcaatgtgcctgtagtcctactcgctctggaggctgagatgggaaggactgcttgagcctgggaggtgaagaggttgcagcgacccgagatcatcacgccactctactccagcctgggcgacagagcatgaacctgtctgggaaaacaaacaaacaaaaaacatagggtcacttcctacctctgtccttgtcatacccattttctgttccattcttcttcttcttcttttttttttttttttaacagggtctcactctgttacccatactgaagtacagtggcgtgatcttggctcatcacaacctctgcctcccaggatcaagtgattctcctgcctcagcctcctgagtagctgggattacaggtgtgtaccactagtacccggctaatttttgtatttttagtagagacggggtttcaccatgttggccaggctggtcttaaactcctgacctcaaatgatccaccagcctcagcctcccaaagtgttgggattataggcatgagccactgtgcccggccctaatatattcttttaaagagagagaaaaatgttaagttctcccttatgggataccttcttacataatctaaatacatagctgttgtcaacatccatacctctacaaaaaaacctgcctgtctgaattattctggtcttactacctgtgactctaaaatgagatcacgcttaccttatggcctgcattaaagtgttcaagccctcaaccacacagtggccacatccatccccttcccgaacccttctccccccccatgtaaaatacttcccacgacctactgattgagcagacagctgggtagtcattatgtctagggaggctggatcccaagtccaccaagctccacttagggtcaaataaagagagccaggggattggtttttagttgtgaattcacagaccatgtttttcagtaaaaaaaaaagtcactgtattaataattgcaaacatttaatgtgtattatgtgccaggcactgtactaagacctttttatgtgtaatcacgtttaaaactcacaatgacccaatgagtcaaacactactaaacagtattcctagcttataaatgagtaaagtgaggcaaggagaggttaagtaatttgttcatgtgcaccagatggaaagggagaattgacgctgggcatggcggctcacgcctgtaatcccagcactttgagaggattgcttgagcccaggtgttcgagaccagctgggcaacatatagcaagacctgtctctatttaaaataaaaaaaaaaattataaaaataaaaaaaagaaagggggagttgggatttaaatcctgacactgattgtagaactcaggctcttaacaagatgaccctgaccagatggtaagctccattcatgcagggaccttccccaagggcctagtgcactgcctggcacagagcagaagtgtagcaaatattaatggattcaaatgttcacacgctaacactgccagtaggttgaggaaaggatggtggcaacgtttcccagtgactgcaggcttgtgtcctcgctcagggcacactccccagaatccaagcctaaggtaaggaggccaaattagtgtcatgagaggccctgtgggaggggttggaaccagagggctgcagccacagaaggacctttctttaccctggtgggcctgatgtgcccacgggagcacaatcccttgatctgcagcttccaccccagagtgtgctggacacacttctgcacactgaacctgagcctttttgcttcacccgcttctgtggaattccttttagatgtattaacatctttttttttttttttttttttttttctgagatggagtctcgctctgtctcccaggctggagtgcaatggtgtgatctcggctcactgcaacctctgtctccttggttcaagcaattctcctacctcagcctccccagtagctgggattacaggcacgtgccaccacacccagctaatttttctatttttagtagagacggggtttcaccatgttggccaggctggtctccaactcctgacctcaggtgatccactcgcctcggcctcccaaagtgctggaattacaggcgtgaaccaccgtgcctggccagatgtattaacatctgattcacctattgtgtttactgctgcacccctaatacctagaacagtgccttggaagtagcaagccttaaatctttgttgaatgaataaaagttaagctatgcacctgatcctggccagacggcccttcagactccagacttgagtcctttcagcgcctcctactgggactggattagctgcatctcagagggcactttatttcctacatttctaagtcacaggggtgggggtaactggggcattcactgttgacctccagcacccgaagaggtgagctcctgacgggggttggttctcattctaggagttagaactcatacaaggccaacgtcctttttcacaacccataaggatgattctgctatagttttaggtaacgcaaatatttcctctcttgggttttggctgaaaaataaagaggtctgccaacagacagcaaaaatcaagaaaagtaaacatacaatgccaggttcaatcagacatgaatcaatgggaatacacatggataaaccctgaaatagaaacacggcaccatagtttaactgacacatatatatactgaaggactccagaatgtctctcccacccctaaagtgctgaacactgcagggagctgtaactgagtcaggagctattttaatctcccttgtaaaaaagacgtaaaaatggcaaagaactggacagaatgctagtcaagaatttgtaactattcatggatgagatggaattcacacgtatttttatttcttccaagcaggtacagagactcaaatgtaaccctttgagctctcatgcttgaggatgtgctgctacctggcctttgagctctgtgctggcataaagcccaaggcctgggcagggcagatgatcaaagtagggagaattttaacaccagtcatgggacacagtggggagcacaaacagtagggtttaccaggcaatgctgttgatgttgatagtcctagcaaggctggcagttccaggaggaggaccagcacctccaggacgtatgacttccccccctacccatgggtgatgtgatccttcacataaccattctgctccaaggtctgccttgttctcaagtgctatacgctgattcgcacccatcacaatcacacacgtctcacacagactccagaccctgcagcgcccaactgagtactcactcacgcaaggtgaggctccttggcggtgccatctttattattcccagccacaagttatagccacaacctctcttccatttaaagtgtgcgtcacccgcagaagacaacaggtgccggagttcactcctatgattcaattctaccctcccctggcctttgcacggatcccagtggtcctggctcggatcaggcctacagcttacttcccaggcatgcttccaggaaggcagttggggtggggggtacccctttatggctcttcccaggttacatgagaactggtgatctcggtggggtctcaagtagaagccctgaattagtgttcattaacaaacttaatcctttgtcctaaaccaggctctagctcaattcaaagataaaggggggttaaacattaagaaaaatggcattttttttccacatcactgataccccaagagaagttaataggtctaccttgtagatgcagggaaatcaaaaggtcaaactataattttttataaaaactaatttttttttacgcttaatttttttcttttttttttttgagacaaggtcttgctttgttgcccaggctggagtgtagtggcacgatcttggctcactacaacctccacctcccaggctcaagtgaaccttccacctcagccttaccaatagcaggtactacaggcatgggccaccatgcctggctaatttttgtattctctgtagagacggggtttcgtcatgttgcccaggctgctctcgaactcctgggctcaagtgatctgcccccctcggcctcccaaagtgctgggattataggtatgagccacagcacccagcccaaactacaaattttaatagaattttaaacccaaccactggccaaaaatcactcggtcacgaattcctaatccacaatcacatcagtaggaagggaaagcactcattctaacacagatccaagaaccaatggctaccccgggtaccttaacagcatcaactcagaacttaaaaaatcaactagagatcatccaaggaacgtaagtataattctacaaaaaaccatctcatccccattgcagcaggccccaaactccagtgaggcttccataggccatggagaatgggtttggctcttgtcacagggtagagccccatgataggggtctgaggtagatgaaaacaacagggtagccaggggcatctatagaagatgttacagagctgcctgggcctcatgacagttgcacctcagttacaaatcccagacggctctatttgcttaaaccagtttttccagtgacgcttacatgctgactttcttggtttctatagatgcttggtttcaaaaataaaactaaaataacaaaaattccaaatccctcaaatggaacaaataaataatagtaacaatatttacataagtatgtcacattgagagattccagcatgaccaaggaatggaaaatccaagaatgtgccctggcctgtgtggggctcaggcctggctcatcgtcaggtgtgaagacaccatggggagccgatggatgtatgcagtgagctgggatggaccatgacacctggctgggctttaagtccagggaagcagtgtgtgcacgagctgtggggccgtctatagattaggtttcaagcaagcaaacaataaaaccctcagctctcccgagcagcgtggcacagtcagggtcactggtgtgagctgcaccctatcagaggagaagctgctcctggggatgccaagagggcttctctgattgctggcataggtggggacctcaggacccccgtcccagggagcacaaaactctttatacatcagctggagacaggacaaggagtcaaggtcaggcatggtcccctctttctttggactatgtgacaagggggatgtggaattcatttgtgtcgaagatcaggggcctcttgggagggttcgggtccctgtcagccttgtgaagcagcttgaagagcccggttccaatgttcattgggattcccatgatgatgcactcagacacccctgaaaccaaccagaatgaacatcagagagcctctaaacacaaggtacattttcacgaagaaagactattggcttaagtgtcagaaaattaggatgtgagtcccagcgccactccacatcaactgaactttggcaaatccctttccttcccatctaaaaagggtggctgtggagtgcagacagggggattctgcactttcagggaagggcagggcttgctcacagcccaggagcttgttggagacagagtcagctcctccagttctcctctcccacctgagccaaaggcaccctgggagggccctgcctttgagaacacaacttagcaagaatactgaaggatgcttaggaaactctaagtttgccacccagtgcttccttaacttagagcctccaagaaaagcaaacaactgggacagtagtgagcagaatacaatccccttggaaactgcggtaggcagctgttagctgtgctcaggggaaggggccaggccaggcttaagagcatctgagccttcatgatctacagccctgatgagaaacacccagaaggcagggcacctatagagttacaggatcaagggggtggtgcagattctttctccaagccccatgtcaacctggcataaggcttgagtctacgatgagcaagcaaatggctactgtgttgtagactttgtgctaccaaggaaccggagaggcaaacaactaaattaaagaccaacatgcaatgagggcgaacactgggttacaatgtgctgaaggaccaggaggaggggaaaacttcaaattgggggtggggtggcagtgccaggcagtcaaggagactggtggtggagaaaggtgctggtgtatggggccgcagagctgcggcaaaggcccggtttccaggtgtcaggcttgagtgctgggtctcagccctattgtcaggcagacttgctcttctcttggccttgggctttcttccagtcttctgtgtacctccctctggccccattctaactgctgctccttttcttttcccttcatgctagttttttttttttttttttgagacggagtcctgctctgttgctcaggctagagtgcagtggtgcaatctcggctcactgcaacctctgcctcccaggttcaagagattctcctgcctcagcctcccgagtagctgggattacaggtgcctgccaccgtgcccagctaatttttatattttttttagtagagacggggtctcaccatcttggccaggttggtcttgaactcctgacctcgtgatccacccgccttggcctcccaaagtgctgggattacaggcgtgagccaccgcgcccggcccacgcttgttttttgattttaaaaatatttaaatagacacgagttctcattatgttgcccagcctggcctcaaactcctgggctcaagtgatcgtcctgcctcagcctcccgagtagctgggacaatagcaacaccatgcccgctctcacccttctttatcttaaagacttatgtaatatttatttccctccatctccaatccctgtcccttctgaaaagagaaacagttaatcttagaggcaaaaaatgggtatatactctaatgatgccaatctgtacaagagcaggaggtgagagagcaaagggctactgggaagcagagctctggcctggaaacagcagccagacttggaatccctgtgtgggcctgactggtgtgtgccccggggcaggttgctggccctctcgaaccccagccccttaccagctctcaccccaagcctgcagggtcttcctgcggaatcagaaaggctcgagcaaagctcagcagtcagtgctggtctcacggaagaggcagggaagccagacactggggagagttcccctcgtgctccctctcccccaggccagcacagccccataaagccatgttttgtcgagtggcggggatgaggcatggtgcagagcaaggctctgctggtggactcgacagcaagcgaggtcaccttggtcttctgacttgtcaaagggcttaatatccacaccccacgggtgggtagagatacttgacacatatgatgcctggcacaggggctcagcaggcattgatggccacctcccaaggacagtaggacactctgctctgcccagcgcccagccagtacctgctcctgtcagccctggtgtcacacacaggggtcaggatcagtgtggctgactacaaagtcaagggctagaaaaattcttacatgcccagggttgctctttgcttcgtggaccaaaaaccatctgtgctgacagagggaagtcatccaacagatgtaaacggggatgcaggatgctacagtcaggatttggagataaaagatccagcagttccaattcgtgtctattgacattattcttgaaaaaataaacgctctgccactcagtttttttcattcccttggaagcctagccatggtctatttgtaaatagtaaaggcctttgatgctgttcatagaaacatcaaacctaccacacacagagtccttctgcccgaagtaggcagcgtcaaagagatggtcagccgtcttctcaaaggaggccagcatcagcacactctccttcatcttggccaggccaaacctagtgatgcccaggacttcaccctgcgtcaagggagaaagagtcacggtggtactcacaccaatggcaaaagctcgaaaccaaagcacggtgcaccttcaatacaatcaacaaaaatcctccaagacccaacgtcaggtgtgaaaggccctgaggagctatgggtccgccctctgtgtcccattgaggtggtcaatcgtcggcaacatgaaacttcacactcgcatccagacgccatcagaacaaagaagaattgagaactagaattcagagactaactttaaaaaaggggagtatttctgaagagatttcttatggctcaaagaactaaaaataaaagaatgtaaaaacctcaagtatgaagagaattaattaaatttaggtaattctactcaaaggaatattgtgccataatttaaaaagtatatttattaaaaccatgaaacaagatggaaaacatttgtgatgttaaacaaaaagtcacaacaaaaactgcatgcacacagtttcctgcgactaaagcaaaagatgcataaagaataggacttcacagaagacatcgaaccgacagcctcagggtggtaggaaatgggccatttccctcacctggtttctaaatagtctgtaatactctatcgacttgtttggggaagccttatgaaaacctgctgccctaaggcacagctagagggaaatacgttttttttggaaaagagagaaaaaaaaaatcaaaccaaccaacccacctcagcctcccgcccccaacttcagatcatgttaacttattttttcctgggaatggctacagaagagtgatggatgggtttaataagaaagaaacacctcaacttgccatgggactctctgggctttggcagtggctaattttgctttaggatgacattcaggatgaggacggaaccaagctccagctctcttcactccaccgactgggtatgagtttgccatgaggctgtaactctcatactgggatttcaccaggacactcagcctgaccagcatactttggtttttgagcaatgttcacatcttattttctctctatgatggtcctcacagcagcgtattctacatgtcttagaaactccacaggcttattctcctgaaagtgagtttcgggatgcccaggcagcccgggggcctcctgcccacataccttgtaggtcatgaggtcggagagcagcatcacgtgcctcctgtcgatgctcatgccgtggttcaccatggtgtactggatttcattgatgatcgttgtccgggcggcctcgatgcccagagttttctccacctacagagagccagtaatgagcagaagcagccccttccgggaggccactgcaaattctctccactttctcctctgccctgcagtttcaaagcaaaccctgtgccgttttccagaaatggattgctgggcaattttcagttgcagacccacggcaaatgggatggtcagagaagtatgctgggaggccgggcacagtggctcatgcctgtaatcccagcactttgggaggccgaggcgggcggatcatgaggtcaggagatcgagaccatcctggctaacatggtgaaaccccatttctactaaaaatacaaaaaaaaaaaaaaaaaaaaattagccgggcgtggtggtgggtgcctgtagtcccagctactcgggaggctgaggcaggagaatggcgtgaacccgggaggcagagcttgcagtgagcagagatcacgccactgcactccagcctgggcaacagagcaagactccatctcaaaaaaaaaaaaaaaaaaaaaaaaaaaagaagtatactgggaatcagtggaaggcctgcagatggcacaaggaagacagcctaaccctaaggcgaccccgtgggctgagtggtacctcataggtgttattggaggtggttcgggtgcccttcacaccgtgtgtggccatgactgcccgcaggttatcaccttccaccagaagcttgtacttctcctttccactctgctcgtcaatgtggatgacagctctggacacctctggaatgccctgcaccaccacctggattcagagacagagaaagctgtgaggacggggtgagccatgccctgggctgatcaccttgatcaccccagctttcagcagtggtcatctgttaacacactagagctagttttagggataagggagaacagaagttgttcaggggactgcacctcatcctaacatcagttttttgatagaacagagaggaatctaacagactaactccttggggataaggccaagaagaaattaagaaatcggactaagtgacaaagcccttaggtcccagccctgggtgtcacaccacagggagatgctgggtctccatgagaagcgacttctgtttcaccttggggagatcctctttcaggaactgcagcacgtagtacatggagctcttgctgttctctctgggggtgacacacaccacagcctcaccatgaacagccacatcaccgggcttcacacggagcttggatgtgcagatggaatatctcactgtctcagcgttcacctgcaacatggccaggtgtaggtgttactgattccagtgttgttcttcgtttatttcattgttgcccctctaagaagtccttttagtcaggtttgttctaagcaccccccacccgcaccatgaaattaataccataaatatgctacatatgttttatgtactatatgtgtatatatatctatgctttattcataaaaagagtagtttttttcacccacgacaaaatatttgcccttgaaaattcatgctcagttcatggcaacacacgcagcctctgtgggaagctctagggaggctggaggttggaggccaggctaattaaaagcttccgtggggcctcccctttacctgacactttcacaatggttcatgtgctacgttcctggatacaactcatctcttctgcaaaggagccacaaggcaggcagcaagagacaggctagagaaatccccaaactggagagcaggttgctgcatttgagtcaactgttatatgggtaacatatgaacttgatgcgtgagagaacgagctgacagaatgtgttttaagggctagtacagctttaactacccgagagaaagaagagggtgtcgggaagttactcagtttgtaccccaagttggtctgtttgtgagaaaggctgatcatctttcaactgttgcctattacccatgcatgccagtttaagaagccaggttaatctccccatctaaacacatttactgaacttcctaggctagctgccatgctgggcgctggggatccacagatgagtaagacacagccagccctagggtccttccagacactgggaagagggacaacaagaccacttatcataataccgtgtcacagtgaactggtattgcggtctgcacaaaatttcaactaattttctgtgtgtctttagatgggtatatttgtatcaaggtcaggtttagaaagaaaatgtgaggggacaacagaatcacaaaaaccagaaaccacacagaaggttctgcaatgcttcctctgtcttgcttagctcttgccctagtttatcagtacctatcttgggactaacaggatgacttcctctctacatttaattatgtgactcacttccagtctcagaagcctaatccgttccagggagagcttgacgagaataaagcagtcatcaggaagaaacacttcttcaatatactcggaaatctggagtgtcaaaagatcagactgttaatcagccgctttcccctttcctaagagcacacgactgcttgcttttttgaagagcttgagtagtgtggacgccacaggctggtcaatagatggcagctgatttttacacttccttgcaacattgctgagctagttttcttgttatcaatagggatttcttcttacctctcccaagagggttttctcaattctccctttcacgaggcgagcataatccgcgtcgtcatccttgtctagctgtgctgtgataattggagtgctgttgagaagcaaaggaaaaatggcactagcacaagggaggaggctgtttgaggactactgctttgttaaacccaagtgctatttagaatcataatgttactagcaaccccagtttactgagcaagctctgcctcccaggttcatgccattctcctgcctcagcctctggagtagctgggactacaggcgctcgccaccacgcccagctaattttttgtatttttagtagagacggggtttcaccatgttagccaggatgtcttgatctcctgacctcgtgatctgcccgcctcagcctcccaaagtgctgggattacaggcgtgagccattgcgcccagccgactatctttcattcaatgctacgtattatcattttgttaaatataggtcataggtaaaaatcattatttttgtcatcgaaggcattgtaatacatttctatttcttctagccttagatcaactagaaatcccatcatgaaatcaccaggggctcacagaatatgaccacagggcaagtggcagacatttcagtcaggcctagttaggctggaataatgacatcaaaaggatgaaatctccactgacacattgctccaatttttccagtcattttaaacattttctctcttcatgttacttgtggccataacaaaaccattgcttctattttgactgtatccagtttagactttttcttgagtggcttttttaaaaaccaaaataggattaacacagcaagcatgccacccagagtttaagacacagtcctatgaggatatcacacatatgcatgtgacacggggatcattgtttctcaggaaacaggacaggcatgtgtggaacaagaaggaaatgaaagcaggcacctgatggccttggaagcgttgatgatctctttaatccggggcacgcccagggtgatgttcatggaggccacacctgcaaagtggaaagtcttcagggtcatctgggtgcctggctcaccaatgctctgggcacacagagcacccactgcagaacctggctccatctgtgccctagaaggcaaaggtatggatgagattgcagcatgccaaagaaaagtccagcaaaactgctggggagaggcttctggttatcacctttcaacagagaatatagatgctattagggtcggaaagggtatgtctgtgacagagaaaaagcctggcatagaccagaaataggtacagacaggggaaagtaaaggtcagagagggggcagcagtgcaactcaattctgcatggctgcttgtggtcagcatgtaatggatgcagaaaatctaagcagtctgctaaccaatggtactgatggcaaacagagcagtggcatctgccatattcgttagcagtttccccatggggagaagacactaagaaatttccttgcaattatttccgttatcttggagcattcagactggcaattcatcagaccccctacagaaaatgtgacagaatctgatcaaatactggcagttaacaagtgagctggtgcagggttttgtacacatggggaaacagaagggatacgtgagacctatgtggatgaccgtcagtccaagacaaaagcatccctacctcatgtacttgtccctacaggtctccagaaacttttctacttgggtgggggtgatgcggtccagctggtacagcacacggggctgggagaatacaagccaagcacagagttagggccagcggcaactacaaacagctcggggttctaacgcgtcttggagggatattacctctgttgtgccgttatcattgatgccatatttatctctggttttcttgatcttctcagagacccccttaatgaatttttttatttcctgaaagattacacagcaaacatcatttgtaagtttcacagtcatgcagatgacataattcatttcataaacctcagttgtatatgacaagtccatcatattttagtgttagctccatatatagtataaaggacccaatctggatactgcttctactacaaagtggttttccaaggaacacaccacactgtccataccccagacacacactccattggttaatgtgtctctaagaccttctcctccaactgctctcatggcactatctacagagcccacaaagtgcgtgggagcctttgttcttgctctcccacgtgccacgagggctataagaacacagctcaagacaggtacgactgaagcatttatactgttcttctacagattaatttttgagggtttcttctgaaggtattatgctcagtttaaatactaccaactaaagcatagctttgttgacagtaaatgcatttcaaacacactttgagcttaccttcatttcaaagaaaacactccccaaacccagcttatcttttcccctctggtaaccacctctccccacaggcctaggcctacactgtcttcccacacacaattagaagtctgtaaggattcctggaaaccattgtcaaagccagatgtgaagcatcagtatatgctgcgattcccactgtatttaagaacagcactctcagccccgggaggatgaccaagtagagcaagaagaaggtgaaaaatacacaggtggaagatcagagcagggctagagactacagccctgactcaggttttctggcaaccactcaaatgggtaaaactatctgttttaggatttacagtgtgtctgtgaaatagacccagcccaccaccactcctaaagccaggatcagccagcaccttcccctggagagtgctcacagggaaggagcacttacagaggagcggttaacatcctgctcacagtgggtcaatcatcacggactacagactggctcttaaagcaattctcagggtgagctgatggcacctgccatgtagtagcaaccatcctccagaggccattatcctgccatcccgggagctggcatcggctgctctggtgtggcctagggatgatatagtctctgagaatatggggaagaggagatagactgcccctcctttgtagcagcaaggaaatcacagtggcggtaagcttgaatggcactctggccaaatgcaggcattcagctgctctgtgtgtctggatgagtacagatgcccacacatggaggacaagcagcttgagggcagactgcgtactgtggtggccgagaagcctcatgaggttctgtttcttgattctggggtaggctgagggtcccccagagagaaggccagcatgccctgcccaaagtccactcagcctattacatggctgaaaatgcctaagcctgaaccaggagcccatttctgcaaaaataaaatcctataaggtatccacagacagcttaagacttcctagccccattctatcctaaccttgcaaaaagaaatctcattagcctcctaactagccatttctagttactaccctttctacaagcaaactgctagaactttatgttcctgttaaaatagccttagcatctgtgtccacatggtcttatgcctttcccagccagctgctgcccagcttggcaagacctcactgtgaggtggcatggctttagccccaccaccctagagcagaaggcactgaaggcctgaatgaggtcagcgcttggccaaggcaaccaaccactccacgaagtcagatgctttcttcaaagtcttttctctgaacaggggtttcttcgatgtaatctttgcctactgggaaattccgtctgtctcccaggagcccaggcagccaaggggctacctcgggggcccaacacatcctggctgtcagttcccatgaatactgctttctcatgactctctgtgttggcccactctctttcttcccactgagaaagtgcagaggcccacggagggtgaccctgcagcccaatcattgttctacatagaaagggctttttatttaagaagttttaccagctgggtgcggtagctcatgcctgtaatcccagcactttgggaggctgaggcaggtggatcacctgaggtcaggagttggagaccagcctggccaacaaggtgaaaccccgtctctactaaaaatacaaaaattagctgggcatggtggcacgcacctgtagtcccagctatttgggaggctgaggcaggagaatcacttgaacccaggaggcagaggttgcagtgagccgagattgtgagactctgtctcaggaaaaaaaaaacaaaaaaacttttattaattcgcaagaactttagagttctcaagaaactctttttaaagagaaactctcctgattccttgttattaatgatgagtctgacactgtgttttcagatacagttaccttttgcaaaccagagatgaaaaataaagctgtagagggcagtgggacaacctcttctggcatggctctaacagaatattcaaaggcatttgcacttgctgccactgaatttttcctctatatattcagtataagagggggctttgcctggcagtggctgggtccttttgagaaaggtcccgaaagccctcttggcccagatgttgccatttgatcaccagttgttaaaagctgccttacctgttggcacaggaaaaacaggagcagaacctaaggccaagccttagacccagaaggttttcatctgcaagggactgtgcacacatagggagtaaaattaacacacctaaaacaatctgccggcttaggcactgggaatgacatagctcagctttcaccccaatggacacatttcccgtgggtttgctgaatgactttccctacacaaaggttctggaaattaggtttaaaaataaaaaaagaaaaacagctcactttttggaaatgaaaactgaaacaatctgctaaaaattcacactgagtcaacccatgcatactagagggaacgaactcacaacatggctattggcaggcaattcatcacacgattaaccagaagttagtgtctcatgctccacagcaggcctatgagcacgggcattctcctctggcagggacctgggctcaatgccactcaggagtgcctctgtcacctcagctctgatacgggctagggctggagaacatttcacgggctcagacacatctgttctggccagtggattttggaccctctcagcaaatctgagctcatcggattgtgagctgccggtggcaaggacatgtttagtcatccttgcatccccaggatctgtggactgtgtgacatatggtgagggctaaaccagtgctcactgaataaacaaatgctgccgggtaggaggtcacctgtgttaaaccttttcaagggcaagaaaggaaccagtccaaagcaaagcagtgtttgccagaaccgggacagaaacctgctctctctggcgctggcaaatgctggggtgctgctggagtgggccctttctgttggcgttcacagcatgctaagtacgttacctcgttatagctttcataacctgtctcagttaaggtctttgaggacaaacagataaatacgtaaacatgagcgtgaagaaaaaccaaattacaactctaatttgttagttaaaaaaaaagaataagaaagcctttggaggagaaaaacagacaaaggcacccagccttgccacactcttgattttaaaatctggaagagtctctttttcacctttcacaccttgacacatgaacacaagaagcgaggagcttccttaacacaaatattcttatttaagcttcactcgctgtttttatttttgatctacggaaagagatacattcttctttggcctgctgatcttgtgctacatttgaattactatttagtacacaaaggaaaccatttactgatttctgtatccctttgcttttgatcctaaccatgattataaacatgaaggagctgcctgagcaggtcagaaccataaaaaaaaaacaaaaaacaaacgaaccaaaaaaccttaagagggtatcaaagtaacagctccctggaagaatagaaaaggctgattcaatggatttttgatccacaatacagcaaaagaaagagcagtttaaaataaatggtatcaaaacaagactactagtactaataattattgggattcagaatgattgagggaagagttggctcacaagatagagtaggtagtaggctggtgttagggacagcgctcaaacaaaatcagcatttttcttctaacaggggaaaaaaacatttttcttctaatagggaaatggcttgagtgaaagacataaactaagaaagtcatgagataaattctgcttgttggctggtgagattttgccttggccatttttgaatgactgcctgtcatttttttttttttttttgagatggagtcttgctctgttgcccaggctgaagtgcagtggtgccatcccggtgtactgcaacctccgcctctcaggttcaagcgattctcctgcctcagcctcccgagctgggattacaggtgcccgccaccacgcccggctaatttttgtatttttagtagagacagggtctcatcgtgttggccaatctggttttgaactcctgacctcaagtgatccacctgcctcggcctcccaaagtgctgggattacaggcatgagccaccatgcctggcccattcttgaactttctaacaaaggaacaaccctaccttaaaaaacaaccagcttataaaatccacttgccagcccttggcaaacagagttctttacgacagccaggctgggtgcagtagccagcacctggcagagctcacctgcaggaagctgtcctggcagcagaggaactcactcttcttcatgatggactctgtggtcaggatcagctcgtttttgctgagagcaggctcactgggacacgggaagactgccttgagtattaaaagaaaattgcattatgtgtgggtgccacagagagcaggcggtagtagatgagagaacttacaaaggataaaatgaccttacccaaggtgagcttttagcaacctgtgatttttctttcaaaacaaattgtggactctacctttcatgtgaaggtgaaaactggataaatggatactccatcctatgcaaaaatttctgggctattcagcaggtgttgtcccatcacttcccagccttcgccaccccactgccccccaccagatttacattaaaaatataagctgttatttaaaaaactcaaacatttcaagagtgaaaatattctcccacttctgaagctcataaatttctcttttttttgagatggagtcttgctggattgccaaggctggagtgcaatggcgccatctcggctcactgcaacctctgcctcccaggttcaagtgattctcttgcctcagcctcccgagtagctgggactacaggcatgcgccaccacgtacgattaatttttttgtatttttagtagagacggggtttcaccatgttggccaggctggtttcaaactcctgacctcaagtgatatgaccgcctcagcctcccaaaggactaggattacaagcgtgagccccagcagaatttcctcttttttcctctcctctgctttgtccaagttgactcaatgttttaatggctgcattattattcttttgtatagacagaccatcatgtatttgaactatcctctactgatggtttgcctttactgtaagcagcgtagaaaaaacattcttggcatagttagaccatttctagaggacaaaaggagtttctgtaagggaaactactgggtcaaaagggacacgtatttaaaactcagaatggtattgtccagctactctccaaaaaggttgttccaagttatattctcaaagtatgtgaagtgtgcctgcttttcaatgcccatgacttataaaactggtctctagtatgctctacttgacacagagcgaaaccaaacaaagccctcttctgttggcatttgattactaccaacactagactttcaactgaaaacaactttttttttcatcttttttttttttttaagacagggtcttggtctgtcacccaggctggaatgtagtggtaagatcagctcactgtggcctcaaattcctgggcttaaggattcacctgccccagcctcctgagtagctggaactttaggagcatgccatcatccctggctaattctttttttttttttttttttttttgagatggaatctcgctctgttgccaggttggagtgcagtggtgtgatctcagttcattgcaacctccaactccctggttcaagtgattctcctgcctcagcctcccaagtagctgggattataggcacgtaccaccacacccagctaatttttgtatctttagtagagatggggtttcaccatgttggccaggatggtctcgatctcttgatcttgtgatctgcccgatgtctggctaattctttaaaaaatatttttttagagatagagtttttcctctgttgcccaggctgacctcaaacttctcgcctcaagtgattctcctgccttggcctcccaaattgctaggattctaggtgtaagccactgcacttggcctttttcctttaaatattggaaagtaaaaaaaaaaagcaaaacttttttcttttttttatagagacggggtctcactttgctgcccaggctagtcttaaactcctggcctcaagtgatcctcctgccttggcctcccaaagtgctgtgatcacaggcataagccattgtgcctggcccttcccttttaatatcggaaaattatacagagtaacacaaagaaaaaagatactaatccagtgcttgggattataaatactgaagtatttattaactgcaattgatagtccaaacagtacttccgtcctaaagaaacatccttaaaaacactctaaccccagatataatgctaaatcttactttgatgttgtccagaacccttttaaactccaaaggttcatcttttccctccatagctgcaggatctaagccatctcctccataaatgaactggataatatcgccagtagagcttcggactgtcagatcatactgggagcaaagatcttcaagagatttgacaagccttcgctaaaggaaaaggaggaaaaagctcagctgctttgagaagactagtcacatggggagaggataagatttgcaactcaagagtctcaaggttacaagcactttaatcacataaaaatactttattagaaaccctttaaaaagagtcctctcaccccaagaacaagagcaagaatgccttactagcctgtgcagtgggatttggaatatgctccaacctccaacattttagtgtattttagaacacatgcaatttaaaccgcatcacccacaaaggactctgcaactgctgttttcctaggctgttttaccttccttctctttctccctaaggtataaattaatgcaatagctttgcatttctaaacagaacttaagccaggacccctgcagacttcaatatgaattacggaggatcaggtgcaggccctcttctgggacagagggggaagaagagagaacagggacagtattgtgtctgaaccagcaggcagcaatgacttctcaaatctgcttagggagaaccgtccaccagctgaacactccagccagcaatgctatggtggctcagtgaattaaagagaaggaaatcttcctctaggcaacttcaaaacaaaaaatcccttatgccagaactaatttagtttacattaacacactgctctggcaaagtcatactctctaattcaaaaagtaaagacaaaaaaattaagtaaaaacacacattatgacaagagtggtaaaagtatttcacagtctattgggtttctgacaaaagcagcatgctcccacactgaagggcaatttcccattgaaagatgattaattgtattccatggatgacacacacaaaaaagacgattaaaggtatcagatgatacacgagctacaggagagatgatggaaataggcgtctactgacttggaaataggtgtccactgtcacactaatcacagtgtttgttctggcccactcattcacatctctggtttatctaccctggttttccagcttgcaaagggccatgcttccatagtagggagagagaagacacaaagccacagcaagttcatggcccagcaacttgtagtgttgactttatctggtgttttaagtagttaaaaacattacttaaaaaaaaaaaaaaagcagaagactcagtagccaatgcgatcaactggaagaaagggtatcagtgatggaagacgtaatgaatgaaatgaagccagaagagaagtttagagaaaaaagaataaaaagaaatgaacaaagccttgaagaaatatgggactatgtgaaaagaccaaatctacgtctgattggtgtacctgaaagtgacggggagaagggaaccaagttggaaaacactctgcaggatgttatccaggagaacttccccaatctagcaaggtgggccaacattcaaattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtggggaccaatattcaacattcttaaagaaaagaattttcaaaacagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaataaccggtaccagccactgcaaaaacatgccaaattgtaaagaccatcaaggctaggaagaaactgcatcaactaacaagcaaaataaccagctaacatcataatgacaggatcaaattcacaaataaaatattaactttaaatgtaaatgggctaaatgctccaattaaaagacacagactggcaaattggataaagagtcaagacccatcagtgtgctgtattcaggaaatgcatctcacgtgcagagacacacataggctcaaaataaagggatggaggaagatctactaagcaaatggaaaacaaaaaaaggcaggggtggcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagaacaacgagacagaaagttaacaaggatatccaggaattgaactcagctctgcaccaagcggacctaatagacatctacagaattctccaccccaaatcaacagaatatacattcttttcagcaccacaccacacctattccaaaactgaccacacagttggaagtaaagcactccttagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtaaataatgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatctaaaattgacaccctaacatcacaattaaaagaataagagaagcaagagcaaacacattcaaaagctagcagaaggcaagaaataactaagatcagagcagaactgaaggaactagagacacaaaaaacccttcaaaaaattaatgaatccaggagctggttttttgaaaagatcaacaaaattgacagaccgctagcaagactaataaagaagaaaagagagaagaatcaaatagatgcaataaaaaatgataaaggggatatcaccaacgatcccacagaaatacaaactaccatcagagaatactataaatacctctatgcaaataaactagaaaatctagaagaaatggataaattcctcgacacatacatcctcccaagactaaaccaggaagaagttgaatctctgaatagaccaataacaggagctgaaattgaggcaataattaatagcttaccaaccaaaaaaagtccaggaccagatggattcacagccgaattctaccagaggtaaaaagaggagctggtaccattccttctgaaactactccaatcaatagaaaaagagggaatcctccctaactcattttatgaggccagcatcatcctgataccaaagcctggcagagacacaaccaaaaaagagaattttagaccaatatccttgatgaacatcgatgcaaaaatcctcaataaaatactggcaaaccgaatccagcagcacatcaaaaagcttatccaccatgatcaagtcggcttcatccctgggatgcaaggctggttccacatacacagatcaataaatgtaatccagcatataaacagaaccaaagacaaaaaacacatgattatctcaatagatgcagaaaggcctttgacaaaattcaacaacccttcatgctaaaaactctcaataaattaggtattgatgggatgtatctcaaaataataagagctatctatgacaaacccacagccaatatcatattgaatgggcaaaaactggaagcattccctttgaaaacgggcacaagacagggatgccctctcttaccactcctattcaacatagtgttggaagttctggccagggcaatcaagcagaaggaaataaagggcattcaattaggaaaagaggaagtcaaattgtccctgtttgcagatgacatgattgtatagctagaaaacccaatcgtttcagcccaaaatctcctcaagctgataagcaacttcagcaaagtctcaggatacaaaatcaatgtgcaaaaatcacaagcattcttatacaccaataacagacagagagccaaatcatgagtgaactcccattcacaattgcttcaaagagaataaaatacctaggaatccaacttacaagggatgtgaaggacctcttcaaggagaactaaaaaccactgctcaatgaaataaaagaggatacaaacaaatggagaacattccatgctcatgggtaggaagaatcaatatcgtgaaaatggccatactgcccaaggtaatttatagactcaatgccatccccatcaagctaccaatgtctttcttcacaaattggaaaaaactactttaaagttcatatggaaccaaaaaagagcccacatcgccaagtcaatcctaagccaaaagaacaaacctggaggcatcacgctacctgacttcaaactacacaaggctacagtaaccaaaacagagatatagactggtaccaaaacagagatatagaccagtggaacagaacagagccctcagaaataatgccgcatatctacaactatctgatctttgacaaacctgagaaaaacaagcaatggggaaaggattccctatttaataaatggtgctgggaaaactgggtagtcatatgtagaaagctgaaactggatcccttccttataccttatacaaaaattaattcaagatggattaaagacttaaatgttagacctaaaaccataaaaaccatagaagaaaacctaggcaatagcattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaacatccagaatctacaatgaactcaaacaaatttacaagaaaaaaacaaaccccatcaaaaagtgggtgaaggatatgaacagacacttctcaaaagaagacatttatgcagccaaaggacacatgaaacaatgctcatcatcactggccatcagagaaacggaaatcaaaactacaatgagataccgtctcacaccagttagaatggcgatcattaaaaagtcaggaaacaacaggagctggagaggatgtggagaaataggaacacttttacactgttggtgggactgtaaactagttcaaccattgtggaagtcagtgtggcgattcctcagggatctagaactagaaataccatttgatgcagcaatcccattactgggtatatacccaaaggattataaatcatgctgctataaagacacatgcacatgtatgtttatagcggcactattcacaatagcaaagacttggaaccaacctaagtgtccaacaatgatagactggattaagaaaatgtggcacatacacaccatggaatactatgcagccataaaaaatgatgagttcacgtcctttgtagggacatggatgaaactggaaaccatcattctcagcaaactatcccaaagacaaaaaaccaaatgccgcatgttctcactcataggtggaaattgaacaatgagaacacatggacacaggaaggggaacatcacacaccggggactgttgtggggtagggggagcggggagggatagcattaggagatatacctaatgctaaatgagttaatgggtacagcacaccaacatggcacatgtatacatatgtaacaaacctgcacgttgtgcacatgtaccctaaacttaaaagtataataataataaaattaaaaaaatacagttaaattattgagtggagagtacagggattgaaaagacatcttttgcctgtggtcttatggaagaacacaagaagacgtatttttcactcctctgccattagggtacttttgtggtaaagtttgagaagcacaaatgctgagaagcctctagtttagccctgtgccccagagtctattatctcagagctatacactctctgaggaaatgctttccttctaagcatccaagccccgcagcaagcactggaataggtcattagagttaattagaatgatattaataatgagttacataaatagttgcaaagagagaggcagaggccttgcaataaccctcattgtcacgtgttagtaaagcgaggcttagtgaggttgaatgacatatcccacaatgtacttccatccatgttctcctctaacagcgctttgctatgcgtggctctggcctggtcttgatcatcataggatgattcggaacatactacattttttttggttgttcatttccagggcatctacctttctacattttttccttttaaatttaacccaagactagataaattacagctcatgtgcaaaacgtgtactcaatagtcaaaacccacagagctctgtcctgctctgttgctaatggcctacatttcttcaggttacctgcatgtatcccgtttcagctgtctttacagccgtgtcgactagaccttcccggccggccattgtgtggaagaaaaactcagttggtgtcaaaccggaataaaagctattagccacaaagcctttggcagctgggagctaaagagaggtagaaaaaagaaaaatcaaacaaaaaaagttcaaggcccacgattctgaaatccactcaaatcagaaaatgccccaccttgagactataaatacctggccagtatattctcactaaatggcaggctttctttgccctttccttatggagaaatactttataccagggacaaggagaatgagggcccagccagggctggtgctggtgccagtggcaggcaagtggcccaagagagggaaacctaagatctggatgctctccttaaaataggcaagcagtcaaggacctcagaggacaccctgtggatggaggctgcctgcccattccctgggaaatgacaccttcaagatatccttcctgtgggccagacctgcccacctacaaaacataaccatgcattgtcaatgtctacagggtttcattctgggcactgaaaatgttctaaaagtaggttgtagtgatggctgcacagctctgtgattaacagtcactgaactgtgtgccttacatgggtaaattatatatgaagtataattgtaataattacatatgaagtatatatgtatttaaagtttatttatttgtagagatggggtctcgctatgttggccagacgaactcctggcctcaagcaatcctcttgccttggcctcccaaagtgctagaatttcaggcatgagacactgtgcccggcctgaagtgtatcttaataaaatggcaaaaaatacatatataaaactccacatgaaattggccaacggtctttgatctgaataggtctgtgttccttggaggaaagtgtagattaagagatcttcacagttctacctgatctgctactgcttacctttgagtgtttttcaaaatgaggcaaggacctgttttcaaagccgtctggcactcgagagccactgatggcctgctgtcccacacaggcaatcatctgtgatatgttaatgaaggaacctggggacatggaccagaaatgtaacattcatttaccaaaataacactaattgaagtgcatgcagattggaagggtaaaacaggaataggcccttatgctcaatgaggtcatggtcctggaacagtagaagacagaaatacaatcaagacaacaaggagctgtcaggaacccaagaaaggcggaacgacggcgagaggagccaggagcatgtgtgggttggaggaaaggctggggaagtgacaggtgagtcttcaaggaggcttcagcaagtccaggttggactcctggaggacattatgatttggacataaagggagagggggaggaattccaaagtgggtgggaaagtaggaagcaaagacagagaaatggaaaagtgtgggctatgtcctgagggtaggaagcaggagagcaatggggtaaaaggcagcaaagttaaagagactggactttatcctgtttaaaaaaaaagtgtacagaaatagaagcacagaggttttgaatttgaatgcattatcataaaaccaaatgctttgagggcctcggtatctacaaaatagaagaattatgccacatcattaagtacattaaaaaatccctggctttcttctgcttcaacctgcctgacctgctgggctcaagtgatcctcccacctcagcctcctgattagctgggacgacaggcacaagccaccacgcccagctaatttttttttttttgtattttttgtagagatggggttttggcatattgcccaggctgatctcaaactcctgggctcaagcaatcaatcggcctcggcctcagcctcccaaagtgctgggattacaggcatgagccactgcatctggcctcatttttttttaaagaccacgttgctcaaagcaccctcaaactcagaatccagacacattaccaacaagttccttcaaagcagttaaacttcccaaaatgcaaataattaagtctctctctctgatttaaaaagatcccttaaataaatgaaatgtctgtttggagctgtgactatcacattttctggagccaaacagcctgtacggagaacacactgccagcaggtgagagaggggcatgcagacctttggagccgcacagagccatggtgagggggctgttgctcttgtccagctcccggaggcaggcactgccagcgtggtcacggatcacagacagctccttcaggatcagtgcctagtgggagaaaaggagatccttggtgggttgtcctcattgtctctgtggattacaaatgttcaatctaacatttaaagaaatttgaaaatactgaggcaagatgcccgatttccgatcagtaaatgtttcagaaccttagaggagcaaaatgccctggctatatgaacatgtacatcttctacaaggttctaaaattggtgtataaggcaaacagtttatcttttttttgtttttgttggagacaggatctcactctgttgctgaggttggtgtacaatggcataatcacagctcactgcagcctcaaactcccgggctcaagtgatcctcctgccccagacccctgagtagctaggactacaggtatatgtccctaccaggcctggctaatttttaaaattttttttgtagagatggggtcttgctatactgcccaggttggacttgaactcctggcctcaagggatcttcctgccttgattataggcataagccaccaagcctggcctaaaattgacagtaataaaaacttgaagaatcctttaaatggcccataaggtagaatgtatggctttgtgtatactaccctacacaacaaaatatctgtatataaatagctgtgtggacacacacatgcaccccatacaaatatataagataatatgtggtatgtaaaagagaattgcctgtactatttgtaaatttgtctttctactttttcttgccaagcacacatctgaatgtctgcaagctaggcatgtgatgaggtgacttcacaagaatattccggctcatgagctcatccacagttactcctcaacttacaaactaggatgctgaatcagttacaagtctggttccatgaaaaattgctgctgccgaggtctcaagtaattttctaggaggtaccggtgagggatatccttttctctctctctaagactcagtaagattaagaatgagctaatggtaaatacctcacaaaattctggtttctccctgctttagaaaatgtatttcattagaaaacttcccaatgcttaaagagcctttcttccacactcaggtgagtcaaagctcagtgccacgggtttatcggtgaggcagaagacggccaggtgaaagcctggtgcactcagactgctgagggagtttcaggttctcacaggctggtggtgattctgattctgacccatgctggttgagatcttagctaaaatagtttcaaatgaggggcagcaggctggggatgtgactattagacatgaattctccctcttccgcatccaagtctctttcaaagaccatacattcaaagagctgtggtgaggctgggcacggtggctcatgcctgtaattccagcactttgggaagccgaggtgggtggatcacctgaggtcaggagttcgagaccaggctggccaacatggcaaaaccccgcctctactaaaaatgcaaaaaaaaaattagctgggcatggtggtgggcgcctgtaatcccagctacttaggatgttgaggcagggataattgcttgcacccaggaggtagaggttgcagtgagatgagattgcaccactgcactccagcctgggcgacaaagtgagactccatcttaaaacaaaacaacaacaaaaaaactggctgggcgtagtggcttacacctgtaatcccagtactttgggaggccaaggtgggcagatcacgaggtcaggagatcgagaccgtgctggccaacatggtgaaaccctgtctctactaaaaatacaaaaattagctggtcatggtggcatgtgcctgtaatcccagctacttgggagggtgaggcaggagaattgcttgaaccagggagtcagacgttgcagtgagccaagatcgtaccactgcactccagcctggctggagtgcttcataaaactatgaaaagcgagactccgtctcaaacaaaaacaaaaacaaaaaaaaccaaacccccaaaaaccaaagagctgtggtgtcagtttctacttgaaggatgctgaaaatagaaaaggcaggagcactcgagtaccagttacagaagggacctgagtgtgccaccagaacaagagcagcctcgtgtggccgaatgaacagatggctatgttttcaccacctggatgtgaaagttaggagggacatgaggatctgatgaaaggccctaccctcaggaaacaaacaaggacacacacagtgagcccagggccccaacaggacagacgaggacatacacagtgagccctgggccccaacaggacagacgccaatgccttgacttgcccactcctttgctacctctattcatggctcagcacaaccccagagagcaccaccgtagccactgtgcacggcaagtggcgaccctgaaccaaagggccgggctcacctccagggtctcctcagcagtgcagccaggctgctgctgcagcttgcccgtgttcagggcttcgatgtactcatcacatttcttgtagccggcattcagcaactcatacttggccttcagcagtccttggccaggtgtgacatcaccgatcccaattgagaaaccacggttagctgttgagttggtagagcaggaagaaagggccataaatgagactcagcaaacctactaaatacagtttatgcctgctagatatagtttgtactatatataaactatgtatgtatagtttaaagtataaaaaagtgtatatcttcacagaattcatcacaattcaattaaataatggctttctttctcagtcattagggagttacacaaaatgactaggactcaactgacttctctcagagaccttacgatctggtggggaaacacaataccgtttccaactattatctaaagcagagtgacattaaacactaaagggtggcctgagggctgggtgcagtggctcacgcctataatcccagcactttggaaggctgaggcaggaggctcgcttgatcccagatgtttgtgatcagcctcatctctacaaaaaccttaaaaaattagccgggcatggtggcacatgccagtagtcccagctacttgggaggtggaggttgcaatgagccataatcacatcactgcgctccagcctgggcaacagagcaagaccctgtgtcacacacacaaaaaagtattctccaactttgatggaactaggtgccaccattgatcctagccacaatatactgtatgtagaaataaagagagtgaatgagtggcttctggcttagcaggataggaaggtatgacctacaagtatctgtagatgagaggactaatgggcctggaaaggctcagaaatgagatcattaggttctgcaactgctggaaatgatgaatgtgctggaaacaaggaaacctagtggaaagtctgtataaggaaggctccaggcccttattcctgtaggagatgggagttcgctcccagcgaaatggaatcagagaggctctgggtctgggaataccaggcagatgaaataactgtaaacaagagcactgagggaaagtctgtatattccttttatataaaaaaactgagaggtccatcaaccagtcagctccatttccaatcagtgtttcagtccttactcctcaaggaccaccagatatttgaggaaagattttaacatgaaagacaaaagacacaaatgcacaggaaaaagaaagtaaaaggatacagaaaattcaggaagcaaatataataaaactatgaataatattctctcagagtgatcagagaagatacattcagggatcaaaacaagaaagctttaaaaacaaaacagcctgggcatagtggctcacgcctgtaatcccagcactttgggaggccgaggtgggcagatcacttgaggtcaggagttcgagaccaccctggccaacatggtgaaaccccgtctctactaaaaacacaaaaattagccgggcatggtggcaggcacctgtagtcccagttactcgggaggctgtggcaggagaatcacttgagcctgggaggcggaggttgcagcgagctgagattgcatcactgcactccagcctggcgactgagcaagactctgtctcaaaaaaaaaaaaaaaaaaaaaaaaaagaaacaaaaacactacctgtgaataagtatattgaaaaatagtattggaaattaaatacatgacagtgataaaattttaaaaatcaacagaagtattaaaagataaagtgaatctagaataaagaaatggcaaatggaaaagaagataattagataattaatctaggagttctaatatgtaattaactgaagttccaaaaagaaagaacagagaaagtaaaagagagaaaattattaaagaaataacataaaatttcccgaatggaaggacacacagctgcagattaaatgaaattactcagtgcttagcacagtgaatgaaaaaagacccacaccaaaggtatattgttgtgaactttcacagtgagaacagagaggattctgaaagtttctaaaatgaaaaaaacaattcaagggccaggcatggtagctaatgcctgtaatcctagcactttgggaggtggaggcaggtggatcacttgagaccaggagttcaagaccaacctgggcaacatggtgagacttcatttctacaaaacttagttgggcatggtggcacatgcctgtagtcccagctgctcgagaggctgcgtgagccaagatcacaccactgcactacagcctgggtgacagagcaagaccctatcttcaaaaaacaaaaaaaaatcaaatacaaaaactggggaataagaacgacaatacctgttaacaacaactctgaaagcaagaagaaagtagagcagtaccttcaaaattctgagggaaaataattttcaatctaaaattgtatacccaggcaagtataagagtggaataaagttttgggggcatgcaaacatcacttgactcatggcccactcaaagcatgagcaaacaaacaaacaaacaaaatagaacagtgaaagcatagtaggcaaatattgagtaatcttggagaactgaatcatggatagccccaagtgttctagtgcttccacagggaccttggaagcagcccatcaaggatggtttataatctaaccctgtctagaagaccgtagggagctactgctggttttgagaagagaactgaaaagcaaattcaaatctgttgtgaaactattcagtactgagttaatttaattaataacagcacacatgatttagcctggaatgagtatctttttctgtatgtatatgtgtggtggggatgaaatggcagtaaaagaacaaaataacgtaaacccttaagactctaacaattgcagctttaactaaaagaaggatgctgagatacttacacaggtagacaggagccagcctggcgagccgtgacatggcatctgcagcttcattctgtccccagtctcgcagcaaaatgtaaaaaatattgttcttggatcctgaccctagggttcctttgtccatgctgccactcatcaactcactgttctggattgtaacatctggaagaatgattatatatttagacaacaattatttattactttgccttattccaaaatgaatttgagacagttgagaaaatatgttcccatactgacacttaaagcagaacaaacagaaattctcctcaaagcttttttttggggggagggagggggggttaaaggaaaacttgggaatttttgaaaaatatagaaactccagttagtgtgtagtcctaaccctgaaatataccagttgaccctcactctcctcatctgtgaactgtgggtaacagtatcaagcacttgtcatctttatgttatgggatattttgagcatcagatgaaataacatacagtgaagtgctctataaactataaataatttgttactcatataagatattaaatattaacaaaggtaccatcatgtacagcctatacaacaaccaaatgaaattcatatccaaaaagaaacaaaacagtctaaaacaagaagctgaagtattttgaagatcagagagcatatttccaaagaaataaatctgaggagtatcagtgcccttcaaaacatttgctcttcattagaagacagcagaaatcctgaccttcagaagaactctgcaattcagttcttcagtacagagtcctggagatccacttctagtcccaaggtctcactagcaaagcccattctaaatcagtgctactcaaactaggctgctagggaactgtttggtagtggtctgggtgagtgaacgtgctcacatcagaaagtaactcaatggatgctggctaaacagcagggctctgtggactgcacttcgggttgaactggtttagacagactcagatgacttgcatgtaaatcctttccctggctgggtgaggtggctcacacctgtaatcccagcactttgggaggatgaggtgggacgattgcttgagcctaggagttcgagaccagcctgggcaacgtagggagaacctgtttgtctttgaaaaaaaaaaaaaaaaatcaatccaggctgggtgcagtggctcatgcctataatcccagcactttgggagggcaaggcagatcacttgaggtcaggagttcaagaccagcttggccaacacggtgaaaccccgtctctactaaaaatacaaaaataagccaggcatggtggtgggcgcctgtaatccaagctactcaggaggctgaggcaggagaatcgcttgaacccagtaggtggaagttgcagtcagctgagactgcaccactgcactccagcctgggtgacagagcaagacttagtctcaaaaaaaaaaaaaaaaaaaaaaaaaattaaatgccttaaatagtaaaatccttgtttattgccccccccgccgccaaaaagatgacaaaatacagacaaactactaagtgagaaaaactagtcacttaagacaaaacacatttggagagaacattctaaccactgcgtcatgtgtctacatgatctctacttttaagagaaatggggaattacatctgagagaagaaaaaccagctacattttcctgaagaaaaaactttccacctaaggcttacagaaacaatgaatttgcttgcttcgcgaaggtaccagcaaagctgatgaccagccacttgcttttctgtcacgttcctccttctccccacccgagttccgtccactcacaggaatcattggcacagagatcttcccctttgccacagtactgcttgcccttggttcgcaggttggccctcactggattgtcatcgctaggcctgaggatgacactgaagatctgctttcccgtccacagggtgacaggctgagggggggaggaagcctgagagtcagtgggctgagcctggtctcaatcccccttcagtagacgaagccaggcggcctagggactgcactcaagcctagcaccaacacggttccactcatttcaccagtctacccccacagacacatacacacacctgtgcaccaacacacaactcccacacacacctttaggattgtaggcggtgggaggcgaactttaattttctcatccttgccaaccagtattgaagcaatgatttggcaagccttggctcgatcaaagaaagtgtccttgagagtgaggagataggcacctaagcattaggaaccaacacaaaacaaagaaaaggaatgaaattgtgagaatactgcaaggtttcaattttaaaataaatttgaaccatgaccaacagcgtgaattgaaacaaacagctgcttactggctttctcctccaactaggatctacctccacaggaacgtgactttgttttgttcactgctgtatccccaggcaaaagggacagattctaagccagacactaggtttagaaaatgcccagtccatgagaggagctcattaaagacttgctgaattaatgaataaccaaccaattaaaaaaaaaaagaaaaaaaaaaacccacggggaggttcatgatcaaacttagtaaacaaaaaaccaaattaaacacaggctattaaatagcttttcaagtcatcacatgaatcactatgaacgaggaacactgtgttccagtcagaaatctcctttcaagtgaacttcaccaacctacctgttagaaaatcctgaatagcagcaatcagcggttccccattcctcggggttacaagatttgctttagtctgtaggaaaagtaagcgcagtcagttagctgttctcggatgcatgatgcagcccaaagcctgaatcacaaggtttttgaatagttatgaacaaatacagagtagcagaaggacgaggctgagaaatgaaagccaggggtctgaatcccagctttgtcactaactcccagttcctttatctgtcaaggggagagaaaaaaataccagcaagattgacctaggagggtcctaccaacaccaaaatgaaatatcaagtgaagttgtttcagaattctatgaaaaactctacccatgtaagaagattttattgttgtttgtttttgagacagagtcttgcttatagcccaggttagagtgcagtggtgcaaatatggctcactgcagcctcaacctcatggggctcaagtgatcctcccagctcagcctcccaagcagctgggactacaggcccacatcatcatgcccagctaagtttttgcattttttttgtggagacggggtcttactttgttgcccagactggtctcgaactcctgggctcaactgatcctcccaccttggcctcccaaagtgctggtattacaggcatgagctactgcacccagccctattgttattactataggtgcttctccaaagaaaattcatttctgtgaatgatgaggagcgttgtgacctctgaagtcaaccaattccacacttgtccacaatgatgacagaactgttaaatgtcccttggttaagacattacgttctaataataatcaatccaacaacagaatttaattaaacatttaatgagggcctacgttgggcaaaaaagggtgttaggtagtaaaacataattaagtcatgtaaagaaggctctgtgtgtatgagagtacatttgctctaatcttgatatgaaaatgcacatgtgtatttgtgggttttctgggccttttcacccagaaagcagggtcctctcagacaaaggcccattaccacttacttctgagccactatccaaagcagggacccttcaaccagagtgggagacagctatttagccagatgtgcctcttcattgcacaccacctgactgctcttactcctggtttagagactctctctgaggtgggatacaggtagtctacggatagaagcagagtgcaaggggctgagattagtgtattttgaaaaggtctcctgggtaatttgggcccacatccaaattagagccctatgcactacacggagaacagcattgctaaatcagaacgataggtattttcttacttgaaattgaggaaacttgtccacatggtaactaaggattcttctaccccaaaatccttggagactttgttttattattgccatttgtaaccaatgaaatatgcagttgtaacacaatgtccacagtatggatcctcaatggcagagttgacagcaaagtctaaatggttggttgcaagctgatagctattatttcaagcagcattctaaacattactttttgttacaaaaataatatatgctcattatagaaaataaatctaaggccaggtgcaatggctcacacctgtaatcccagcatctggggaggccgaatcgggcggatcacctgaggtcgggagttcaagaccagcctgacgaatgtggtgaaaccctgtctctactaagagtacaaaattagctgggcatggtggcagacgcctgtaatcccagctactcaggaggctgaggcaggagaatcacttgaacctgggaggtagaggttgcagtgggctgagatcacatcattgcactccagcctgggcaacaagagtaaaactccgtctcaaacaaacaaacaaaaaaaaaaagaaaaagaaaaagaaaaaaaatctaaacgtatagacaacttaaaaccccaaaatgatgcatgcaatactaaaagcctaaaccaaaacaggttaaaagcatcacatcagaaatggtaataagtgattttggaggtagggacacttacaactataagacttaccagttcctaatataggaagctggaatactgaaaaaagaaagcctgaagctctaaaatactcagtagttggggatcatgaagttcaggaggagagaatcctacacagccggtgccatgtcccactgtgctattgctgggtcaggagtgaatagtacatgtagtgccaacaggttttttttttttcttcttttgagacagggtcttgctctgttgcccaggctgaactgcagtggtgcaatcacagctcactgcagcctcaacctcctgggaccaagcaatcctcccatttcagcttcctgagtagctgggactacaggcgtgcgccaccacacctggctaatttttgtagttttcgtagagatggagtttcgccatgttgtccgggctggtcttgaactcctgaactcaagtgaaccacctgcctaggcttcccatagtgctgggattacaggcctgagccacagcgccagcctgtgccaacagttaaagctcaactgtaagctccttaagagcaggcacgtgcctcactatcaccgatctcctgcagcatctactgggcactccttatgcatttgtcaaataaagtggtggtaagagttattatcattatgtataatactgcatcctctaagaagacgaagtatgtaatatagtttaggaaggtttccattcagaatgttcaataaaatgtgctggtgcttaaagaatcttcagctactggaaaatttacttaggtaggacatcttcttcccctgtgacagccaacattgatattgctatattcttttcttaccttgtcataactggccctcatgtatacattttctcccagaacccacatttataggccagaaaatcccctcaacgcatctgttacagaccctaactctcatgtatatactataatttctaagagattcttcaaaggctcaaaagaaaccaataaaaagagagatatataggcagttagtggtcggtttaagaacagaaagagcctggcttctttggcgttgttagttgtggtggtgttttcatgtaagtttcctttgcctcctttcaaggagctgttatgcaaaagctgggctgtgccaccctacatacccccatcagaacaagggcctctgctttagcttcttctgtttgaggaagatgaaggttcatttcatcaccatcaaagtcagcattatagggtgtacagacacactcattaaatctgaaggtccggtggggcttgaccctggcctgtggaacacaaaacaaaacaaaacaggaagaggacttaggcatttatccaaaagcttctctgttttgaaacattaaaaatggcttcctggaatactgggcactggcttaagaaagtagatttccagtatgttctgtcaagtgatatatatcatttaggactcattcccagtctggccaacatggtgaaaccccatctctactaaaaatacaaaaattagccaggtgtggtaacacatgcctataatcccagtaacttgggaggctgaggcaggagaatcgcttgaacccaggaggtggaggttgcagtgagccaagatcgcgccattgcaccccagcctgggtgatagagcgagactccatctcaaaaaaagaaaaaaaaaaaaagactcattcgagaagctttattagattgaaccaaagcagtgaatttcaacaaaggcgccagtgtgaaggctcccactggccaaggatgtcatggtttcaagtatcaaaaagattaacagcagaagttgattaaaataaaccaactaaataaaaacccatgtgtttataatgacactgaaaaaacagaaagtcaaaacaaacaaaaaaccccaatcaatctagttggaagttactgagcactaaccccctttttttttgagacgtagtctcactctgttgtcctggctggagtgcaatggtgcaatctcggctcactgcaacctctgtctcccgggttcaagcaattctcctgcctcagcctcctgagtagctgggactacaggcgtttactgccacaccaggctaatttttatattttagtagagatgaggtttcaccattggtctagaactcctgacctcatgatccgcccaccttggcctcccaaagtgctggcattacaggcttgagccaccgcacctggccctttctttaaaaaaaaaaaaattttttttcctaagcacacgaacacaggagagcactaagttcttacttcccaaaatcacaataaaggaaaaagacttaaccatttacacagcctttgctttatgagctgcacctctgggcaagcaaacagacctaattaacaagcgggtattttccattataagaattgtaggtaataaatgttaaaggaacgatagattcaaaaagtggggttccattttgcagcccaataaaataacacaggcaatgataacaaatgaattaattagaatgaattcattgcttgcatcttgactcaaacaaaccacaaaaagacaattttgagacaaatggggaaatctgaatatgaactaggtatggacctgggaatgccaagagatgactgttaattttgttaggtatgattacagcactgtggttatgtaagtttttcttacaaatgtaaactggatacatattgaaaaatgacacagatatgggttcatcgaagaaaaatgggaaagataaaacaagtgtggctaaaccttgaaaattattgcatatagaggatgggaatatgtaagttcattagaccattctttctactttagtgtacatttgaaaattttctttttctttttttgagacggagcttcattctgctgcctaggctggagtgcagtggcgcaatctcggctcactgcaacctctgcctcctgggttcaagcaattctcctgcctcagcctcccaagtagctgggattacaggcacgtgccaccacacccggctaattttttgtattttagtaaagatggggtttcattatgctgtccaggctggtctcgaactcctgacctcaagtgatacaccttggcctcccagagtgctgggattacaggcatgagccatcacacctggcctcaaaattttcaaacaaaaaaaatttctacttctttttttagagacagggtctcattacgttgtctaggctggagtgcagtggctatttataggcgtgatatagcacactgtagccttgaactcccaggcccacgtgatccttctgcctccgcctcctgagtagctggggctataggtgtgtgccattgccagtcaaaaaaacctaataattatattttgtaatgttccaaagccaagcaaaacattccagaaagagaaggctttagttaaccctctacattctcacaatcataatcccataatcacaaactacttcttagttatttctactattatgtaaatgactgatataatgtgttcagacgaccccaaaatgaatctatgaaaaaatattaccataagaggctgcttaaacactgtttgcaaaggctcatggattaacagctttacagataggagaatctatgaatattgaacaaattaaagctgtatttcatttccattttaaatctccagaaaaaggaactgctgctgttgcaaaactaaatcaccaaaaaaatatggtttaaggtcttagttggaggattactgcaaagaaaaaatcttttaagcattttagttgcttagttaatatgcaaagttaaatcaaaagtcaattttctggctaggcacagtgggtcatacctataatcccagcactctgggaggctaaggtgggaggatccattgagcacaggagattgcgacccatctgggcaatacaccaagacctcagctccacttattaaaaaaaaaaaaaaaaaaaaagggtgggcacagtggctcatgtctgtaatcccagcactttgggaggccaaggtgggtgaatcacctgaggtcaggagtttgagaccagccaggccaacatggtgaaatcctgcctcaactaaaaatacaaacattagctgggcgtggtggcatgcacctgtaactccagctacttgagaggctaaggcaggagactcacttgaacctgggaggcagaggctgctgtgagccaagactgcgacactgcacaccagcctgggcaatagagtgagactctgtctcaaaaaaaaaaaaaaaaagctggccatcatggcacatgcctgtagtcctagctacggtaggctgaggtgggaggatcgcttgagccgaggcggtcaaagctgcaatgagccagactgtgccactgcactccagcctgggtaacagagtgagactgtctccaaaaaaaaaaaaaaaaaatccattttctgccatacctattttatgtaagtttgtgcacacaacacatatacgtgtatatgtttttgtgaaaccatgctagtcactttcaattaaatcctctcttagtgttttgtatgaatattacgttgcaaatattaaaaatttaatattaaaaaatattaaagcttactaaaaggaagcttgaaattaaaaagtttcactcaaactaaaatgtgagagaagagggagaccaatagttatgaaaggttgggccagctgtaggggctactcacgcctataatcccagaactttgggaggctgaaggaggatcgcttgagcccaagagttccagactagcttgggcaatatagtgagacccccgtctcaaccaaaaaccaaaaacaaaaaacaaaaaaaccccaaattagccagatttggtggcacatgtccgtggtcccagctactttgggggctgaggtgggaggcttgcttgggcctgggaggtccaggttgcagtgagctgtgattgtgtcactgcactccaacctgggtgacagagcaagagcctgtctcaaaaaaaaaaaaaagttatgaaaacttgagataacaggcaattttaattttagaagtccactgtttagcactgaacagtcatggcaaatttctacgtgatggaaaatttaaaaagcagtgctactcaccagatgagccataatgctcaatttgtgcagcgagggctgccgattgaacagcaccacatctccatcgatgaggtgtctctctacgatgtcaccatacttgagctcttgagccatcttttctcgatttccgtatttcaaaaacctgaatgtgcaacaataaacatgatctgtgaaagcaaagttctctcaccaagtttctccctcttcagatcaggattcaatctttaatatattatttcatcaaatctaagatgcctccattttaatgtcatatagttttatgtgccaagaaaaaagctccctattaaactatgacagggtgggcgaggtgactcactcttgtaatctcagcactttgggaggctgagatgggcggactgcttgagcccaggagattgagaacagactgggcaacatggtgagaccttgtctctacaaaaaatacaaaaattagccaaacgtggtggggtgtgtgcctttaatcccatctactttggagcctaaggtgggaggatcacctgagcagaggaggtggagactgcagtgagccatgattgtgccattgcgctccagcctgagtgacagactgagacatcaaaaaaaaaaaaaaaaaaaccatgataaattgatcttaagatatatccagtcggatgtggtggctcatggctgtaatcctagcactttgggaggctgaggcagctggatcaccaggtcaggagttcgaaaccagcctggtcaacatggtgaaaacccgtcgctactaaaaatacaaaaattagtcaggtgtggtggcgggtgcctgtaatcccagctactcgggtgactgaggcaggaaacttgcttgaacctgggaggtggaggttgcagtgagtcaagatcgtgccactactctccagcctgggtaacacagcaagactctgtcttgaaaaaaaaaaaaaagacatatcctaattttagaaatgctaaaagccctgagagcccaggtgacacaggcaatgatccactttatatatttattgtatttctgagacagagtcttgctctgtcgcccaggctggagtgcagtggtgtgatctcagctcactgcaacctctgcctcctgggttcaagtgatttttgtgtctcaggcttctgagtagctgggactacatacgtgtgctaccgtgcccagctaatttttgtatttttagtagaaaaggggtttctttgccatattggccaggctggtcttgaactcctggcctcaagtgatttgcccaccttggcctcacaaagtgctgggattaaaggtgtgagccaccaagcccagcaataatgatcctctttagactttagtatccatggtattttgtcctcctggatccaataacattacaagcctgagaacaaaggagcacttcatgtatattcaatgactgaacagagcaaatgacataccttggctcacggaaatttaaacagatattttccacatgccaaaatgtcacgcaaactgtatttctggattgcattctgtggctgagtatgaccacagtgagctttgccatgagaaagtagttaaatccaactagattgggaaaagattaccttttcatctgcgtatgtctctgctgaatgaagtttgctcctgggtgaacctcagggccgttttgaaccagtttcctcaagaaattgatgtttgctttgtttacctgcagtacaaaaaaaccacaataagttactcccaggtaactagaaactaacaaatgatactgaaatgcgtcttaatctttactttccttgttcagattctaggagaaagagaggcatcctgggcagcctgctgcctatggtcttgagtataatgtgaacaacagactggcaaacaagcttccagcttccagtgtcaactcagctgtttgctcactgagtgacatggccaattcctttcctggtgcttggtttcctcactggtaaaacgggtaggctagactgatctataggaaccttctgtgatcctagaaacaggtggcgacttgatctgcaataacttactgggggcttgtaaggtttaaaagttgtgacaccagcaccacaagccctggtctgcattgaatgtgttctggaacctcttaaacaactgtcttgtggaacaccattttggagaagttaactcttggatcattagtaactcaactgaggacacacaacacaagctgaccaggaacatctatgatctgggctaactgtgagtctcataggtaaagctaatcaatattctcgttagcaggccctgcagttacctagacctcaatttaaaaaaaaaaaaaaaagtatgggctgggcatggtagctcacgcctgtaatcccagcactttgggaggccgaggtgggtggatcacttgaggtcaggaattcaagaccagcctggccaacgtggtgaaaccccgtccctactaagaatataaaaattagctgggtgtggtggtgggtgcctgtaatcctagctactcaggaggctgaggcaggacaatcacttgaacccaggaggtggaggttgcagtgagctgagattgtgtcactgcactctagcctgggcaatagagtgagactcagtctcaaaaaaaaaaaaaaaaaaaaagtgctagctgggcacagggccctgtaatctcagtgactttcagtgacttgggaggctaaggtgggatgatcacttgaggccaggagttcaagaccagcctgggcaacatactgagaatcccatctctaaaaaatttttttaaaaaattagttaggcatagtggtgtgcatgtgtagtcctagctactcgggaggctgaggcataagaatggcttgagcccaggagtttgaggttacagtgagccatgagcacaccactgcacttcggcctgggtgacagggcgagagtctgtctcttaaaaaaaaaaaaccaggccggatgcggtggctcatacctgtaatcccagcactttgggaggccaaggcgggcggatcacgaggtcaggagatcgagacgatcctggccaacatggtgaaactccgtctctactaaaaatacagaaaattagctgcgcatggtgatgggcgcctgtagtcccagctactcgggaggctgaggcaggagaatggcgtgaacctgggaggtggagcttgccgtaagcagagatcacgccactgcactccagcctgggcgacagagcgagactccacctcaaaaacaaaaaataaaataaaagcctttctgggtatgtagcaatagccttaaaatgttcaaatgctttgactcagtgactgtaaagttttaaaaataaaaaatctatcccaagaaaattaactatggataatgtttaccatttagttagtttaaaatatgaggcatgaaccaacatagaaaagtgtctacttttttttcttaaagatggtctcactctcacccaggctagagtgcattgacgtgatcttggctcacaacctccaccttccatgctcaagcaatccttccacctcagtctccccagtagctgggaccacaggcgcctgccaccactcctggctaattttttgtatttttggtagagacaaggtttttactgtgttgcccaggttggtcttgaactcccgggctcggatgatccacctgccttggcctccctaagtattgggattacaggcattagccaccatgctcggtcaagatgttattaattggaaaaaaagttgcaaaaaagtatagcatatatatgagtaaatacacatgaaactagaaacaactgtggctgcaaatggtttacagaatatataccaccaactatgtataaagcaaactgggaagacacatacactcatataaaccaaactgtgggttgagtgggttactggggactttctactgcctgttgtttgcaataccaaaatataacgtaaaagactgaatttaaaacaaagaattgagcagctgagtggtcacttaccttctcaggaaaagttagaattttggccacatgaactggcacagctacctcatcaatccggaggttggggtcgggcgagatgactgttctgccagaaaaatccactctctttcctgagagatttcctctaaatcgacctaaatagccaaaaacatgtcataggtccccatggcataccatgtgctcatgggaacaataagaacggagagactgaggaaagcctgtgacctccaatcagagaagctggacagacactcctgaaaaaggaaccaaagagagtgggctggcttctgcacatcttgtgggaaacctaccctgttttcccttcaggcgttggacgaagcctctggtccacttcttgggtgccatgttgaggggaatgcccgagagctcactgttaatgtagagggcacactgcagctgcaggaaatcccagtcctccatgatcatctgggtcttggctcctgagatccgatgctaaaaccagcacagcccaaacagaaacaaacctggtcagtttgatttttctcacattttcttgaccagaagtttttggatagatatactatgaaacttacaaggaaatgggaggcactgacctttttaataacatcgtttaggaaaatgatttctgtcagtttcattgtcagatcatcttcattggtgccagacttcaaatcactcacaacggagggtctgatacacaaaggaggcaccaaaagtcgtgtgagaatcaaatcagacggctttccggcttctgggttcatcagaagtagaggaacatcttcagctgggattcgtttaaataaattcagaactactaagggattcaagttttcctatggaaacgaagaaaggcagaaatggagatactatgttagttttccatagcttgggcaaggttttccttcactatgttttctaacctatctgtcactaaggataagtgacaacagagatttctatggatgatacgctatgctgcaagagccttaaaattgtgtatgtcttttattccaatttttcaagccaaaaattccacttctcattattccaaggggtgtaacttcagaaatgaacacaaagatttagctacaagaatgttcacaaaagctgttttttgttattttttatccgtgtgacagaataggaaggtaataaaagctgttcttaacagtgaaaagttggaaagagcctgacagtttattggctaaataaaatcacggtatatccctatgtggaaaagcagcaagccattggggggaaaaaaagatactagacaaacacagcaattgacataaaaaaggtccataaaatattggtagctggaggctgggcgtagtggctcatgcctgtaatctcagcactttggaaggccgaggtaggtagattacctgaggtcaggagttcgagaccagcctgacaaacatggcgaaacctcgtctctactaaaaatacaaaaattagctgggcatggtggcacacgcctgtaatcccagatacttgggaggctgaggcaggagaatcacttgaacctgggaggcagaggttgccgtgagccgatatcatgccattgcactccagcctaagcagtaagagtgaaattccatctaaaaaaaaaaaaagtgttactggctgggcatggtggctcatgtctataatcccagcacttagaggggctgaggcgggtgggtcacctgaggtcaggagttcaagaccagcctggtcaacatagtaaaaccctgtctctacaaaagtacaaaaattagccgggcatggtggcgggcacttgtagtcccagcaactcgggaggctgaggcaaaagaatcacttgaacgtgggaggtggaggttgcagtgagcctagatcgtgcaaccgcactccagcctgggtgactgagcaactctgtctctaaaaaaaaaaagtgttactgttaaaaaagaactaaggtaagccaggatgcagtggctgacacctgtaatcccagtactttggaggctgacgcaggaggattgcttgaacccaggagttcaaagcctgggcaacatagcaagaccttgtctctacaacaaattaaaaaattgttgctgggggtggtggtgtgtgcctgtagtcccagctacttgggaggctgacatgcaaggatcacttgagcctaggaggtcggggctgcaatgagcctcgatcataccactgcactccagcctgggagacagagagagaccctgcctcaaaaattaaaataaataaataaacaaatatataaaataataataaaaaaaaagaactgaggtaaaaacacaaacaaggggccaggaatggtgacctatgcctgtaatcccagcactttggaaggctgaggtgagaggatctcttgggctcaggagtttgagaccagactgggcaacacagcaagaccccatctcaattaaaaacaaaagcaaaaacaaaaacaactggtgttacaaggccagtccacattagccttagtgccagataaacactgttacggtcaaataagaattactggagagctggccgggtgtggtggctcatacctgtaatcttagcactttgggaggctgaggcgactggatcacctgtggtcaggagttcaagactggcctggccaatatggggaaaccctgtctctactaaaaatataaaaattaggtgggcatggtggcacatgcctgtaatcccagctacttgggaggctgaagcagaagaatcgttttaacctgggatgcacaggttgcagtgaaccaagatttgcaccactcactccagccagggtgaaagagcgagactctgtcttccatctcaaaaaaaaaaaaaaaaaaaggaattatcggagagctgtcgaacctaactggacctctcattttggaagaaagtgggtgtctaggggtggggcggagttgggggagagagtgtgcatgtgacgtgcggaagaggcaggcgggaggcaggcggaaggcaggcgtgcattctcaggctcacctgtgcccttcccagcagaggctccacttctttattatgttcaatggctgtttcaaaagactgaaggaaatttgatacaatgggatccaccacttttttgttggtcttgtatttctcatgaattattttcagcagtccacacttctttacggtacctataagggttagtttatttaccaagaaataaaaaattatgttctcagattggccagagattgtagtatggttaatgaaattactgaaactactatagcaatgaaagatgagaggtccgtttcccaataggacatcagttgttgggctcttaagcctaatttataaggagaaaagctgactcccgaacattatgtaaacctaataaactaaacagaagacagtgagtgaaaagggctattgcttagccttctgtgcattccactcaccattaaaagcgccacagtgatggcagatgtttttcttccggcacttgtcagagattttctttttcagtcctcgcttctgaaggtaggtcaggccgggcctctttagatagtccagaaactgcttcttctcctcttgggacagcatgatgtggcagcaggttttgcagatcatctttttcaaattaagcaagacagataaaagcataagtgagaatgaaaaattattttcttttaaaaatgccatcgccctgttttgtacccttaaccacgtgaccatatacacagatctgcaaatggctctatactatggatatgcagagaggaagcctgtgttcactagattagcagtactcacagccagtaggcagactttgttacctttatctttttctttgtgctattctgtattgtttgaattactactattgttatttttttaagaacacgtatctaccatcttctcaaggtaaataaacaaaataaataattcttgagtgatttaacgtagtgtgagatgaaaatattatgtacttagtataaaagagtcccctagatgtatcccccaccactcacagttcctaagttcattccagcatccctgaccaatcactccagaatttatgtcttggaaatcagcacctgtgtgcttacctgtaagatgcctatgactgctctgaagtaccctacatgaaaacacggcaactccaggtcgatatacccatagtggcctagacagtcagccaagtttttcccacaggtttcacatggacgatccttctcactcgtaccctttgaaaaaaagcacacccaatgatcaacacagactgctggacgggaaagagtgcccagccatcatgcctggctggtgacacagaatcatttcttttgcttcttaaatttcctttctgagatcacttcctactgtttttctttcttttctaattttcatgactcagaatcgaatcaggttgctgactaaaggccggagttcttgacctagtctaatatgtgcaggggggaattgaggagatggaaggaagcccctgctcctttcaatctggtaagtcaccagttttatcagcagggcaagacacagttaccaggaggggtgagggggccttaccatcctatggtcgagcaccccatatagcaagggggcatgttggttgtcctggctgtacaggttcttactcacaacttggatgtgcgcctgctggcgcatctcctcaggtgacttcattccaaaacagatgtggcttctggaatgggaagaaaaaggtgaaaattacagcaaaatctgtgaccaaaaatgtctattacatacatagcccaccataaccaacctatccttccaactgtctccactggcttttcctaccagtattaaatatatttaaccctctctcatttttccttcacaaacatcccttcatcttactggaatccagtttctactctcaccatcaaaggaacagtgctcaccaaggccacctagacaacctgcctgctgctgaatccaataagaacttcctcattttacctctgcagcactggcagcaccctgcccaatcctgaagtgcttttctctcggctttggtgacaccatacactctgagttttcttcttcccttctctggctgctccttgtacagtctcttttgaggtcttttcttctactgctatcccttaaatattggtgcactgtaccacctagcattacaaccttcatcctcttatcttctcatcctacacattctcctgagtgatcatgccactcacatacatgttgatgtctatcaaatctatctctataggccagctactgctacccaactggacatctgtatagacacctcctcctggacagttccacctagatatctcataggcacttcaaaccccacacattgaaaacagacctcaatactttttctcccatgtctgtcccttcattcattcttccaacaaattgactatttcctatgtgccaggcaccatcctacaggctgaggatacagattagctaagacagacaaggtccttgccaacaaagagctcacaggtcagggtgggaaagacagaccacaaacaaacgaatatacaaatgtgaacagatgcagaagtgatgtaagcagtggagtctgaggaattactttacgttgcatggtcagaaagcctcactgtaaaactgacaatcagaaggaagagcatctgaagtggagagaatgactagggccagggtcctgggactggcacaagcttggcattttcaaggaaccaaatgaaatcagtatatactggagcatagaaagctaatagtacaagataaagtcagtgaagcatgcaggagctaaagcatgagggcttgggaactttggtagggaatttatttaaataacataaatgcagccgggtgcggtggctcatgcctgtaatcccagcactttgggaggccaaggtgggtggatcacgaggcaaggagattgagaccatcctggctaacatggtgaaaccctgtctctactaaaaatacaaaaaatttgctaggcgtgatggcccacacaatggaaagctgctagaggatttttttttttccctgagacagagtcttgctctgtcacccaggctggagtgcagtggtgcgatctcagctcactgcaacctctgcctcctgggttcaagcgattctcctgcctcagactcccaagtagctggggttacaggcatacaggcatgcgccaccgcacccagctaatttttgtatttttagtagagatgaggttttaccatattggccagtctggtcttgaacttctgacctcatgatctgcctgccatggcctcccaaagtgctgggattacagacgtgagccaccactcctggcctctgctagaggattttaattgacaatacccttaatttgcactttgacagaagcactttctctgttttgtgagaatgtattatatctgactgggcgcaggtgtacaggtgggtgtgaagggccagtgtcgatgtagagctaccacatgggagaatgctgcattcacctaggtaagacacctgttctagtgaatggcaaccatccacacagctgcccaagcaaggcattctgtatatccgtctcaaggtctctcgacctctaattctttccaccatgaatcaagagattttccagaaggagaactcttatcaagatactctcctgttgaaaatccttcaaaggttcctcactgcctacaagatgacttcttaacacagcttcaagtcttctgcttccttctgatcacctgtgttctctccctcaggtctgctccttgaaaaaagcagtttggtctgctttcttttgcctggacccattatgtgctctcaaaaccccctggacctacccttgtcattgcacttgtcgtacccagtgttgacttgtgtaccttctccaactagattaggcagtaaaagttttattcagaccgtatctttaacgtccaacactgggaataacgcgcagtatcctcctcagtgtctgctgtaagaatgatgaattcacttttttttttgagacaccgtctcactctgtcactcagggtggaatgcaggaggttgcccactgcaacctctgcctcccaggctcaagtgatttttcggcctcagcctcccgagtagctgggaccacaagggcgcgccaccacgcctgctaatttttgtatttttgatagagacggggtttcgccacgttgcccaggctagtctcaaactcctgagctcaggagattcacccgcttcggcctcctaaagtgctgggattacaggagtaagccaccgcgcccggctggattcactttcttaccgagaactctaagaaggagccaccgcctaataacgtatttctgaaggcaaaagtccggatagcagctttatttctgacactgccatccgtcggcctgtggtacagctttctagtgggcaaccccatccttttggtaagcaactactgcctccgtgtcagacgctctgcggctgacagaattagagacagtccccgccccagattgctcccctcgctgcagcaggggatagttcgctgaagaacagggatcattgtatgacttcaggagaatgcgagctttggcccagggtgcacaaatcattaaggctcaggccactccgacttctccgcccaagtccagggacctctcgaggtgctgaaatcccctcagcctgaccaatgctctttgaccaacgctggtagttctgggcgctggtcacacctatggactactggccctccccttcccattgcaccccatctctgaccctgcaagacccgggaccgctgacctcggaccccttgccctatttctcagccctttggccactcttactccgtcttacattttcttggccacatccgtctcccggaactgctccttcaccatgatgaccgctgccgggacgcctccttggcactcgggaggccagattagagaaacgatgcccccagcacctcctggggctgcttctggactcgccgctaacacatctgcggcatcctctcggccaccgtagagtgtcccacgtgtccgcttcctcttccgctactcgcccgcgcgtctgtctgtcaagagagacttccggcatgccttttttttttttttttttccctttccccgcaccgtcacctggtggcgcttactggaagccgcaccgaggcgtgtgctgtattttaaaaatcccatttctggtcaatttctccacgtaatcagacacccgcagagaaactgcatataactctttgcctcaaggcttttagacaagcagagggccaaaacttgcataaaatggaaaatcatcatcattaacatcagtaccatctaaattaagagcttctaattgttttaagggaaggtggaagctaaaatgaaccggcccatccaacagagggcactatctgtggaggaccaacaaaggaaaacagagcggaaaatatgggcgcacatgtgcctccagttcatgaagttatttggagggaggggggaagaattaaacttacattattgattacaaaaacagttgaaaatctgttagagtgaaaacagccatggtaatctacagaagaaaagggagaatggaaagtaaagatcattcatgtcttgaaataagttgtctacagtctgtgagaacttgtgggaggtgatcctagtgtgatatattagtgcatgagcctagcaaggaaatcacatcaccacagggcttagcgcttagaattagaactaagtcctcattatttgtgagaaactcaaaacagaacttaacaaaagtgtttaacaactttcaatttttaagaagggacgctatctcattttcagacgccatggatcctcactagcaaaacacaatgtcacagacaaacgaggcatatcaggtttttctaactcatttcggtactccatcacttaatcatgaaataatgttgactatatatatatatatatatatatatatatagtcaacattatgggttttttttgttttttttttttttttttttttgagacggagtctcgctctgtcgcctagactggagtgcagtggcgaaatctcggctcaccgcaacctccgcctcccgggttcaagcgattctcctggctcagcctcccgagtagctgggactacaagcgcccgccaccacgcccagctaatttttgtatttttagtagagacggggttttactatgttggccaggctggtctcgaatccctgacctcgtgatccgcccgcctcagtctcccaaagtgataggattacaggtgtgagccaccacacccggctctgatgtttacaatattataccaacaagggttggatcgtgtgtgacttatctagaggttaagagcaaaagttatgaaatcacagtgccatcatgggagtctagctttcaccatttaaagttgtgtaggcagccaggcgtggtggctcacgcctgtaatcctagcactttgggaggccaaggtgggcggatcacctgaggtcaggagttcgggaccagcctggtcaacatggtgaaaccccatctctactaaaaatacaaaaattagctggggttggtggtgtgcgcctgtaatcccaggtactcgggaggctgaggcaggagaatcgcttgaagctgggaggtggaggttgcagtgagccgagaccatgccattgcactgcagcctgggcgacaagagtgaaactccatctcaaaaataaaaaaaaataaaaaataaagttgtgcaggccgggcgcggtggctcacgcctgtaatctcagcactttgggaggccgaggtgggcagatcatgaggtcaggaatttgagaccagcctgaccaatatggtgaaactccgtctctactaaaaaatacaaaaattagcctggtgtggtggcgcattcctgtaattccagcaactcaggaggctaaggcaggagaatcgcttaaatccgggaggcggaggttgcagtgagccaagattgtgccactgcactccagcctgggcaacagagcaagactctgcctcaaaaaaaaaaaaaaaaaaaatatatatatatatatatatagatatagatatagatatatgtgtatatatacacatacgtgtatatatacacgtatataaagtgtgaacttgggaaagttatttaatcttattgtgtgttagtttccccatttataacatgggtgagtaatatgtatcctatttcttagagtcaatgggaaggttaaatagcaaaatgaaggtaaaagtaattagaatgtaacaggcacattacaatcactcaataaatattcttctgcctcagcctcccgagtagctgggactacaggtgcgcaccaccatgcctggctaatttttgtatttttagtagagacggggtttcaccatattggctaggctggtcttgaactcctgacctcgtgatctgcctgcctcggccttccagagtgctgggattacaggcatgagccaccgtgcccagccggctgactattttcttaagaataaggatagttggtcacctcgggaggctgaggcagaagaatcgcttgaacttgggaggcggatgttgcagtgacccgagatcccgccactgcactccagcctgggtgacagagcgagatgcggtctcaaaaaaaaaaaaaaaaacaaaaaacgaaaaaaaagaaaaatagtcggccggggacggtggctcacgcctataatcccagcactttgagaggccgaggcgggggcggatcacttgcggtcaggagttggagaccagcctggccaacatggtgaaaccccgtctctcctaaaaatacaaaaattagctgggcattgtggcgcaggcctgtaattttagttactctggaagctgagccaggagaatcgcttgaatccgggaggtcgaggttgcagtgagccgcgatgaagccattgctctccaacctgggtgacaagagctagactctgtctcaggaaaaaaaaaaaaagaaaataggaaagctgcccgcaaagcctgcaccttggacacctcgtctgcactaacatttgggaaattcttcttattatttctccggaacatatatatttacattctttacatgtctgtttcacgttaaagaaaatatttctggagcaatcaatttttttttcctttttttttttttttttctgagacggagtttcgctcttattgcccaggcggagtgcaatggtgcgatctcggcccactgcaacctccgcctcccgggttcaagcgattctcctgtctcagcctcccagatagctgggattagaggcatgcaccaccacgcccggccaatttttttttttttgtagtagagacggggtttcgccattttgcccaggctggtatcgaacttctgacctcaggtcatctacctgcttcggcctcccaaagtgttgggattataggcgtgagccactgcccctggcttccaatttttttttccttttttttcttttcttttttttttttttctgagacggattttcgctcctgttgcccaggctggagtgcaatggtgtgatctcggcccactgcaacctttgcttcccgggttctggcgattctcctgcctcagcctcccgagtagctgggattacaggcatgagccaccacgccccgctaattttgtattttgtatttatttatttatttattttcgtagatacgtggtttcgccatgttggccaggctggtatcgaactcctgacctcaggtgatccgcccgccttgccctcccaaagtgctgggattacaggcgtggccatcgcgcccggccaaatatttttcaaaatctaattttgcataatgaccaagatttgcagaaaaatacaaattaaagagatcttttaaagtaaagattcgtcataaaagtcacagaaataatactcatgaataataaattagaatgggcaatgttaagtacttgaaataacaaaggttttagagtcagggtttctgcagtttccctagccatataacgaggagactgttagagaggatatcctaaaatgctttccaagtttacccacctctaactcggaagaaggcaatttaaactaatttggtttaccggaattcaaatacgtacaattcaacataatgaattgaactgaaattgaacacctgcttgcgtaaacctagtcggctcgagttgttctggttctggattggtcagtctagagttccaggggtgtggccaaaagtctgtgaggcggggccgtaggcagcctaaatcaggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatggtgagtctccctgggcccgtgcagtcatctgccgcgtatccgagccatccgtggtccctgggtcccagtacttgagctataggcacgcgaagcccggttgctcttctctggccgtttctgtcagaggatggttgtcgaggggctcggggctgttggcagggcgtccgggctggcgggctgcgctgtagacccggacacgctgggcttcgggctccagcgcctgggcagtgcaggagctgttgcgcttgttgacttcgtggagcacggtggatgggggtagggggcgggcgggatagatggacactgggaggcacatctcgtctgcagttcctcattgggctaggtaggcggcttgcaggtgatggcagtacaagaggtgaagaaggtgcgggcagcgcctgggcgagttgcggcaagtgaaaccattcccacgtgtaagctagaaaacttgtcagctggatggatcttcatgtttcatagtggggaaacaggccctggaaagagatgttataaaaaggtagtcctgccctaagtcatgcgttattagctcctccagcatccgtttttaactttaccagcaatcttttttttttctccttacctttgatccgttactttcaagaattgagtaccactgacgtggatttaatttggtgtggtttctcaaagtaaaatggagaaagtctaggaagttatttgctgccatgaaagtctcttgcgcctcctttttggtaaaattgttagcataaattgcttaatgcccacattttttgttaggtattaagtaaaggtgcagttcagtccttcagaagggaatatcgttttctctgatctctgctatggccattctagaaggatagattacatgtaggtagtgagtacaaggtttggggcacatttgtgcaagacatgataaacacagttcattgagtgacctttatatgagccacagcagtttttaccccagagaagtgattctcaacccggagtgatttttctcctaagggaacagttggctaagtctggagacatttttgattgtcacaactgggaaaggtgggaagtgcttccggcatctagtggttagagggctgggatttttatagttattctaaaacatacagtccccacaacatatccatatggaattatccatatggaaatatcagtagtgctgaggttgagaaaccctgccccagagatacacataacctagtgaagtaagttgtacagattcatgtgtaaaaccattgtgttttcctggtattttatgtattccttaggtgtatcctgtgagtttggccttgcccagtgggttttatttactttagttcgctacatgactaatggctacaaattggactgcaacattctaggtcttggaaaatcacagcaaggccaagaaaagttggagtagttttattaaccagagtgtttatgttttcagaacgacaccgtaactatccgcactagaaagttcatgaccaaccgactacttcagaggaaacaaatggtaaggaagggcacatcaatctttgcttaattgtcctttactctaaagatgtattttatcatactgaatgctaaacttgatatctccttttaggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagagtaggtgtcttttcatttgttgatcagctcctgaagacctattttttcaatagcgttgtgttgtgagtgtggtaaaaagggcaagaccaagcaatctgggatacaactctgaaaggattaagagaaaaagttatttcataaaatgcacaggtggagtacgggggttcaaaattgaagtctgacatttgagctgagttcagaagggcagctgaagtagtgttcttggagatgggctaggggtaaggattgttttccagaggagaagtaaggggatgtgtttggaaaggtagcctggcaccaaattcacttagtttggattaagtctgcatctgggcttaaacccataggtagtcaggaaccaggaaaagtttttgattgtatactgagtgtcaaacactgcagagtgaactacagcagtgatctgggcaagctccccagcttacattctagtaaacaagtaagcatcatcacctcgaagtgcttgttttgtttgttcctttaactcactttatcctatcctgttagataaaccttcccatacgatagctgtgagggaaaatcctggtgatgtcataggtagaggctgcacttttttttttagagagagagtttagctctgtcgcccaggctggagtgcagtggtacaatctccttggctcactgcaacctccgcctgccaggttcacgcaactcttctgcctgagcttcctgagtagctgggattacaggtgcgcaccatcatgcctgggtaatttttgtatttttagtagagactgggtttcaccatgttggtcagcctggtcttgaactcctgacctcgtaatccgcccacctcggcctcccaaaatgttgggattacaggtgtgagccaccgtgcccagctgaggctgcactatttttaactgacgttcggtcatgttaaaggccttgctgaggtggtgacattgaagctgagatccttgtaaagatttggaagtagtctttgtaaagatacagaaacagtcttgtaggccccaggaacagcaagtgcaaaggtgggcagagtggagatgagtagatccggaatctccatgatgtgggggttgtaaatgcttgtctgtcataagggagtaatggggagttgaaatgggaagagatcccctcagccacttcggaggtgccttgttttggtagtgcaaaagaagaaaaaatagtgatctgtgagctcaagtctggacaagaacagccagtctcccaaactccctgttgagagaatgttgagtggaccatttgtttcctgtgaggctattccatacctaaaatcccttgatgatcctttctgttccagcaaaaacatgcattaaatgtacttgaaaagttttggtttagaaagctgtgtttcttaagctcagactgggtcagtttccctaccagagtggtgggtaatgattttaatgtttacaagtcacctggatgtactcttttctcattcagcatggcctgtatgagaagaaaaagacctcaagaaagcaacgaaaggaacgcaagaacagaatgaagaaagtcagggggactgcaaaggccaatgttggtgctggcaaaaaggtatagttcattaaggaaaatatagaaacgtcattaattgtaggtctttagtttctaggaaagaagggatcttattaatttttaaaataacttttcttaatgtttcttcttttccctcttcttctggattacagaaggtaacatgttttaagaaactatgtagcatagtgtcttaacacctcagtaaagtagcttggcccaccccttgtcagctcacagcacaatctggaggccacattggttcattgatcccagctggtgggcacctttcaagcctatcacaagaagttttaattttactaattggcatagaaccttcaatgcagagcggatcccattccctgtgattttacttattaatatggacactggtttaagaagcagttggatcaatgtggcccgtgttttcctggcacactggaaaggcaactgagatctcaggattgctttcctctccagttggccaagacaagtgattttagcgataagcagctttttaccagctttgctagctgtaaatagttggacattgtaaatcattgaatagaattaaggtgttgggttgttaaattaacaaataatcaagtgttctgtgaactttttttttttttttttttttttgcttttcctctctactttcttggatttcttgttcatcagaaatgaagtgtctagcaggtactgagattgtaagcacggtgtggggatgcatcaccttcactgagtttgctttgatgatgctttgcatgttggcctttggacgacagttttatagtatggtcgattataatgccagtgctatttaggctggtgcaaaagtaattgcagtggcaaaaaccacaattacttttgcaccaacctaatatgttttaagatagtatattatgagcaaaggagaaaacgtttaaaatcatgtttattttgtaaactccaaaatgcatgttacatgtgaagtgactcactggaggaaggtgagtactttaccaagtaggcacttgggaaatgctgtgtccacatacttaggaaatggcttcagttaacactgggcttgggaagggctctcttatccaaggagcagtcttctctggagccatgaaaccagcctggcagcactggtaataaactagtctgtgaaatctggcaaagcctctgtcctgtttggatatacgcaaaactgccttttaccatttccattgctttttattacttaatctcccaactttgtgcctggtgtctttttttttttttttaaaatagaaaatttttgaggtaattatgtattcatataaaagtctttggtggatatgctttttcccacaagcacttggttagaatggcccattacctcatttgtttattttttgagacagggtctcttgtcacccaggctggagtacagtggcatgatcatgggttactgtacctcccgggcttgggtgattctcccacctcagcctcccttgtagctgcgactacaggcatgtgccaccgtgccctgccaattttttgtagagacaggatttagccgtgttgctcaggctgctcttgaactcccggacttgagcagtctgcttgtctaagccttccaaagtgctgggattacaggtgtgagccactgtgcccagcctgttacctcatttaaaacaaattttgcacatctgaacagcctaaaattgtaatgtgataagtggggtaggagtggggtgggcgtagtgggattttgaatcaatgaaggcccttgttcttgtggcatccttttgcagtgattccctgccaggcaaggcagtaaacctgggattgcctgcccaggactgtaatcacattgatgtcccagcgccatggagtatgtaatgaatgaactgccagcagaactactcactaagaactactccctgtttgtgaggattgtacctgttgagagaagttgcaaaaagaattagtcaaaagaattagtcaaaatttgtcctctgacctaggtctgaaggacatttaacacattgattgttctcttcatccagcctttgagccctatgagttagtgcccttagcctttgagtcccacaggtatggaggagctacctgtggggacctgagccatcactattcctgcttcaagttacactggtgcctctcactagcactgctctgaaaagccagctggaaaaatcaatgcatttgagtacataaattctttggctccaaagaaatgccatagcaatattgcttttaattcagttttgtttagatgttagaattggtatttgttcttgctttttggttgcgatggagttatatactaagttacttatactaaggcattagtagtctcatatctgaggagcaattgtatttttagttcagctaaattaatgcctctttttaaatactaacttgtactacttttgtggctgtgaatggtatcttttattgaactgaggcagcttttaaaagacttgcctgatcatttagagcactcccattgaggttaaattagacttgaatctgtaatgattctcgtaactgttcctggtgtgtgtccagcacaatgttgctgggcagagcagaggggcagaggctcaggtatgtacttcattgacaagtgggcaaggccatcctgggtaccacattggcttaatgatctcttcattgtgaagtccggctacctcgtttgcataagaactacagtaatcaggcaaggcattgtcagaattgggaggaataaaatcagtgagtctggaaggagtgctctgtatacaattgcaaagaacaaaatggtcatctttaaggtacctgattgcatgcacttaaatgcagattattttggagtttgaaaagggactattaatgaaatctttcttttccctcctttctctttttcccttccccgccactgattcagtgagctggagattggatcacaggtataattcaagcttttcatgtagtcatgtagatcactagactccttggtgtactgacgtagcaatttaaaagcagatcatgtgtagtacatctagaagtagatttacaaatattctgaagagttgtaaccttttaaaatactaacagtgacatggttttgtttttaaggtttagcaatatttagcccattatttttgttttattcttaacttgaatgtttgtaaattttatttcttgatgctttcattgtgttatgataacatcaaaataacttgatattctaggttactaataattgttgtgcatgagtgttactacttttggaattgaagactttaaagaattttaaaggcagttgttgactaaacttctttctcttgattcacagccgaaggagtaaaggtgctgcaatgatgttagctgtggccactgtggatttttcgcaagaacattaataaactaaaaacttcatgtgtctggttgtttgaaatgtatttgcagtttcctgggactgctaggaggttagtctgctgatttcagttgctgtccaagttcacatgctccatgaagcattcagtgaaaacttaatgtcatggggtggtgtttgtttgctgcttggtttatagcttaggtgggttcatctgggagtcaagcttgtaaatgctgtgttaagaaccatgtccgcggtggacgcagtgtagtggctcacagtcatcagcacttttgggaggtttgggtgggatgattacacttaagcccaggagctcgaggctacagtgaggtgttttttttttcgagacagggtctagctttgttacctaggctggtcttgattgaactcgggctcaagcgatcctcctaccttggccacataaagtactggcatgagcgaccacgtctggcttagagtctaaaaagtaccatgtctggataaactggagaaatctcaggaagcagtagagagctgaaagacttggttgggcatgaaggggactcaggaaaagcaataccgtgaaggcagaagggttgaggttgcaggaaggaagggtagtggaatgttttggagaaaagatggtcacagcccctgcatggagcacctacagacaggagggcagggctgagaagagttaagtcatggggctgggcctgctggccagggggtggttggagttctgttttcatatctacagaggctgtgtacttcggtttgtggggcctctggccctgtaggttctcttgctaaggaatctgctactactttgctaggaccaggaaatggcttactagtacagaacgtgtggaagaatggggtctttgatgtgatttgacattttttgatgaacagtgcataccaggctgaaggtaatgctaggggcagcaaaggttggggtttgagatgcagtttcctgtgactgagctggagtgtggaagcagagaaggcaccctgtgagcagcttgcagaggcaaggtggtgaggatcctgacagtgctgcagggatgggatgggatgggatgggacaggacgtggagctgggggtggttgctaagttgatgcagggagagtggaaggaagcaattgagaactgaagggtaggaaatagtttctgatgtgaagaaaaagggcatagctgcagagagcctgaatgattgaaggttggcatcaaagtcacgaagtggggaggcttttctgttcagctgtgctcagggcagaagttgtagtctttcagccagtagccttgggaagggaggtgggatgaaactcaggcttggcctatttttccagaggatccacttgggttgtgatattatagaaaatgtggcagtcttgctgtgagccttgttaggcataacatttggaaacttggcaaattttacgtaaaggtctggatttccagcctcttgaaataccagaagcagcagtagtagcccaccttcctgtttgataacaattggcagggctccaggctggctgcatctgttgggacaggtattctctggtctccacagcctttgctcctacggccagctaacaccctcctctacctgccctctggtcttctgtccctgctgcctgcttctcttccatctagtccatccaagtgttttttggggaagtcacctggtaccttgttagggttaatttgtcttttaaattgggctcccaagggtatctgctagctaccctggctcacaaggctattttgaggctgaggatgtaacaactgtgaaaacagtttggaaactagtgctaagcaattgtttgtcaggaagcagggacttgtgggaactcaaactgtggacagattcagcacattgtaggccctcacagtaaccaggctaccctgtgctgtcagcaggctttggaagagcctccataaaatgcaaacttgactttactaagctgaatcaatattgagggagcacatcccttccttcagcttgtcactgatgggaagctgtggcttagagagagcagggatctttgaagagtgatgagaaactcagctagaggtggttctgggaaggtacctgcagtgaatatttggggtgctgctttttagcttttcctagcaccacaaccatgagttctgtttgtagctggatgtgcctatgtaatcaggcagctttcaactctgcactcttcctttcttccctggcaagttgcttattttaggctgcccttaaagacagcatcttacatggtgctctcatggagccgaaacaggtgctgtcctaaactctgaacaacgatctccattaatctgcgcgcgcacacacatacacacatattttttttgagatggagtctcactgtcacccaggctggagtgcagtggcagaatcttggctcactgcaagctctgcctcacgggttcacgccattctcctgcctcagcctcccaagtagctgggactacaggtgcccgccaccatgcccgggtaattttttgtatttttagtagagatggggtttcaccatgttagccaggatggtctcgatctcctgaccttgtgatccgcctgccttggcctcccaaagtgctgggattacaggtgtgagccaccgtgcccggcctaatctgcatgttaactccaagaagcatgtcttcctggacccacgctggaaagggtgtagagcagttaagcatcttaccagtgtctcacccatgaagtggtggggatgggattggaatgcagtcatctgactccaaaacactgcattttttcaggcactccagtattaagctactttgcactgtgcatataatggtatataaaactcatgactgccagcagggtgccagttgccatgggtttattgaacaagtgttagatggctagccaaattcccaatttactgaccacctgctgtgtccctgttctgcaagttggggataaagaagctgttctgtcttgaaagctctgaggtagttaatgacgatcccatgatctggcttctgttcctttctgtgaagtagcagatagtgtatgactgtgacgtgatagaaattgagagccaagaagatcagtgcagggaggctgggtcttggaaggcttccaggagacatacagcagtccccacctatctagtttcagttgctgtcggtcaactgcagtctggaaaattatcatggctaaatggtctgggatcacccaaaagtgatgatcctcttgaagtgtcatcagaaggtcaatagtagcctaacacgtcaccatgcctacgtcatttacctccctctcccttccacataggcattttatctcccatcaagaatgtgaatacatgtacgtattcagaggaaaagagttcatgcagcctactacagtataattattaatatcttactccctaaattatgaactttaattatgtatatatagcaacaaacttggtgtagatagggtttgcggtttcaggcatccactgggggtctaagaacgtttgccccatggataagggaggattactgtaacaccagcagtggcaagagacatgatctgatttggatgcacaggagaaagttctcatttgaggccatgaaaaataggaaagaaagcagggagatgggagcaggcagtgtgggacaaggtgagaccagtcattctgcaaggggaagagaggatgacactggggaggtgggagcagagtgggtaggtaggcattctcttgaatcaacaagatggaaggccctacatgactgatgcctttgagcagagttttgcacaatgcatttctggtgggagatactccatttcaaaaatagtcttcaggttggctgctagagcacagaagtatgacacctgactcatttgtgctggcagagaggctctcctgggttttagagctttgtgaacacacctccatacattaatccaactgtccttccccatccactcacccttgaacttcccgcatgccagatgttgaggggaggcagaaatgagacctgcctcccagtgcccacagtctggatgagagggtacaggtgaggtcctggtaagaaacgaagctggagaggtcagcggagaataaatcagggaggatcttgtatgccaagctaaggatttcacttgttcagtgttttggttaaagaaaataaaacgttggagaattagatgttctgcagtggattgtgtgttcttttcacatgccgagttcctccacacaggaaatactttggcaacgctctggctgctcatcatgcatattggagagggaatttatgtagaaggttatgggtcgatgagatggcatccaagtatttatcgtatttttttgagatggagtttcactcttgttgccccggctggagtgcaatggcacgacctcagctcactgcaacctccgcctcctgggttcaagcaattctctgcctcagcttcccgagtagctgggattacaggcatgtgccaccatacctggctaattttgtattttgtagtagagacggagtttttccatgttggtcaggctggtcttgaactcctgacctcaggtgatctgcccaccccgcctcccaaagtgctgggattaccgtcgtgaggcaccgcgcctggccccaagtattaataactcggaaaaagggaccagatcaggaatcaggagtcacagttcctgatctccactcagcttacaatcagctggggccatggatgggcaaaagacttcccttttctgggcttctatttccctccctgtgtctgtctgctatccgggctagatgagtaattccgaaacctggcaggtgggggctttctttttttctttttgtgagatggagtgttgctttgtcacccaggctggggtgcagtggcactgttttggctcactgcaacctctgcctcctgagttcaagcgattctcctgcctcagtcttctgagtagctggaactacaggcgcctgccaccatgcttgggtaattttttgtatttttagtagagatggggtttcaccatgttggccaggctgggggcttgttaaaaatacaaatgctggctgggtgtggtggcttatacctgtaatcccggcactttgggaggctgaggcgggtggatcacttgacgtcaggagttcgagaccagcctggccaacatggtgaaacatctctactaaaaatacaaaaattagctgggcgtggtggtgcgtgcctgtaatctcaattactcaggaggtggaggcacgagaattgcttgaacccaggaggcggaggttgcagtgagccgagaccatgccactgcactccagcctgggtgacagagcgaggctctgtctcaaaaacaacaaatgcccagcctcttgccccagttttcagagttagtagatctgggtagcgcccaagcacctgatgttttaatagcttcccaggtgaggctgcttcaggaaactggactgaagcttcccaggtgagctcaggcttgggaagctggactgaagtttctctaagatccgttctgcctctgagaattctgtctctaatgggaatactgtctctgccctcaagaagctggcagatgaacagtaatactattgctaattaatgaccacagaatagctaacatttattgtttaccatgtgccaggtactgagctaagtcttgcacaaattatctcatttacctttttttttttttttttttgagaatgagtctcgctctgtcacccaggctggagctctggattgcaccagtggcgcaatctcagctcactgcaacctccaccttctgggttcaagtgattctcctgcctcagcctccatagtagctgggattacaggtgtgtaccaccacacctggctaatttttgtatagtagagacagggtttctccatgttggccaggctggtcttgaactccagacctcaggtgacccacctgcctcagcctcccaaagtgctgggattacaggcatgatccactgcacctggcctcatttacctgcactcggagggaagtactattacccccattttatagatgaggaaattgaggctcaaagaggttaaggaacttggttaaagttacacaactatggcatcctatgataagcctgggggcatttgtggaacatcttgccaaggagctagaaatggtcctgagccttaaatgggtggaggtgattagctgaggcagcgattctccaggtgtggtcctggacagcagcagcagtgtcaccagggaacttgctagaaattcaatttcttgggctccaccctagaattactgaatcagaagctgtgggtggggccaggtaacctgtttttttttttgagttgcccaggctggagtgcagtggcgtgatcttgcttcactgcaacctccgcctcctgggtgcgattctccacctcagcttcctgagtagctgggactactggtgcctgccaccacgcctggctaattttttttttttttgtactttttagtagagatgggatttcaccatgttggtctggctggtcttgaactcctgacgtcaggtgatccgctggcctcggcctccaaaagtgctgggattataggtgtgagccaccgcgtccagccagaacctgtgttttgataagctctccaggtgattcagatgcatgctaaagtttgagaaccactgagcttagggaaggggaggatattccagagggggacagctgtggagacccggtaggacagtgctgtagactgccccatccctgccttttcacttggtgaaataaagacgtgtgatgcactatgcagactcccacaagggggcactgtgggcacagacgtggaagcggtctgctttgttgtcaagaccgctacccttgtggaagcatgaaaaaagcttgatgccagatcaactggagaggtcactctttcttctcagagaaggtctaatgggggtggtaatcttgtttataggattcggccctcgtagggaagctgaacctggagggctttctgctgttcatatgtgcatggtgatgtctacccatccgtgctgcgaggtctctgcagatcctgtgcaaacagcattcccccttttgtagctgcccagccaggcagcttgcggtttctattgggggaggtgggggccgaaggctgggaaccccagcagcccgattctgcttcagccttctgcctacagtgctatgcctctgtcctattctttgacaagcatgggtccggggccacagtgctgggtccaagacctgttttcaagccttagctctgccccaccacactttaagatctctggcaagacccctttctcctctgggtctcagtttcctacactgtaggatgagagagtggtgctgagaaagtggctgtcaacatctctttccactataaaattctgccctgggagttgaggaagagactgccttgtgcttttcaaggacctcggattgcaggggatctgtaaaccctgctacatgacatccatctccagtagccacttaaggaagcatttccagggatatggtgcaagtcagtaaggtggaatctctcaaacaagattttttaaaaagtccatatcttcagacatccagaatttgcttttataggtttctattctgcactgtttggaagaaggaaaatttataccatgttctcttttctgctgcagtgtgtatttcttccaaaaatacattgcctcggagggtctttggcattcacctcgttaatccagggattggcatcctatactctcggtgactgctcacccagctgagccactgctctgcctgggcaggaaatctccagaactgccttttcagagcgctatagatgtgctcatccctgggttataaggggattcaaaagagtggtccagccctctgctggctcccaccgtcgatgatgatattcagagagtctggttagaaattgcccaacccagccgcgtgcggtggctcacgcctgtaatcacgttgggaggccaagatgggcagatcacaaggtcaggagttcgagaccagcttggtcaatatggtgaaaccccgtctctactaaaaacacaaaaattagccgggcatgggggcatgcacctgtggtcccagctgctcaggaggctgaggcagaagaatcgcttgaacctgggagagggaggttgcagtgagccgcgattgcaccactgcactccagcctgggcgacagagcgagagtccatctcaaaaaaaaaaaaaaaaaaaaaattgcccaacccataggcaaacattgttaactgcagctgtccttggtggaggaaacaagttaaacatgatgtctctttccatcaggcctccttggagcggggaaggagagctcttcagttcctttggcaccttcacgcagcatgcaagacgggctgctttttcttctgtttatggatgaggcacagagggtagatgacttgccccaagtccttcagctcattcatgctggggaaaggagtaagcttcaggcgtcttcccctggagttcacgccacctctgacagcaagtgagccgtttgctactcaagtgctgtttcttgcttttttaaggtaacaaaacactgcatgctgtctggggtaccttttccctgctgttcagttcattgccctgtgtcgtctcacagagcgtgtcactggtacagaaatgttccctgggaagctagagttgaaacatcgcccactggtgctcctgagctggctttgtcatgggtttagagggtatgttagggaggaggccttctgctgcaagtctctgagaagtcagcttacactgccttgaacagtgaggttgcttattagctcctgtaagaaccccctggatgcccaggagccttcagggttggtggacactgcagtttaacagcgtcttcgagggcctagacgttttctctctccactttgctgccaatgctggtgccattctgagggatagttgcccatcacagtggggctgggactgggtgaggcaatgaagcgcttagcatgtgaaatccaaggaggtcttcacccacagtggtgctagtgcaaggtcagcatctccttgaccctaagagcaccttgccctagtactggggcctgtgggaggccacccactctccacaaaggccagaccagaagtcacctgtgttttttctgctcctcttccatcggctgggacttagtctcctgcaacacctaataactgtgaggtgggctgggaaatataggcttgttccagctcaggcagatgtgggagcacagttttgggggacaatgaccagtctttgccacagcaggaagaaaatggttgcttcatagggatcctttcagcagaaacctcccagcaaaagggggaagtttactgggaagctgtgggtgatctaacaaagccaaaaggtaggcggtgctggcagcctccctggatttgggtctggaaaatcatttcagaacaaatcagctcttccttctcccctccttcctccttccccctctttgagtctatgcctctctctctctctctacaggctggcttttctttgttcccctttctgccccatggctgccacaaccaggattttattgctccccattccaaacttccggccagattagttagacctgcatcctccttgccacttcccagggacaagatgctgactggtctgtcagctcatggagcccactcccacttacctggggctgaggagcacctgctgggaaggtttgagggcaggagggctgctgatgtatccaatgcagccaccactcccaccgctgagacatctgtctttctttccttcttgtcactcccagacctcagcaagtggccgctttaaaaagagaataagagctttattgaggtttaattcacagaccatatattcacccttgtaaagtgtgcaattcaatgggtttcaatgtatttgcagagtggtgcaaccaccaccaccacctaatttttaaacattttgatttttatttggtctcactctgtcacccagcctggagtgcagtgatgtgatcatagctcgttgcatcctcgaactcctaggctaaagtaattcttccacttcagcctcccacataactaggactacaggtgcacagcaccaggcccagctactttttttttctttttttttagtttttgtagagacagagtctctacattatgttgcgcctcctggcctcaagctatcctcccaccacacctattcatttttgatcatttttattatgccaaaaagaaacccttagcccggcaggtgtctcatgcttataatccctgcactttgggaggctgaggcgagcagatcacctgaggtcaggcgttcgagaccagcatggccaacctggcaaaaccctgtctctactaaaaataaaaaattagacgggcatggtggtgagcacctgtaatcccagctacttgggaggctaaggcaggagaatcccttgaacctggaaggcagaggttgcagcgagctgagattgcgccactgcactccagcctgggcaacagagtgggtgagactctgtctcaaacaacaacaaaaagaaaccctgtagacattagcagtctctccctatttccctcaacctctgccccagcccctggcaaccacaaatctgttttctgtttttataaatttgtctattctggaaacttcatataaatgaaatcatatagtgtatataggtttttatgaccggattctttcactcagcctaatgtttccgtgctatgtccacaccgtagcatgtatcagtaatttattccttttaattaccaagtaacattcccttgtgtggatttaccacgtcaacatcagttgatggatatttgtgttgtttctgctttttggctattctgaataattttgcagctatgaaaattcatgtgcaagtttttgtgtggatgttttcacttctcttgggtatatacctcggggtggaattgctgggccttatggtgactctctggttaactgttttccacagaggcagcaccattttatgttcccaccagcaatgtacgaaggttctaatttctccacatccttcctgacacttgttattatctgtacttgattttagccatgcaagtaggtatgaagtggtatctcattatggttttgatttgcatttcataataactaatggtgttgagcatcatttcatctgcttattggctgtttatatgtcttctttagaaaaatgcctgtttgaatcctttgcttattttcaaatggggtgatttgtctttttattgtgttgtgttagtttatatatcctggatgcaaatctcttatcagatatatggtttgcaaatattttctcctattctgtggattgtccatttttaaaatttatttatttatttatttattttgagacagggccttgccctgtcgcccaggctggagtacagtggcttgatctcggctcactgcaacctctgcctcccaggttcaagcaattctcgtgtctcagcctcctgagtagctgggattataggcatgcaccaccatgcctggctaatttttgtatttttagtagagacggggtttcaccatgttggccaggctggtctcggactcctggcctcaagtgatccacctgcctaggcctcccaaagtgctgggattacaggtgaccgccaccacccccggcttagttcttggtttttctgtccttggaaactgctgtcagggttcccgagagactttgaatgtaacaataataccttccttttattgagtgcctactattcactgtgttgggcacattgtatatattaccttttgtcctggaaatagttttacaaggtggggattattgtccccatttcatagtgtgatgaggatgctaaaaaaaagcaaatgttgcctctagctgccgccatgggaggtaggcacctggagcgaaggcacggcaggttctgctctgccctatctccctttggaccccttctaggggttatgttggatttggaagccacgaggaggagtctactcagacaagagcatcctgatgggggctgccttgagatgatggggtgtaagccctgtttagctggaaatgaggagagagagacgtacccttggtcaagggctatcatgtgaaagaagggtaacatttgtcctggagtgtggagtgtgaagcatatggggaaatggtttgggctggatagcaggcagtttttaaaacttggagcaagccgggcgcagtggctcatgcctataatcccagcactttgggaggccgaagtgggtggatcacctgaggtcaggagttcgagactgtccttaccaatatggtgaaatcccacctctactaaaatacagaagattagccagatgtggtggagggcgccttgtaatcccagctgcttgggagcctgaggcaggagaatcgcttgaacctgggaggtggaggttacagtgagctgagattgtgccattgcgcttcaggctgggcaacaagagtgaaattccgtctcaaaaaaacaaacaaaaacaacaacaacaacaacaaaaaaaaaaaaagaaaagaaaaaaacctcggagctaatggaaggggcctgccccctgggaagcagcaagcttcctgttgctggtggtacacaagcagagcctggctgctttctaggtgaggtggttgtagaagctctttgggttcagagtcctgggggggttttagggtttccttgaatgcccagagcctgtatgtcatagcttctgatttcacagggacttcctgtccacgcagctgggatctctcccagcccagattcatcatgtctcacccatcctgagggctaaatttggaatttaataacaacactttggatttatgtggcccgtttccttggaggcattacatctgttatcccattaattctcctaatatctttgggtggaaggtgagggaaggtgagggagcctgagaggggagaaggaacctctttggcttcttcagctcctgaaggggagaggaaatggcagagcaggagcgggccggggatgggggaacgtctgcaccacagcccctctggctttcccctctcataaaaagcaggttgctcaccggatgaaggggtgtctcccagcaggaagctcctgtgttgggcacagtatattggtgcataagtctccaggtggactctttgagggctggaagtgggtagacatcaaggtgggcaagatgaagcctgagccctaagcttgggaggagaccaacatgtctaccacgaaccaatttgcagagctggatggtctggaggaagcagtatggcttcctggggaagggggatttgagctgagtttggaaagagtcctggagcaccctggagtccagtttcctacctcctagtcacgtggtgtgggtgaaggccataccttggtgagctttcccagggtatgggggtgcctagggtgctcctcaagatcctaaggcttggcctggagtgctgttgggcgaatggccagagagtctgggcaggcagaggagggctggggactagtgcagggaaggagccgctggcactggccatgaagaaggagtgggaagggaagggaagggtggcccaggtggagggctctgtggggcagaggcagattggtgtgggggttcttgtctactccagactatgctgttttcattcctgcctctgttctgaggcttgaactcctgcaggtacctggcttttacagccctcccaagtgcccttccttcaagctttggctctgactgctgctgatcttccctggtaccaagtgagggaggtgcagaatcccaggccacaggcgcagaacagggcggctggaaggcacctggacaatcctctgagactattctctccttcccgcttttgcagatgagggaattggggcttggagtgcaagcattgggaagaatttcccaggaagagagatgcacagatgtgaagaactcgaaggcaagagaaagccggggggttgtgtggcaggtagaagtgccaggaccgtggagcgtgtggacatgtggcagattgcggaggggctgtggcaagtatttacaggtggccgttacctggaggaagactgaaaacagagaacagtgctgccaggcgtgccttttggagagggcactggtcagaaacggagccttcatgtcgcctgcctcacctgctcctgctggttctccccaccctgtggacggtgacttggtcctccacttgccagaagccttgtcagcaaccttgactctgtcaccccacatccaggccatcaacaagtcttttggccctttctttgaaatccaccaggaatccagctgcttctccccaccttcctgcctctctggtctgggccactaatgtcactgccatggccgccttgctgcatttctgaggatgcttcatctctccaccttcttctccactcagcagccagcagggcactgtggaaatcggagtcacatgagctggcacctctgttcagaaccctccagggctccacatctctctcacccaaatgccaaagacctccccacgcccccacaatcccccacgacctggccactggcctcccaccaccttccagctccagcggctcctaccacatttaaggctttccttcctagttttaatttttcctcgtcagcagttgattttattattttcttgtttattggtattttcccactagaaatgaagctgcgtgaagttagagatttttttttttggtctgtgttcctaattagctcattgctatacccctggcgcccagaacaatgccttggacacagtacgcagtagactaaataaatacttgttgaatgactgactgacggaatgacggctgtgtggggagtggattgggtcgtgaggcagaggctgcggtggaaactcaggcaggaggtgatggtggttcttggggctgcggaatgccaagtttagaagctcttcctctgctgtggcacatgaaccggtcactcgagaaggcttttagatttactttgcctaatcccctcttagtgcatgtggggaaactgaggtacacaaaaggaattccccaccaagttaggggcagaacctagcccccttgtctcccagatggatatcttcttttttttttgagacggagtcttgctctgttgcccaggctggagtgcagtggtaccatcttggctcactgcaacctctgcttcccaggttcaagcgattctcctgcctcagcctcctgagtgtctgcgattacaggtgcacacaaccacgcctggctaatttttgtatttttagtagagacggggtttcaccgtgttggtcagggtgacctcaaactcctgacctcatgatccacccagctcagcctcccaacgtgctgggattacaggcatgagccaccgtgcctggctggacatcttgttattaaagcttcttctctctttgtaggggagggggagatgcctctggtggagaagaccagtgtggcagtgactgtgtctgttagtgaacctggtggctggttgagggtctgtcgtggtgactgaggacacatacaaagtgcttttctcagtggtcaccttggtgttggtgaataagggtcagaagatggctcctgtcctagggcactgccagtcggtttggaagctgaaatgcctgcttagcagtttgaggaaacacagaccttggaggatcttctggttgcctcttcaagaattcattctattccccttctgctccccaaatttgcttttcttggggtgggtcttggttggcctaagccaagaaagtatggcatctactccttccatagcaatagctcaggaataggcagtgacccagacctgaaccaatcagtgcatggaattacccctggccaaagtggttgattgaggctgggtgcaagcagagttgtgagaaggctcccatttggtggttggagagatcgcacttgctccagaggtcataatgtgcagatctgaggcttggaactgctgcagacattttgctaccacaagtgaagccaccctgacgacacagttgacaatttggagcagggcagagctgagagaacagcagggaaacagccagagtcttgctcaagcctccctgaagtatctatacccctggactctagttatgggggctaataaatgttatatactgtttaaggtagtttgagttggtttatctgtcattcgttattgaaaaaacatttttttttcggctgggtgtggtgacacacacctgtagtcccagctgcttgggaggctgaggcaggaggaccgcttgagcccaggaggcagaggttgcagtgagctgagatagtgccactgcactcactctggcaacagagcaagactgtctcaaaaagaaaagaaaaaaaaatttccattttcatcaaaaattgtattaaagattttctatgtggtgggttctataatatattcttatagggaataagacctatattatccttcccctccgagagcaatgaaaaaaacacaaatactgaggtgggcagatcacttgagctcaggagttcgagaccagcctgggcaacatagtgaggcctgtctctattaaaaaacaaaaagaaaagaaacacaaatatcacacataattatagacaaacacatagccaagttgaggaagaacagaaacaaaaccaaaacagtttttctgggctgatcactgatcagatagagatcatttacttgcctggcctttgctctaaagatctggtttcatgttggttttctccatgttactcatgaaccccaggaattctggaaaattcttacctttctaagatcaagagtaggtgtagcagtaggagcactttgagtgtcagggtgacagagcccagaggcaaggcccatctgcaggaagcgaagtgacaagttgctgggtggccccttgtgtgatcctagcattgtcaaggaagaaatcttaactgatatttgggtgatagggaatcatggggaagtgtgggtgtggatggggacagccagagacagatgtgactatttttttctttttctttctttttttttggaggcaaggactcactctgttgcccaggtgggagtgcagtggcttgatcaaagctcactgcagccttgacctcctgggcccaagtgatcctcctacctcaggctcctaggtagctgggaccacaggcgtgtgccaccatgcctggctaaaatacatatatatatgtgtgtgcgtatatatataaaatatatatgtgtaaatatataaaatacatatgtacatatattttatatacttatatataaatatatacaatatatatgtactatatatattttatatatatatatatatatttctttttgagtcaaggtcttgctctgtcacccaggctggagtgtagtggtgtgatgatggctcactgcagcttcaacctcctgggttcaagaggtactcctgccttgcctcctgagttgctgggaccacaggcacacactaccacacttggctaatttgtttttcctattttttgtagtgacagggtctccctgtgttgtccaggctggtctcgaactcctggactgaagcaatcttcccacctcggcctcccaaagtgctgggattacagccgtgagccaccacatccagccagctaattgttttttatttttgtagagaggtgatctccctttgttgctcaggctggtctcgaactcctgagctcaagtgatcctccctccttggcctctcaaagtgctgggattacaggtgtgaaccactatgcctggccagatgtgacttttgcttgaaatgtgctccagagccctgcctaagtcccgctcctctgagaagccttctgtcccaccaggtctggagggcaagtgccaagaaatgctctgagctgtttcttcctgaaagtggggcagcttgggctgtcagcatggtttctagcaccgttggggccatggaaagaaatctgtcttcctacagagtcactggctttttatccttccccttctgtccgtggacatgtaccctcttgggagagtattgatcagaggggacagcactgatcatgcctttgccggaggtctgtgcacacatccgcatgggcacctgttagcatgtgcttgctagagctacagatggcttcctgctgccccacaggtggggttctttaccttactttgccccttggtgggtggtgaccagtgggctccttcctggaatatttatgcatgcggaaaaaacatgaacttacaaagaaaaccaagtctattcaagtacacttagcaaaattaacatttgtgatgaagtaacaaatgtttccttattaatgcaataataactatcttgtggcaggtctaattactactataattcaaagtagggatggaggccctagtgacatttgaaatatctgtaacagctgtgatgttatatgaaaatatctgtgatttctactggccacaaagtctctggaagtgctcaaagtacagggatttattatctacattcatgatggaaaaatcttagaaaagaaccaaaaaaacacacaaaaaagaaaaaaaacaaaaatcttggaggtcagggctgggcgcggtggctcatgcctgtaatcccagcactttgggaggctgaggcgggtggatcatctgaggtagggagttcaagaccagcctgaccaacatggagaaacccttgtctctgctaaaaatacaaaattatccagggtggggtggcacatgcctgtaatcccagctactcaggaggcagaggcaggagaatcacttgaacccgggaggcggaggttgcggtgagccgagatcgcaccattgctctccagcctgggcaagaaaagtctcaaaaaaaaaaaaaaaaaaatcttggaggtcagtgaaaataaagatgtaacttttttcttatccaagttcatgggacccctgcattctatccgtggaccccatggggagtggctgtgctccccaagttaagaacccctgggtgacaggtactttaagaaatgcttgtgtgtgtgtgtgtgtgtgtgtgtgtgtattacattctgtagatatatgcacctatgcatctaccaggattctcctacccacagagaaagctacaggggacacctcttaccactccaggtggacctgctatgcacacacacacacacagccacaggcatgtcagagacacactgcatgtgtacatgcacatgctcgtatgcagcacatggggtcatgtgcacacacacccccggagaagtgtacacacaacttacacttatacctgcccacagagctgcagggacacatgctcacacacacaagcatgtggacacatactcctggctctgtacccagcgcttcctgtacacatgtgcacacaattctaagtcctaggcaggatggacagaggaggtcagattcatgccatctggatactgtccccaggcactaaggaggcctaatccaagaggatcagaatcctacccaatccactctccccaagtgcaaaccaaggagccagtgaaactctaatctgtaccctaatgggatttgatcaacgtcgctgtgccaccatgagtggggctgccacagagccctcgatttgagcttgtctgaccccgtggtgagggagtagggcagtgggcccagtacagtgcgggcgccccctcaaaggaaagcattcttcattggtaatgaacattatgtctgcagaaactaatggcccaacctcctattcagtttatgtaaaataaaacaggccatatgctgctgctttcagagtttgggtgtttaaattaaatgttgttcaatgaatattcaagcccatttgctccaaagttgtgctcaatgtggtggtggctctcatccccctccttcctcgcagcccctccctgctccagtacccagggtattaagccattagaacggggtgtgaacatccaggcatctgtcttccaacggaaagttggatattaaaatgccggagcagatgacagtataaataaagacatacagtgagaggctcgtctggttatttttttgtttggtaattaagactgaggaggttttgacttaagttctgtcttattgagaaacagagatagggggctgagatcattccacctcttccctctttactttgcccatctgcccagagagcggcttctgtgttggcctccatgtaactggcttattgacgagtgtcatgttggtggcatagagatgtgaaatgattttatttttatttttattttttttgagatagagtctcgctctgtcgcccaggctggagtgcagtggcgcgatctctgctcactgcaagctacgcctcctgggttcacgtcattctcctgccgtggcctcccgagtagctgggactacaggcgcctgccaccacacctggctaaatttttgtatttttagtagagacggggtttcaccatgttagccaggatggtctcgatctcctgacctcgtgatccgcccacctcggcctcccaaagtgctgggataacaggcatgagccaccacgcccggccgattttatttttctccagctaacttctctctgctgaactctgtcagattatccttaacatgagctggagcagagtccagagttttatggtcagttataactgagcctggttcaaaactggctcatctctgttggaactcccaccttccccatcggaggcccgaccggtgcttgggtgagggaagtggggaggggtagtgtctcttctctcatgcctctgcccactccagagccttgggtcttcctgtctggggttggaggcagggcttcctgtgggtggtggaaggtgactctactctgaccctcctctatcagggtttgcttccctggctgatgtggtggtttccatgtagatggtggggcaggtgtccttgggacagagttcagctcatgccagcaccatccatcactgaatatcccctctgagagaagctggggctctcttcagccccatgagtggtgcactcctccagccctctttctgagtgcggcattgtgtctcctggactgtcctgggattccggcgcatcctctgacctccacatctccatgtggctccacaggaggggctgtgaaatgggggtgcagaggcccacactctttttttcctgagcagtctaccctgtgccatccatactctgctgctggtgtggggtcttccacaagccctccaccttctgagatctctaggggcacgtgggcaacgtgctccatgctcacatctattcccaagctcccggtgtcctgagttaggctcacgggagcactccctccctagattttgttcctctcccacggcagccacagagtggggctgcagatcctgcaggtcggcaggcacccggctcgggagggaaacaccagcttccatctttcgggcacccccatttcttttttttgtggtaaggaagattggggactctttttatatttaatttttgaataaataatatatttacatgattcaaaaaccaaaagaatatgaaaaggcaaatattatctttttttattatactttaagttctgggatacatatgcagtacgtgcaagtttgttacataggtatacatgtgccatggtggtttgctgcacccatcaacctgtcatctacattaggtatttctgctaatgatatccctcccctatcccctaccttccgacaggccccggtgtgtgatgttcccctccctggggcacccccatttctatgagggattctcttggagctcctctcatcacaatgacggctctctacgtgaccacttcccccaccatcctcttctttctcttccctccccagtctttcctatagatggtgtgtgttggtggtttggggtggagcctggtgttagaggggctggttgtgtttctttttgatgaagaccttggggacatgtctgctgctggtgggtctctttagatgtgtgatagtgagcacgtctttgcccttagttttgtttccagtgtcttggggcaacagtaaaaaaaaaaaaaaaaaaaaaaaaaaatcccatttgagatcctgttgcacacatttagactgagagtttgtttaggactagaaaaattttagaaacatcatgagggtcttcctgcttttccccttcactcctatccctaagtcacctcccaacccaaattgctcccatgcctctaattatcccctctgtgcaggagacccccaagcctcctccaccagccctgagctttctctgcaggagtcctcttagctatcccaccactttcagtctgctcagacccaccctcatcatctttccttcccttccgtctcccacaatccaggccagtgttttctctacagtaagaatttgccccacaagcattcaattgagcagctactgtacaccaagtcctgtgataggtgctggggatacagggacaaccaaaaatggttgttgccctcaaagaactcttggcatagtggtagccattgacccaagaagaggtcctcagtatgaaatgggaagagctaaggtaagcacaaggcatgaatatgccacctttcctgggcacacaggaatggcttccgggagggatgatctctgggctcagtcttgaattgcaataagtagcaaagtaagaaataggaaggcattgcagggaaaggaaacagcaagaacaaaggcgtggaggcatggactagcatgtgctgagaacttggagcagttccatgttcctggggtctaaagtgcagggtggggagtgggaaaagataagctggtttcctgactctgttcctagcacctccctcctttcaatcatccatgggcaagttgtggtcgactcctctgcagtaaaccttcacccctgctgttcaccccaccacagagttaaagatggggtggggtggctgaccacatggtatcttctcacttggatgccatgttgccagtaggtgaggatggtgaagtctcccctgtgggaggtggcctggagggaccatttggggtaagacagctaccccaaggccagcccctctgccctcaccctgatccttcctctaggctccgcttttggtctgaattcttaatctcctcgatctttgacttccctttgctttcttaatccttgagtttgctgcagaatttggcccacagatttcatctggtcccttgaataggcagttcagttggatccatctccgttggcattgacattttacacatggcaggatggttttcaggaaaaggacctgtgttgtgtggaccctgaggtatctttatgagttcctgcctggccagctccccaaaactcctggccactactcaactgtcctagagaattgggatcccctaggtgaggtcagttggtagccttcttccttggtgtgtgtgggttgagagagattggcagggagccagtgtcccagctgagaatctgttcctgggctcagaagaagcggagtgtctctgcctagtgaccccgggacattcacagatacgtgatccgtggtgggtgtgctccatcccagtttgatgggatccctggtccaaagcacgtacctaggctcctggctcttccaggcaactggcgagaactcacagaatgcattttctttttttttgagacagggtcttgctctgtctcccaggctggagtgtggtagtgtgatcatggcttgctgcagccttgacctccccagctcaagtgatcctcccacctcagactcctgagtagctgggactacaggcatgtaccactataccgggctaatttttttattttttggcagaaacagggttttgccatgttgcccaggctggtcttgaactcctgagctcaagcaatccacccgcctctgcctcccaaagtgctgggactacaggtgtgagccacagttcccggcctaaatgcattttcttttccttttttttttttgttgagatagagtatcgctctgtcgcccaggctggagtgcagtggcacgatctcggctcactgcacactctgcctcctgggttcatgccattctcctgcctcagcctcctgagtagctgggactacaggtgcctgccaccacatctggctaatttttttttttggtgggttttttttttattatactttaagttttagggtatatgtgcacaacatgcaggttagttacatatgtatacatgtgtcatgttggtgtgctgcacccattaactcgtcatttagcattaggtatatctcctaatgctatccctcccccctccccccaccccacaacaggccctggtgtgtgatgttccccttcctgtgtccatgtgttctcattgttcaattcccatctatgagtgagaacatgcggtgtttggttttttgtccttgtgatagtttgctgagagtgatggtttccagcttcatccatgtccctacaaaggacatgaactcatcattttttatggttgcatagtattccatggtatatatgtgccacattttcttaatctagtctatcattgttggacatttggcttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactgcacatgcggctaattttttgtatttttattttttatttttttttagtagagacgtggtttcactgtgttagccaggatggtcttgatctcctgaccttgtgatctgcccacctcggcctcccaaagtgctgggattacaggtgtaagccaccgcgtccggcccctaaatgcattttcttgataactagagccaagcaattctggaggggaacatgctataaggaaaccgttcattgatttcttcattctttcactctggcagaggctgcactgggaattggaggatagcagaatgaagaagatacagctccttttctcaaggggtttgtggtttagtgggagctgtgagcaggctctgtgatgtgtgtgtttaatggcagtgggcagcacagccagccacctgcagagggggaggggtgcttcttaattcctggatgcttttaatctgcgtgtggtggcaggcccacctacaggaacaaactgcagtgcatcagactatggggtatagttctgggacatattgtgtgatacagagagggtgaggtgccccccaggagaggaaggctctgaactgtgtccatcaagagtggctctggggttggcagaagtgatctgttgtttcactgggcagaggcagccctcctggctttctgagatctaagagtcaggtcgtgctaataatcctggacctattccaggggcccctcccaccacccagtgacaaaaggaagcagctccaaggcttgggacttccttatggccctgaagctaggaaagggagtgcccaggacaggaacaactggtacacccgagcggggctccctcctggtgtctctgcaaaggggagtcatatcatcccagtgagaggcgggaagggcaggcgggagtcagatgctttttctgtgagttgggattgcagttctgcctcccccagagtgtttgttatgagcaaacacataatttgtgaaagtgttgggaaaagatcagctcctgtgaaaaaataaaacactattcacacttctacctgattttttctcattctggtggaattccccccaccacaaatgagtttcttaaaaccaaacaacaaaccaaccagctcacccccacccaccccatcacaacacatttatttagtgcctacttgttgttggttacttacaatgaaagaaaggcaggcagatggataacctagttcaatattttacgtgagatgcattattttactaagtcctttccaaaccatacccatcagatcctatctccatgggagtggagaaatttgagcaacagagaggttaggaaattttcctgaggtcacagggttaggcagtagcagagccggaatttaaaccccagtcttctgtctccaaatgacctgcttggctaatgctagattggccttgaaaggttatatttttatttggttgaggagactctttcagttccaggcgaccaaaacaaacaattctttatgccatggctgggctgaaaattcctcagtgaagggcagtggctctgggaatattttacacatctcttctcatcttcaaaggcagctgagccgtggtgtcctgggttctgtggtggcctcatctgcagactcccacaagaatttggggaaatctttgcaggcatgtgggggttggccccttgggaagaacattcagacagtgtggagtcatagctggtacccagggcccagaagatgccccactgctccttcgggatgccccacgggaagtgccgttccattgttgtgggcggaattttgtggaacacaaccccttggagccagctcaggcacgagggttgcatgtgggggggcccgggcagggcatggttattggagtgggacagggatggatctctagatggaaagtgaggccagcggctggtgggaactggatcttggaagccccagagagggagcagctgctctctcttgggctgcgtggcttagctctttgcctatttctgagcctctgccccattttccaatttgagccaggcttcccctgcttgctttgacttctctgctctgtgtgccccctccagcttcagtttgcaggtagcttggttttctagagggcctcttgtggctgtgaccacacacaaccctaaatgccatcaccatcttacctacattatgttttttctttctacattttgtaattttaaactagatgaagaattccataaaacatgcaaaaaaagcaaggatgtgcccagtgctgaaagcctgggcctggagtgagagtgtggaggcaggaggtagcagtggctcccgggttagcgctgaggagctgcatttaggttaatggggactgggccagggcaggggtgggcctaatggtgacattggcagttgtctggagcagccctgggaacctagctctgtggaaggcagggcaggggtggtgtccccaggggaagggtggtatcaacccacagacacactcaaggctcagaatcattggaagggggtgggtggatgctggtcagtgggtgcccaggctggacaagtgagtgcccctccagacacaggcattgggagactcagcatgtgttcccctccccatcacagagcaaggcaatgtttaaaaactagaatagatgcctaggaagcgggtactgtggccattccaggcacctagaacaagggcaggcttcaaacagggagccctgtggtaacccctcccatctctggagctgagggaggggacaggggaagccaagaacagagacaggaaaaggggaaaagtggccagggggacagacagaaggaggatggtcttcttgaccccatcaccctcagggctgggggcacagagttggcccatcctgccagcctcaccacccctcagaagaggccacagttcttctggctatgattttttattttgagacagggtcttgctctgtcatccaggctggagtgcagtggtgtgatcatagctcgctgcagcctctaactcctgggctcaagcgatcctcctgcctcaggatcctagtcccgagtagctgggactacaggtgcatgccactgtgcctggcttttttttcttttttggtagagatggggttgcactctgttgtccaggctaattttgaactcctggcttcaagatatcctcctgcctcggcctctcacagtgttggaataataggcataagccaccacacccagcccttctggctgttcttgatggtgatgtcagtcgtgctctgcacattctgtttttcatgtcggtgacagcataggtgacttgtgcatggatctccctggtgttcttgcgctattcaggccctctcacttactctgatgtagctggcagcctcgtcagacttgctgacccctgtgtacttgtggaagcagatggtgggggctgcgtgtgatcttctcctcacctaggtccttcttcttgatgaagaggatgacagacgtttccatgaccacttgacatagatgctgccaaacagcttcatgttctggtgtgtgtgattcagcttgtcctcagctcaggccacagatgctcaagcctgcacagaagatggtggctgtgatgccctcaaagcagtgggtccactgctgcccagactgctgactgccacatcagccatcttgaagagagtaggtccctggaggtgaagggcgtctttaagcagctctgcagctccaccttctgtgtgggggcatggtcactctgtgtcctgtggctccaggtcgttcaggtggaaggcggctaaactgtggagctggtgtcctgtgggtaaccaaagcaggatgaaacaggcatcccatggagcaaatccaatgggcagcccagagattccggatgacgctggacagcttcagtttgcaggtggcatctggacaggtcctcagggagtgcaccctggcccacaactgtgtaagacattgcaaactgttgcctggcatcatccgtatggaaggggttggcaaagtcagtctgtaggttgcctgtggccttgacgatggccatgatggcctggagggtgtggctgtagatgactgccctgcacagccaaccttcctcctctgagtaaccatcctcttggatgatctgctttgaggtccttagggcaggtatctatctctagtctaatcaagggagagcgtgtggtacaaccatggcttcctacttcctagagctgcacctaagacaaagatgctttaacacatctgcctggaccaggggctagctgaggacatttgcttcactccagaccatcagcgggagggcagaacctggagcatggcttcccgggctcagtgtctcgtgctctgatcttttcagagtgggcagctgcctctgaaggctctgagccgggagactgtgcttttggggaggaccacgaaacagccattggctggtgggtttccatttgaagtcaagtcattgggagcccatgaagaagacagagtgctgtgggagacccacgtccacaaactcaggagtctaataataccctgctctgagcatctcccacatgccaggcactgtgctcaacattttacgcagggaatctcctttcattctcataagcctgccagtagaaaaggacctgattactgcctttacccaaatggagtcacatccattcgttcatcaagtacttactgagtgcttcctgggtaccacggctgtactgggatatgatggtgtacaacggataatgctactacaagctaactgtggaccagagaccatgccaactaagggttttacatatatgtatcctccccgccttttttttttttgagacggaatttcgttcttgttgcccaggctggagtgcgatggcgcaatctcggctcactgcaacctctgcctcccaggttcaagtgattctcctgccttagcctgccaagtagctgggattacaggcacccgccaacacgcccagctaatttttgtacttttttaatagaacggggtttcaccatgttggccaggctggtctcaacctcctgacctcaggagatccacccgctctggcctcccaaagtgctgggattacaggcgtgagccatggcgtccagcccgtatccattttagttcttagaacaaccctatgaaagaatttccattaaaaaagtcatatccccatttaattaaagagacttcccttttaaacccattttacaaataagaaaactgaagtccagggaggttaagttccttacagaaggtcacacagctagtaagtgtaacaatgtgaattggagcccaggcctgatggcctcttatcacgcaatacaaaaattctgggcaaagatgaatctctgctggccaaggggcagcctggggaagaatgttgtcatggccttggcctaagctggttactgtgtgtgttgaagtggggatggggagcggggttcttgcgtgtgcccctcccaccttcctccttaatttctgcctcctgtcctcgattctgctcctcctgcccggtgctccccatcttggggtcacagggatgcttggcctccacactgtggcactgtttgtgtctgggagctctgcaggcccagctggctgagcagggccatgtttgtcagagctgcccctgccagccatgtcccctgtgcccctgtggactctcctgatgttggaatcatgtctttactgaataacaaactgtgtgtgtgtgtgtgtgtgtgtgtgtgtgtgtgtgtgtgtgtatgtgtgtgtgagagagagagagttagacaaaaggaggccttggcattaggccttttaatgagcaaagtgacaaggtgactgtccttaattggctatcacaacagccaaccaggtcctgctccctccatacaggcctcctgcctccttgaagtggcagccaccactcgatgctcggaaggctggggagcaagcagcagcttttctctcactctctggatccgagacagcttctccccagcaggcaccaactggcttggctggctttctggaacctgggtgacagccttctcccctctgcctggttgccttcattgcctagagagggagcttttggctgttcgtttgaagctcccaggtcattatgataaacttcttgtgttagagctactgcagaagccaccactgagagtatgtggtgaagaggccagtcctattttggagaagttgggagaatgagagaagaccttgggttcctgttgcttcaggatttccattttagctgatgagagaaaacacttaccaatgtcagagccctaacctggcaagaggtggctttgatgtcatggaaagagcactaatgtggcagtcaagggacttggagccaagttctactaagatagtaagtagctgctaatagtatatagtgcttactatgggtgagcactcttctaaacaccttacatattttaattcacaacaaccctgtgaaataggaacattacttcctctattttatagttgatggaattgaagcacagagagggtggtgactggctcaaggtcacagagccattagaggcagagcagacagtcacgagccacttccctgcactcgaggccactgtgttgccactgtcctgctgccagaggcagggccgtgggcctcatgaccacaggggtagctggtcgcctggcccacctgcctgttccacccactgcagctaggctatggatgtgactgtccaaagagtgtgaggcagcaagggatggagcttcttttcccagggacaaaaggaactgcacggagggtgtcagcacaaagctgccctagccagcctttcctagttgatcacaccagtcattaatccacatgcagaacgcagtttgggtccgggctccaggctccacagtcattgccatgttttcacgggcctgataaatgattctgctataaagacttgaagggcaactgtgcaaagtggttctgagcaagattctttaagacctttgtacacattcccattgagtctgaggtcaccttgggaccaggggaaggagaagctggcagtgttgggaagccagaggtctttggtctggagtcacaggaagcctgtaaggtcttgttcccaaaagtcagaggagcagggccttggagagcatttagtccatgtttttcacagtatatgagaggaggcttgggtccagacagaagaaggcagtagctcaaggttgaccaggattagtcttgttctggggctcttaagactgcctggccttttggaaccctgttacaacacattgcatcacatgcattatctcattttaatctccacaccaacccaaggaggtgggtgttattaaggccattttacagatgaggaaatcaaggcccaagtggcagaactgggatttggccccagatacttccatattatttcatgagcttccctttaatattaagaccatctttatatcttccagagcaccttctcttccatgtatagtttgtttgtctggtggccataattcctgagccagcaattcctgactggatggtcagtctaacctcagataggcgaggttcaaatccaactccaccatttagtaagtctgacgtggagcaagtcatgcaattgttgaaaccttagtttctactttgtaaattagggataataatgcctaattacaggacattttttaaggatgaaatgatacagtccttggaagacacttattatattaacaaggatgtaagtggtagctctaattttttattattattgataaggagtgccagtatttgatactgagtcttaccctgaaaacctggaattatgtttgttgcaacttagtgcagtctgattaatgcaataatttttggctgagatctaaagaaggcatggctattattataatcttaataggttttatttttattttttatttttatttccataggtttttgggaaacaggtggtgtttggtttcatgaataagttctttagttgttaccataataggttcattgcccgatgcacacagcaagtcaacatgccaagacatgggagacacgggttgcagcagataaagagatttgatcatagggtcaaggaatcaagatatgggaggggacctcaaatccatctcctcaaggaagttggggtaggagttttaagggttttggagtggaccaaagtgtggaggtggaagagtgaaaggtgaagtcactgggcaggtagaagcagcagctgtattctcatgctaatccccttcctctctcagggtcttcaaactggttgctggaattggggcctgaaaaacatcttaagtgatccttcaacaaaagccttatgattctaatgatagagatcctgtatgtgggaacaatggggatgcaagtcaattctttttttttttgagatggagtcttgctctgttgcccaggctggagggcagtggcttgatcttgtctgactgcaacctctgcctctgggttcaagagattctcctgcctcagcctcctgagtagctgggattacaggtgtgcaccaccacacccagctaatttttgtatttttagtagagacggggtttcaccgtgatggccaggctggtctcgaactcctgatctcaggtgatctgcctgccttggcctcccaaagtgctgggattataggtatgagccaccgcgcctggctgcaagtcaattcttaaacagtcttatgatcctaatgtcagaaatctcgtctacaggaacaaggggatacaattggtcaggatctagtgctgcatgactttcagcaacaaggaagtgagccaaagtgcagcctgattaatgcttaattctaagtatatttctgtccagaactcagcatgcaattcttgtcaactctataggaatggtttcattatcatttcatttattaaggtctgtggttgaataatggctccccaaaatatcctagtcttagttctggaccctgtgaatatgttaacttacgtggcaaaagggatttgcagatgtggttcaactgagaatcttgagatggagaaattgtggtagattatctgggtgggcccaatataaccacaaaggtccttataagaaggaggcaggagggtctgagttggagaagataggatgatggaagcaaaggtcagacacagagaaagatgaggatagtttgttgctggctttgaagatggaagagggggccatgagccaaggaatataggcagcctctagaagctgggagcagcttctcctctagagcttctgtgaggagtgcacccttgcccacttattttggacttctgacctccagaactgtaaggtcataattttttttttttttttttttttgagacgagtcttgccctgtcgcccaggctggagtgcagtggtgtgatctcagctcacttcaacctctgcctcccgggttcaaacgattctcctgcctcagactcctgagtagttgggcctacaggtgcatgccaccacgcccagctaatttttgtatttttactagagatggggttttaacatgttggccaggctggtctcgaactcctgacctcgtgatccgccctttttggcttcccaaagtgctgggattacaggcgtgagccactgcacctggctaaatttgtttttttttttttttaagccactaaatttgtagtaatttgttactaaagcagtaggaaattaatacaagatccttatttaatactttctactcaaattgcccaggctttttttttttttttttgagacagagtcttgctctgtcgtccaggctggagtgcagtggtccaatcttagctcactgcaacctctgcctcccgggttcaagcgattcttgtgcctcagcctccccagtagctgggattacaggcacgcacccccacacctggctaattttttttttttttttttagtatttattgatcatttattgtttctcgcggagggggatttggcagggtcataggacaatagtggagggaaggtcagcagacaaacaagtgaacaagggtctctggttttcctaggcagaggaccctgcggccctccgcagtgtttgtgtccctgggtacttgagattagggagtggtgatgactcttaatgagcatgctgccttcaagcatctgtttaacaaagcatatcttgcaccgcccttactccattcaaccctgagtggacacagcacatgtttcagagagcacggggttgggggtaagtttatagattaacagcatcccaaggcagaagaatttttcttagtgcagaacaaaatggaatctcctatgtctatttctttctacacagacacagcaacaatctgacttctctatcctttcgccacatttcccccttttctattcgacaaaaccgccatcgtcatcatggcccgttctcaatgagctgttgggtacacctcccagatggggtggcggccgggcagaggggctcctcacttcccagaaggggcggccgggcagaggcgccccccacctcctggacggggcggctggccgggcgggggctgccccccacctcccggatggggcggctgctgggtggagaggctcctcacttcccagacggggcggctgccgggcggaggggttcctcacttctcagacggggcagccgggcagagacgctcctcacctcccagacggggtcgcggctgggcagaggcgctccccacatctcagacgatgggtggccgggcagagacgctcctcacttcctagacgggatggcggccgggaagaggcactcctcacttcccagactgggcagccgggcagaggggctcctcacatcccagacgatgggcggccaggcagagacgctcctcactttccagacggggtggcggccgggcagaggctgcaatctcggtactttgggaggccaaggcaggcggctgggaggtggaggttgtagggagccaagatcacgccactgcactccagcctgggcaacattgagcactgagtgaaggagactccgtctgcaatcccggcacctcgggaggccgaggctggcagatcactcgcggttaggagtggagaccagtccggccaacacagcgaaaccccaaaaaatacgaaagaccagtcaggcgtggcggtgcgcgcctgcaatcccaggcagtcggcaggctgaggcaggagaatcaggcagggaggttgcagtgagccgagatggcggcagaacagtccagcttccgctgggcatcagagggagaccgtggagagagagggagaggggagaggggagaggggagggggagggggagagggagagggagaggttttttgtatttttagtagagacagggtttcgccatgtttgccaggctggtctcgaactcctgacctcaagtgatctgcccaactcaacctcccaacatgttgggattacaggcgtgagccaccatgcctggcctgcacaggcatttaatagcgactctgctattaggccaggtgctgctgggcactttcacctcaatgtgtttctctaagcattgtgatgagtggatgcagaatgggctttttttgttgttgttagagatgggggtctctctctgtcacccaggctggagtgcagtagcaggatcacggctcactacagccctgcagccttgaactcctgggctcaaagtatcctcccatctcagcctcctgaatagctggaactataggtgtgcaccaccacacccacctaatttttaaattttgtgtagagatgggatctcacatatattacctaggctggtctcgaaatcctggacctcaagctatcctcccactttggcctcccaaaatgttgggattacagtcatgagccaccgcacctggcctgagtgggctttgatgtagaagatcttagcaggaatcccagctccactctcatttgtggtgtgatcttgggccaggcacctgatctctctgagcctcagtttccttatctacaaagtagagagtataacagtaaaagtacttgacgtggtgggcttggcacttggcagattctaacccaatccatcttgctgcctccttctcccaggcttggatgcatctggagattctcttccctaggatagcccctttgactctggggggtaatgttgagtgtttcctgtcttaggggtcccctcagggacagaatcaggactaggcagtacaaagagctcacattcagccagggctttcctgaggttgaaccagctccttgatacctaccctgttttgggggacccagatgttataactctcctcacctggggccggtctcacttgggcatggatgggacattcagctcagggctcacattatcaaagacttcagatatggacttttgaggtcattgccccatgaggttatacttgcagccccagagctggctggtgggcctgaaagaagatgtatgtgttggggttttgaactcatacctcagtcctgcccctcattaccagccatgctcttgacttcgacttcatacttgtcaggaatacaggatttatttttatgatcagcaaaatcacattgcattgcactttattttgggttggtgggttaaaacaatatattggtaaatgcacacattgaaaattcttcacttttttttggtttgcattctggctttggcagttcttcatttttcactctactctgagcttctggaaggggaagtagcctgagttgatcttaatcacatgaaagctttgcccctaaccttcctttttatctgggtctcctgtatttgaatagaggcttttccctgttgaagccccgtcccgttcattacctcctgcaatgctctcaacagatctctgagtgaggtattattattctgctctgattcaaccaggatgcatgggcgagcaggttattgccaccatccactccaattggtcagggcccgtgctgtactgatggttacctatttaaatagtaaacctgattatccccattttacagatgagacaactcagataggggaagaatgtgtgtgaagccaggcagctgaaaccagggcctctaactctgagaacctgtgagcttttccctctgtccaagctccccctctttatggaaggtttagtcacactggctttaaagaccccattacaatatctcagtttcttttctttttaccacctcggaagtggctgtaaaaatattaaaaccaattgccatcatctttcagactgctgcatttataagatgtagctttcaaatgaatggaaataatcgaaactccctccctgttccattctgtggggccatttcagatttatacaatatttctgaaagctcttataatagagcatatgcacttagggcattaatgaagtcggctcagtgcttgctggtctcatttcatggagctaattgttaagtgttttgcatacttacaattgaactaaattattccaagctagctggtttcaggaagtgttaattatatttcagtaaaggaaaatcaaggctaaaaaatcatccacttagagcttatctatttatgaacatctcattctggagatctcaaacatatattttaacgccatgtgaatattgagattaatatttcttaaccaaagaaacctttattccttccttgaatagggaccctcatcccatccttccacttttatttagcagtctagtctggaagttgaaagaaaccttcctttgtatttctggcaccttgaatctttaagttggatgccaagaacagcattagctccattcatctggagagcaactggccttctgtaactgatattaagtaattaatttatgggtcctgcacaggccatttaggaccaagtgctcccttgcttctggggtttgaggaaatcactgggacagttttcacctgggacttagcttggaggggctgagtggtgaagggttgtcactcaggtcttagttcaggggcaggtgtgggggtggggagtgggtgggagtgggatgtgaggtcccagttggggaggggagtctgtaacacctgcattgtcctctcccacccttctcttcctcctttttggatcagcagggctgaatgaatgcctgaatgaagtgctccgagctttttttgtatctgatgctcaatttctctgccacttgttttgaactttctgtttattcaccatgcatgcattcattcgctcactgagcgcacacatatgaagctaaggaaggcccatcactcgagagcactgggccagggcctgctagggagagctgagactggcagagcccccaccttccgaaactctcacaatacatcaacggacctgggcatcagcaccagtgcagggcctgttcaaacacagagtgctgggccccaacccagagttctgatgcactggggctggggagggctgctaattggcatagctaacaggttcccagggacactggtgctcaagtgtagtgatcaccctctgagaaccactgcaggagactggttacatcctgagaccatcttgatttgcttatttatttatttagaggcagagtctcgctctgttgcccaggctggagtgcagccttatgatcttggctcactgcaacctctgcctcccagatttaagcaattctcctgcctcagcctcccaagtagctgggattacaggcatgcgccaccacaccctgctaatttttgtatttttagtagagacgggctttcaccatgttggccaggctggtcttgaactcctgacctcaggggatccacccgccttggcctcccaaagcgctcagcttacaggtgtgagccaccgtgctcggcctgcatctgaatttatatacatcactgtcacagagccctttttggttggcgttgatgagaggggcatttgttttttaacaaataaagattttttcattaaaaaatcactttacctcatatataatgactagagaataaccaatatgtgttaagatgtggatgctggtggttagttgggctcaggtgtctgctgcacaactccccctgcatgccagccttcccacctgagattcaaacccacgtctctgcaaaatgacaaactactccttttcagaggcctgcagggatgcttgggtatctttgggaccttggatagaattaatatatatattttttgagatggagtctcactctgttgcccaggctggaatgcagtggtgcaatcttagctcactgcaacctctgcctctcgggtccaagcgattctcctgcctcagcctctggagtagctgggattacagacgcccgccaccacacccagctaatgtttgtatttattttagtagagatggggtttcattgcgttggccaggttggtctcaaactcctgaccttatgatctgcccacctcagcttcccaaagtgctgggattacaagtgtgagccaccgcgcctggctggaattaatatttaagagtagtgatatgaatgtgatctcagtgttaagtcttcacaggtccaggtctgcccaaagcttatacaggcctgagcttggtccctgggcactaagcgaggcatgccccacaggcagagaggagaaggggatcaggaaaggtcacaggggttggtgagttgacagttcacttggggtcttgaaggatgaatcattttctagcactggagcgatggtgggatgagggacattttgagcagagggaacagtctttgtaggcatggaggtgagaaagggcaggactggttcaaagaacagagagaagggtgcagacgttgctttgtatgtctgcgtgctggggggcaggaggaagaatggcaggagatgaagctgtattacaaaaaccttgagcgtgaggctgaaaaattagactttattctgaagtaaaggtgatagaggatcacttgacattttataggagtgaggagtgactcaaaaactgctattgagtggggctggggctacagaagaagtctggcagtgctgggagccaaatgggaggtaaaacgaatgaaagagaaataaaaaaattagttcttcagtagtagcagccacatcccaaaggctctatggtcacatgcaggccgtggctaccactggacagtgcaactgcagaacttccccatccttgcagaaagttgtgcaagacagtgctggtctagaaggggcccatggtgtctgcatgggcatatccccttggattcacagattcctcacctcggggagagaggggtgtggccacaggaggaccagagtggaacactctaaaagtggagggcatgcttgttgcccaaggtcaaggacagttggcaggtggtgctgagttggaaggtcattagactcagggcctggggctgccatgtttgggtggctgggaaggctgagtgcagggagatgagaagcctgtctgtgtagagagcgggagcaaggcaacagacctgcatccctgcatgtgacagaagcagagagaatggggccctgatggacttccattcccgtgacacctgggtatcttcaaattaatgctgcccccacttttacccaagatagtttgagtgggtttttgtttcttgcaaccccaatgatgaggagtggttgactccccgtcacccagcccaggacggggcacacaccagtgttccaccaaagctcgttgagctgtcaagtgaacgtgggacaagcagagggagggagaaggctgggggctgcccctttttcctcctcccaccccctcgaatgcagatggagatactggggacgggaacctgaaagatgttcccttttcccttcacctttggcacctggaatgtggttcccctccatcccaagctacacgtgtgcattggtggtgctgtctgtgatgtcttccctcacatcaccaagggctcacgtcaattcaggtggcagtttagaaccaattaaaatgtataagccacaggtagtgagtgaaatcccaaggattaatttgctcagtggagtgttaatctgtgtaatgtcataggcgcttcttcaaacaatgcggcaagatggagccgggaggttcttccccacccctgttttcctgtaaatgccctagttggtccccctgggctgggtgggtgtggcttcatctcctctgagcgctgggaagggctgagttagctttttgggcccccacccgagcctcctagaacccagtcctcctccttgctactgggcagggccgccaaccacactggcagagataggccctctcctctctgtccagccttcctttgctctgtgcttcctttctgcattgcccctggggcaaggtacgggaaggcacagtaatgggcagatccaacctgcccccaggacttgcttcccagggctttgtaattagaatccttcccaattagcaggtagagtggatcagcatccaagttaataacatggcgatgcccacctgtccagccagtccccctgcctccaagacagcccaaagagcaggagagaggacttactaatgatgagctgcatgtccaatcacagccccatggctggctggttgtgagcctgtccactgagtcttggtgctgggattcaggagacctgtgttctaattaaattccttcccccaccagagcttagctcaagaaaaccttgtctcaagggagctcggttttcacctggagaatctaaacgtcagtgtgtgcaagtcagagcactcactttgcagccagtgacactggaccctggcttatgtggcttgtctggagagctaggcagtggccaacagtgggagccatttaatagaatggctaagaattatcgctttggagccagacagacctagattcaagtcctttctctgaacgtagtagctgatgcccttaagcacattttaaaacttctctgagcttgtttcttattactagaatggcgatcaaaatacctacattgcagagttgcatgacgtatatgaagtggtagcacagtacttgcaaatagccatcccttaacaagcggtggcttgtattattgtcgttaatagtaatgataacaaaagtatccttaaatgtcctgagccccagccttcatgctgtctggtccctatcaacctcccctgccaataaaaaagacctgttctgtctaccttacctgtgggctctgacaatgaggtgggacaatggataggatagctttgaaaaggatataattgaccaggcgtggtagctcacacctgcaatcctagcagtttgggaggccaaggccaaagcagatcacttgaggtcaggagtttgacaccagcctggtcaacaaggtgagaccccgactctactaaaaatactaaaattagccagaaatcgcttgaacctgggaggcagagttgcagtgagccaagatcgtgcactccagcctgggcaacatagcgagaatccgtctcaaaaaaaaaaaaggtataattgatatttaagcataaataattattattaccatttagctttaaatggaaggccccagaattctctggggatggctcactcactctgatgacatggggaaggaagttcaggacagaatttcctcttggcttcagaagactctgcattggggtgagcattgttaattcaacttcattattgccagcaacagaaattgatctagctgatttaagtagtaaagaaatttgttgaaagagaatatgatcatttggagcattagtgggaaaactggggaaccaggatgagggtggctgggcactaagaccccagtctaaactgtgctgtagggaaaacttagcatgcagcttatgttctttatggacgtgtacctggaccacaccctggtgccctgtgaacataggtgctgcctaaaccgttgagattcattctctcctgactctgtctgtctaagtcacctgtaagtcctgggtatctgtttggctcttccttggtgatatgctagagtctagttgtatagaggagcagggaaattttaaacaagtgttagacctgtactgttttctgtattaggaggaggactctgctccctgaagacccaggtggtaggagagctgcaggggcttcctattcaccgcacctttctttcttgcattccttccagggaggattatgttgacccctttctgcccatgagaaaatggaggcgcctttcttcccagacctgcctaagatcaaatcgctggtaagtggctgagccaagatgatagaactcagtttgctggctccagatcctgtccaatgcaaatggtggaaagaggttgttggttgctaatgacctgaacaggggatgggcggcaccctcttatggcccagagagctttccttgccttgcccgagctgcaagagctcagggtcccagattcaagatctggattagttagagctggcaattctcaggcagtcgctgaccttgcagaacttccttgggctggtgccactgctacttccttgcagggaggaggaagatgcttctggagtgctggaggaggttctgccatgacctggtcccattttcctcttctgattaccaagtgccaatgaggtcagacaactgatcaaagtgaacatctctgcctattgaaatccccctcttccttcagatccaggtcaaatgcccctctctgtgaaggtttcctgatcagccccggtgggctggatcttttaattttagtttttaaatttaaaaaaattttaatttttatttattttatatttgtgtaggtttttgggggaacaggtggtgtttgattacattactaagttctttagtggtgatttctgagattttggtgcacccatcaatctttttcttattttttagagaccgggtatagctctgtcgtctaggctggagtgcagtggtgcagtcactcctcactgtaaccttgaactcctgggcttaagtcatcctccctcctcagttttccaagtagctggaactacaggtgcatgtcaccaagctcagctaatttttaaagttcttttatagagatggggactcactgtattgctaggctggtctcgaactccagagattaagtggtctgcctgcctcagcctccaaaagtgctgggattacaagtgtgagccaccatgaccagccatggatctctttattcttgcattgctggagtcccaggcagagtgagatattaatcctttcctcagagttggcagccaggacttggattccttgatattgcccaccccatggcaaattataggtgcacagtaatgttttataaaaacagaaaggtctcctgcttttatgtctcctctccacagatataagtgctttatggtgaggggattcatgtggctagaacagggggtatgtggcagggtagctggaggtgtggcagggtggctggaggctagacagggctcagtgttggggcttgctgaaggaggccctgtattctccaggctgcaaggaggcttgatcctgtgggcagtgggagccatcggaggtgctctgtcaacctgtgctgagaagtgggctctggcagtggtaaggtgagaagcccagggctaaaggtaaagtctggatgaggacaaccaggggtgcttgatgagtctgaattaggcatggggaggccagtgctggaattagcagtcaagaaaaagaagggaaaaaggactgggcatggtggctcatgtctgtaatcccagcactttgggaggccgaggcgggcagatcacttgaggtcaggagttcgagatcagcctggctaacatggtgaaaccctgtctctacttaaatacaaaaattagctgggcatggcggtgcatgcctgtaatccgagctacttggaggctgaggcaggagaatcgcttgaacctgggaggcagaggttgcagtgagcccagatctcgccactgcactccagcctgggtgacagaaagagactctgtctcaaaaacaaacaaacaaacaaaacaaaaacataaaaaagaagggaaaaggggaaacataaaaaagaaggggagactcacattgcccggtggcctctgatgggctgggcagtgtgtaatacagtgaaaaggggttcaggagaattctcaaaaccccaggggcacacccttttcaaaaggaggggcaatagcaactctatagactacagaggaggctagtctgtggagggctgaagataggtggctggaatgggcagcgaggaggcccatggcagcccggtgtgatggttttctagggcatgatggtggcaggattgatgctgctgctcgaaccacacaactagttggaaatgcaaacactgctggacctggcacagcacgactcggcattgctaattagccctgagattattccttgcaaggaagcaactccatcacacctgacttatggctgaactacctgagcaggaggcaggttgagttcgtggctgctggtggacacctttcgccttgattttttttcagaaatgccccaaacaatcacccagctcctacctcctggtcctacctctccagggtgacagttcttaagtcttattagttaacagagggactgatttgcggaacagaaaagtcatgaagagagaatgtggtgtaaatgttaatcgtttttttaacttcgcattatgtgatccgttaacattaatatttaatttaatgcagtcaaaagattaatgcatgtgtttatttctaaaaaaggcaaggatgcttcaggctgcttttcagcttggttgagctttgggaaaaaaagaaaaaaaacatcaccacaacaacccacccagcccagaagaaatgtattcatgccataataatacaagtatcctctctcccacccgctctccctcctcaattcctaaaaataagccacagggttctaatggggaccctgattaaatattcggctctgtaatttatgcccaagtgaatcccaacaggaaccagaggccctggaaatctgttgtgaaataattatcctgaatgacattgtggagatggtctgcgagggtgctgtcaataatgcattagcccaaatctgtttgaaatacagcaaggaaattacacgatattcatgggaacctgaaagaattatcagtaaacaaatttaatcaacttgatgttatgcataccactcaacctcttattatctgatcatctaggtttagaacacgcaggggaattgaatgacgtgggatgcaaggctgaggctgtgtgtgtgtgtgtgtgtgtgtgtgtgtgtgtgtgtgtgtaagcttggtggaattggcctcagatctttgcatttcttctccttagcagcatttcatttgcatttttctctaggcctgattgttggctgccagctttcatcccagcctggcccctgaactcccatttttttcccccagtgtcaaagccatctttagaaaagtcagctgactgcccacccatcctccagatcccttctgtctttcagagaaggagtggctgcctctgcccaatatttcagaagcaaagaggtagggtggagaggaattgagtgctgttatctggagagatgcttctaccatagaagaaagagccctgtaacctcatggtgggagtgaggatctgctgctaatttgttgggtgatcttatttaagtccctttccatctctgggccttagtttttccatctgtaaaatggaacttgggatggatggtctgtgtgattttatgacaccttggtagaagcttggcagcatctcatttgctggattgttctctttgtcctctggaacctgatgggtatccaagaggaaaggagctttctcaagatcttatgggaaggtggaggcagagtcaagatgagagctttcagatccacttctcacaacccctccacccccaaagtcagaacattgcttttcctctgcactaaaagccctgggaagcattttggagtctttattttaaacttagctcttgggtttgctgagaggggacttgggttgtccttcccaggtctacaaatccctttcaatttctagacctcagcttcccactctccacacgacaaaggggttggatgaggcggcctttcagagacctcttatcccagctttgatattctacactgttatctatgttttaaattccttggggaggagccaagatggccgaataggaacagctccggtctacagctcccagcgtgagcgacgcagaagacgggtgatttctgcatttccatctgaggtaccaggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgacggatgcacctggaaaatcgggtcactcccacccgaatactgcgcttttcagaccggcttaaaaaacggcgcaccacgagactatatcccacacctggcttggagggtcctacgcccacggaatctcgctgattgctagcacagcagtctgagatcaaactgcaaggcggcagcgaggctgggggaggggagcccgccattgcccaggcttgcttaggtaaacaaagcagcctggaagctcgagctgggtggagcccaccacagctcaaggaggcctgcctgcctctgtaggctccacctctgggggcagggcacagacaaacaagaagacagcagtaacctctgcagacttaaatgtccctgtctgacagctttgaagagagcagtggttcttccagcacacagctggagatctgagaacgggcagactacctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgctaaaatgtaaagaccatcgagactaggaagaaactgcatcaactaacgagcaaaatcaccagctaacatcataatgacaggatcaaattcacacataacaatattaactttaaatgtaaatggactaaattctccaattaaaagacacagactggcaaattggataaagagtcaagacccatcagtgtgctgtattcaggaaacccatctcacgtggagagacacacataggctgaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcatctctgcaccaagcggacctaatagacatctacagaactctccaccccaaatcaacagaatatacgtttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaacccttcaaaaaatcaatgaatccaggagctggttttttgaaaggatcaacaaaattgatagaccgctagcaagactaataaagaaaaaaagagaggagaatcaaatagacacaataaaaaatgataaaggggatatcaccaccgatcccacagaaatacagactaccatcagagaatactacaaacacctctacgcaaataaactagaaaatctagaagaaatggatacattccttgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcgttctgataccaaagccgggcagagacacaaccaaaaaagagaattttagaccaatatccttgatgaacattgatgcaaatatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcagcagaaggaaataaagggtattcaattaggaaaagaggaagtcaaattgtccctgtttgcagacgacatgattgtttatctagaaaaccccatcatctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatgaattaaagatttaaacgttagacctaaaaccataaaaaccctagaagaaaacctaggcattaccattcaggacataggcgtgggcaaggacttcatgtctaaaacaccaaaagcaatggcaacaaaagccaaaattgacaaatgggatctaattaaactaaagagcttctgcacagcaaaagaaactaccatcacagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttatactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccgtggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtggggggaggggggaggggtggcattgggagatatacctaatgctagatgacgagttagtgggtgcaacgcaccatcatggcacatgtatacatatgtaactaacctgcacaatgtgcacatgtaccctaaaacttaaagtataaaaaaaaaaataaattccttaattggctataggtttgtgctttgaggaagggagtctagtttccatttctacactgaatgctcctttccactttgttgtgaagtgcaagtgtattcttgttgagcacctgctgtggttggcacccaggaccaggcactgtagggtggatatgctcattgagtcctgttttgtgcctggccctgcacctcgtgttgggataacttgatggcacttgggaagttctacttgcagactaagaaagccaattcgctcaacgagttctttcggggcacctaccatatgtctgtccctattcttggcattaggtgggataatagtatttattgaatatggactatgagctaagcactgagctgagcacttcacatgtttaaaagcatagtgaattccccttgcctcagaatggatcatcaggaagtaaaggtagagacaagaggcagaatgcacttgtgtcataaagaatactcaaaacagccaggcgcagtggctcacacctgcaatcccagcactttgggaggctgaggtgggcagatcacaaggtgaggagatcgagaccatcctggctaacacggtgaaatcccatctctactaaaaatacaaaaaattagccgggcatggtggcaggcgcctgtagtcttagctactcaggaggctgaggcaggagaatggcattacccaggaggcagagcttgcagtgagccgagatagcgacactgcactaccgcactccagcctgggtgacagcgagactccatctcaaaaaaaaaaaaaaaagaatactcaaaacaaagaggtgcaggcaaccccccagaagctactgaatgggttcttctacctccagctatcactgaagctcagccctgtgtgaagcccacatagtcccagcctaacagatgaaagtgtatttctggcactgtccaataatggtagccactagcctcaggtggctgttgagcatttgaaatgtgactagtccagactgagaagtgctgtaaatgtaaaatacaaaatggatggtgaagatttatgcaataaaatagtgtgaagttatctcattaataattttttatattgagtacatgttgcaatattttggagataactgagttaaataaaatattgtattaaaattaattcaaccaatagtcatattacttgctttattatgactaaatatgactaaaatttaaaattccatatgtatcttgcattatatttcattggacagtgctggtttagatattcaaagaatttatctcaagagattagggagtccttggaggatggtgattgtggctcctctgatttctcatgggagaggttagaggggagtttgtcctccactccatgtaaagggttctaagagaattactcatagagatgtggaggagctgatgaagattggtgatatggtttggctgtgtccccacccaaatcttatcttgaattgtattttccataatccccacatgacaagtcatgggagggaccaagtggagataattgaatcatgggggcagtttcccccatactgttctcataatagtgagttagttctcatgagatctgctggttttataaagggcttccccttgctggcaagatggccaaataggatcagctctggtcttcagctcccagtgagactgaggcagaaggtgagtgatttctgcatttccaactgaggtaccttgctcatctcattgggactggttggacagtgggtgcagcccaagaagggcaagccaaagcagaatggggtgtcgcctcacctgggaagtgcaaggggttggggcactccctctcccagccaagggaagccattagggactgtatcatgtactccggcccagatactgtgcttttcccatggtcttcgcaacctgcagaccaggagattccctctggtacctacaccaccagggccctgggtttccagcacaaaactgggaggccgtttgggcagacactgagctagccgcaggagtcttttttttcataccccagtggcacttggaacaccagcgagacagaaccatttactcccccggaaagggggctgaagccagggagccaagtggtctggcttggcgggtcccaccccaacggagtccagaaagctaagatccactggcttgaaattcttgctgccagcaaagaagcctgagcttgacctgggatgctggagcttggtggggggaggggcgaccaccattgctgaggcttgagtaggtggttttaccctcacagtgtaaataaaaaccgccaggaagtttgaactgggcggagcccaccgcagctcagcaaggctgctgtggccagactgcctctctagattccctcctctctgggcagggcatctctgaataaaaggcagtagccccagtcagggacttatagataaaacccccacctccctgggacagagcacctgggggaaggggcggttgtgggcgcagcttcagcagacttaaacgtccctgcctggcagctctgaagacagaagcacatctcccagcacagcgttcgagctctgatagggacagactgcctccccaagtgggtccctgacccctgtgtatactgactaggagacacctcccagtaggggccaaaagacacctcatacaggagagctctggctggcatctggcgggtgctcctctgggatgaagtttccaggggaaggaataggcagcaatgtttgctgttctgcagcctccactggtgatacccaggcaaacagggtctggagtggacatccagcaaactccagcagacctgcagcagaggggcctgactgttagaaggaaaactaacaaacagaaaggaatagtatcaacatcaacaaaaaggacatccactcagaaacccagctgaaggtcactgacttcaaagaccaaaggtagataaatccacaaagatggggagaaaccagtgcaaaaaggctgaaaattccaaaaaccagaatgcctcttctcctccaaaggatcagaactcctcaccaacaaggtaacaaaactggatggagaatgagtttgatgaattgacagaagtagactttagaaggtgggtaataacagactcctccaagctaaaggagcatgttctaacccaatgcaaggaagctaagaaccttgaaaaaaggttagaggaattgctaactagagtaaccagtttagagaagataaatgacctgatggagctgaaaaacacagcacgagaacttcttgaagcatacacgagtatcaatagccgaatagatcaagtggaagaaaggatatccgagattgaagatcaactcaatgaaataaagtgagaagacaagattacagaaaaaagagtgaaaagaaatgaacaaagtttccaaaaatatgggactatgtgaaaagaccaaatctacatttgatttgtatacctgaaagtgacggggaaagtgtaaccaagttggagaacactcttcaggatatcactcaggagaacttcctcaacctagcaaggcagggcaacattcaaattcaggaaatatagagaacaccctgaagatactcctcgagaagagcaaccccaagacacataatcatcaaattcaccaaggttgaaatgaaggaaaaaatgttaagggcagacagacagaaaggttgggttacccacaaagggaagcccatcagactaacagcagatctctcggtagaaagatacaagccagaagagattgggggccaatactcaatattctcaaagaaaattttcaacccagaatttcatatctagccaaattatgcttcacaagcaaaggagaaataaaatcctttgcagacaagcaaatgctgagagattttgtcaccaccactcctggcttacaagagttcctgaaggaagcactaaacatggaaaggaacaactggtaccagcaactgcaaaaacataccaaattgtaaagatcattgatgctatgaagaaactgcatcaactaatgggcaaaataactagttagcatcataatggcacgatcaaattcacacatatcaatattaactttaaatgtaaatggactaattgccccaattaaaagacacagactggcaaattggataaagagtcaagaccaattggtgtgctatattcaggagacccatctcatgtgcaaagacactcatagcctcaaaataaagggatggaggaatatctaccaagcaaatggaaagcaaaaaaaaagcagaggttgcaattgtagtctctgataaaacagactttaaaccaacaaagatcaaaagagacaaagaatagcattacataatggtaaagggattaatgcaacaagaagagctaactatcctaaatgtatatgcacccaatacaggagcacccagattcataaagcaagttctttgagatgcacaaagagacttagactcccacacaataataatgggagactttaacaccccactgtcaacatcagatcgacgagacagaaaattaacaaggatatccaggacttgaactcagctttggaccaagcagacctaatagacatctgtagaactcttcacctcagatcaacagaatatacattcttctcagcaccacatcgcactcattctaaaattgaccacataattggaagtaaaacactcctcagcaaatgcaaaagaatggaaatcataagtctctcagaccacattgcaatcaaactagaactcaggattaagaaactcacttaaaactgcacaactacatggaaactgaacaacctgctcctgaatgactactgggtaaataacaaaatgaaggcagaaatacagatgttctttggggatgggtgtagtggctcacgcctgtacttcaggaggctgaggcaggtggatcacgaggtcaggagttcaagaccagcctcgccaagatggtgaaaccccgcctctactaaaaatacaaaaattagccaggtgtggtggcaggtgcctgtaatcccaactacttgggaggctgaggaagataattgcttgaacccaggaggcagaggttgcagtgagcagagatcacaccactgcacatcagcctgggtgacagattgagactttgtctcaaaaaaaaaaaaaaaaaaaattgaaaccagtgagaacaaagacacaatgtaccagaatctctgggacacatttaaagcaatgtgtagagggaaatttatagcactaaatgcccacaagagaaagcaggaaagatctaaaattgacaccctaacatcacgattaaaagaactagagaagcaaatgcaaacaaattcaaaagctagcagaagacaagaaataatcaagatcagagcagaactgaaggagatagaggcatgaaaaacccttcaaaaaaatcaatgaatccaggagctggttttttgaaaagataaaaaaaatagatagaccgctagccagactaataaagaagaaagagagaagaatcaaacagatgcaatacaaaatgataaaggggatatcaccaccaatcccacagaaatacaaactaccatcagagaatactataaacacctctacgcaaatacactagaaaatctataagaaatggataaattcctggacacctacaccctcccaaggccaaaccaggaagaagtcgaatccctgaagagaccaataacaagttctgaaattgaggcagcaattaatagcctagcaaccaaaaaaagtccaggaccagacggattcacagccgaattctaccagaggtacaaataggagttggtaccattccttctgaaactattccaaacaataggaaaggagagaatcctccctaactcattttatgagaccagcatcatcctgataccaaagcctggcagagatacaacaaaaaaagaaactctcaggccaatatccctgatgaacatcgatgcgaaaatcctcaataaaatactggcaaaccaaatccagcagcacatcaaaaagcttatccaccacgatcaagttggcttcatctctgggatgcaaggctggttcaacatgcacaaatcaataaatgtaatccatcacataaacagaaccaatgacaaaaccacatcattatctcaatagatacagaaaaggcctttgataaaattcaacaccccttgatgctaaaaactctcaataaactattgatggaatgtatttcaaagtaataagagctatttatgacaaacccacagccagtatcatactgaatgggcaaaaactggaagcattccctttgaaaactggcacaagacaaggatgccctctctcaccactcctattcaacatagtattggaagttctggccaggcaaccagccaagagaaagaaagaaagggtattaagaaaagaggaagtcaaattgtctctgtttgcagatgacatgattgtatatttagaaaaccccatcatctcagcccaaaatctccttatgctgataagcaacttcagcaaagtctcagaatacaaaatcaatgtgcaaaaatcacaagcggccgggcgcggtggctcacgcctgtaatcccagcactttgggaggccgaggcgggcggatcacgaggtcaggagatcgagaccatcccggctaaagcggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcctgccactgcactccagcctgggcgacagcgcgagactccgtctcaaaaaaaaaaaaaaaaaaaaaaaatcacaagcattcctatacaccaataacagagagccaaatcatgagtgaactctcattcacaattgctacaaagagaataaaatgcctaggaatacaacttacaagggatgtgaaggacctcttcaaagagaactacaaaccactgctcaaggaaataagagagagcacaaacaaatggaaaaacattccatgctcgtggataggaaaaatcaatattgtgaaaatggccatactgcccaaagtaatttatagattcaatgctatccccatcaagctaccattgactttcttcacagaactggaaaaaactactttaaatttcatatggaaccaaaaaagggcccacatagccaagacaatcctaagtagaaagaacaaagctggaggcatcatgctacctgacttcaaactatactacaaagctacagtaaccaaaacagcatggtactggcaccaaaacagatatatagaccaatggaacagaacagaggcctcagaaataagacaccatacatctacaaccatctgatctttgacaaacctgacagaaacgagcaatggggaaaggattccctatttaataaatggcgttgggaaaactggctagccatatgcaggaagctgaaactggatcccttccttacaccttatacaaaaattaactcaagatggattaaagacttaaacataagacctaaaaccataaaaaccctagaagaaaacctaggcaataccattcaggacataggcatgggcaaagacttcataacgaaaatactgaaagcaatggcaacaaaagccaaaattgacaaatgggatctaattatactaaagagcttctgcacagcaaaagaaactatcatcagagtgaagaagcagcctacagaatgggagaaaatttttgcaatctgtccacctgataaagaatctacaaagaacttaaacaaatttacaagaaaaaaaacaaacaaccccataaaaaagtgggcaaaggacatgaacagacacttctcaaaagaagacatttatgcagccaacaaacatatgaaaaaaagctcatcatcactggtcattagagaaatgcaaatcaaaaccacaatgagataccatctcatgccagttggaatggcaatcattaaaaagtcaggaaacaacagatgctggagaggatgtggagaaataggaatgcttttacactgttggtgggggtgttaattagttcaaccattgtggaagatagtgtggtgattccttaaggatctagaactagaaataccatttgacccagcaatcccattactgggtatatacccaaaggattataagtcatgctactataaagacatatgcacacatatgtttattgcagcactgttcacaatagcaaagacttggaaccaacccaaatgcccatcagcgatagactggataaagaaaatatggcacatatacaccatggaatactatgcagccataaaaaaggatgagttcatgtccttttcagggacatggatgaagctggaaatgatcattctcagaaaactaacacaagaacagaaaaccaaacaccgcatgttctcactcataagtaggagttgaacaatgagaacacatggacacagggaggggaacatcacacaacagggcctgttgttgggtggggggctaggggagggatagcattaggagaaatgcctaatgtagatgtcgggttgatgggtgcagcaaaccaccatggcacatgcatacctatgtaacaaacctgcacgttgttgggtatgtgtataccccagaacttaaagtatcataacaaagaaaaaggaaagctaaaaataaaaaataaaaaaaagggctcccctctttcctgggcactcattcttctccttcctgctgccttgtgaagaaggatgtgtttgcttccccttctaccatgactgtaagtttcctgtggcctccccagttctgtggaactgtgagtcaattaaacttcttttctttataaattacccagtcttgggcagttctttatagcaacatgagagtggactaatagaatgggcatcttattttttggcttaacttcttaggcaggggaattgctgatctgctccttgtgcttatttgaagtggggtaaaacataatcagagggtgcagtaagtagggtaattccccccattgggctgggcaaggtggttcatgcctgtaatcccagtgctttgggaggccaaggcgggtaggattgctttcagccaggagtttgagaccaacctgggcaaaatagcaagactttgtctctacaaaagtaaaaattagctgggtgtggtggtgcatacccatagtccccactactcgggaggctgaagcaagaggattgcttgagcccaggaggtcaaggctgcagtgagctatgattgtgccactgcactccagtctgggcggcaccctgtctctaaacaaaacaaaacagaaaaagcccatgcttcccttagccccaaatatgcctatgtagtaatcccagaaacctgtggatatgttaccctacatggcaaaagggaccttgcagatatgattaaggctaaggaccttgagacaggggattatcctggattatccagtagggcctaatctaatcatacatgtccttaaaatctgagaaagtttcttggctgccatcagagataggatgactcggataagggaagacaggcaggagaaattagaagtgttaaaagggttccacttgccattgtgggcttggctttgaagatgaaagagggtgccatgatccaaagaatgcaggtggcctcttgaagctgggaacagaaatacacagattctctcctaaagcctctagaagaaaacacagcccagccaataccttgattttagccctgtgagatcttgctcaactctgacatagagaactgtaggatagctttttttgtgtgttgttacaagcaattaaatttgtggtaatttataatagcaacaataggaatctaaacaaagacactgggttggagagagggttgagcagtttggcccagtaaaactgcatgagttatttatgggttgagtggacattttggaatgcagcctgatatggtttggctctgtgtccccacccaaatctcattttgaattgtactcccataattcccacatgttgtgggagggacccagttggagataattgaagcattggggcagtttcccccatattgttctcgtggtagtgaataagtctcatgagatctggtggttttatcaggggtttccacttttgcatctttctcatgctctctttgcctgctctgccattcacgtaaggtgggacttactcctccttgctttctgcacaactgtgaggcttcccaagtcacatggaactgtaagtccaattaaacttctttcttttgtaaattgcccagtcttgaatatgtctttatcagcagcatgaaaacagactaatacagtaaattggtaccagtagagtggggcactgctgaaaagatacctgagaatgtggaagcaactttggaattgggtaacaggcaggggttggaatagtttggagggctcagaagaagacaggaaaatgtgggaaagtttggaacttcctacagactcgttgaatggctttgcctaaaatgctgacaggaatatggacaatgtaatccaggttgaggtggtctcagatagagatgaggtactagttgggaactggagcagaggtgactcttattatgttttagcaaagagactagtggcattttaccctggccctagaaatttgtgggattttgaacttgagagagatgatttagggtacctggcagaagaaatttctaagcagcaaagtgttcaagaggtgacctggatgttgttaaaagcattcagttttataagggaagcagagcataaaagttcagaaaattcacggcctgacaatttgatagaaaagaaaaacctatttcctgaggagaaattcaagctggctgtataaatttgcataagtaacaaggagtggaatgttaatctccaagacaatggggaaatgtcttcagggcatgtcagaggtcttcacagcagcccctcctgtcacaggtcaggaggcctaggaggaaaaagtggtcttgcgggctgggtccagggtccctgtgctgtgtgcagcctagggatttggtgccctgcatcccagccattccagtcgtggctgaaagggatgaatgtagagcttgggccatggctttagaggatgcaagcctcaagccttggcagcttccatggggtcttgagcctgcgagtgcacagcaatcaagaattgaggtttgggaacctctgcctagatttcagaagatgtatggaaatgcttggatgtccaggcagaagtttgctgcagggatgatgctctcatggagaacttctgctaaggcagtgcagaagggaaatgtggggtcagagcccccacacagagtctgcactggtacactgcctagtggagctgtgagaagagggccactgttctccagaccccagaatggtagatccactaatggcttgcactgtgcacctggaaaagccacagacactcaatgccagcctgtgaaagcagtcagaagtgtggctataccctgcagagtcacaggtgcggagctgcccaaggccatgggaggccacctcttgcatcagtgtgaactggatgtgagacaaggagtcaaaggagatcattttggagctttaagatttgactgccctgctggattttggacttgcatgggtcctgtagccccttcattttggccaatttctcccatttgaaatggctggattttcccaatgcctgtacccccattgtacctaggaagtaactaacttgcttttgatttacagactcataggcagaagggacttaccttgtcttggatgagactctggactgtggacttttgagttaatgctgagatgagttaagactttaggggactgttgggaagggatgattggttttgaaatgtgaggacatgagatttggcaggggccaggggcagaatgatatggtttggctctgtgtccccacccaaatctcatcttgaattgtacttctataattcccatatgttgtgggagggacccggggggaaataattgaatcttgggggtggtttcccccatactgttctcgtggtagtgaataagtctcacaagatctgatgcttttatcaggggtttttgcttttgcgtcttcctcattttctctttgcctgctaccatccatgtaagatgggacttgctcctccttgccttcctccacggttttgaggcttccccagccacgtggaactgtaaatccaattaaacctctttcttttgtaaattgcccagttttgatatgtctttattagcagtgtgaaaacggacaaatatatggccaggattgagccattctgtcaagatccatccaagcagctggctgcaggggaagaaagcttaacagcaaaagcctttgagatggttctccaagggtggtggttgaggggaatcagaggaggtcaagttgagccactcttggggatgtctagtggacagcctccctgcctgtggggtctcctgaagggctcatgcgtggattccaagatcagtttaggagctaccacatagagattcttaccagagacagcaaagacagggccacatgagagccattagccacccatatcagttagataggctagactatgctaagtaacaaagtccccaaatttttgtgccttatgacaatacagaaatctttcttgttcattcttcatgtctgtctctactcatcctagtggaatacatgctcacatggcatttactattatcaagtcccatggctccacctaacttcaaggggacagaaaactataaccctactatgtgcctggaagggcaaaagagcaggctgtggcccctccctcatggcaagattctcaggctgattccaggctggcctgagaggaagaggaggatgaaattagacatgcaattgcaatttgaagccagactagactttcattttaaatattgaaaatgaaaggagtctgggggctcttcctgcaatgtgattacaaactaggaaatcaagattcatcagggcatggatgaaggcagtgcttagaaaggaataaagttagctgggtgtggtggctcacgcctgtaatctcagcactttgggaggccaaggcaggtgaatcacctgaggtcagaagttcaagaccagcctgaccaacaaggtgaaaccccatctctactaaaaagcaaaaattagctgggtgtggtggcacacacctgtagtcccagctactcaggaggctgaggcagaagaatcacttgaacctagtaggcagaggttgcagtgaggtgagattgcaccactttactccagcctgggtgacagagcaagactctgactcacaaaaaaaaaaaaaaaaaaaaaagaaataaaattgttttttatgtgtggcttgctaatttcagactctattaaaccaactgcccttgcatttaatcttcaaaacaatcctttgaattagtaattattattaccttctttttacctatgacaaaactgagactcagagagattaagcaatatgaccaatggcacacagctgacggagctagtcagaattcaaatctagatttgtgtgactccaagcatgcacattccgttttttttttgaggcagtatctcactccattgctcaggctggagtgcagtggtgcaattgtggctcgctgcagcctcggcctcctgggctcaggtgatcctcccaccccagcatcccaagtagctgggactatagatgtgccccaccatgctaggttaattaattaattaattaattattttggtagagatggtgtattagtccattttcatgctgctgataaagacatacctgagacgagactgaagaaaaaaaggtttaattggacttacagttccacattgctggggaggccttagactcatggcaggaggtgaaaggcactttttacatggtggtggcaagagaaaatgaagaagacacaaaagcagaaacccctgataaaagcatcagatctcatgagacttatccactaccacaagaatagtatgggggaaaccacccccatgattcaaattatctcccaccaggtccctcccacaacatgtggaaattaggggagtacaattcaagatgagatttgggtggggacacagagccaagccatatcagatggggttttgccatgttgcccaggcttgtcttgaagtcctgagctcaagtgatccttctgccttgacctccaaagtgctgggattacaggcatgagccgccatgcctggcccaggtatgcactttaaaagccatccttgctatcttgtgccattttcctgatagaagtcacccttctaaagtggacaaggtaagacatatttacattgttatccctttgtgggtaagagaataaaattaggaagatcctcaggatgtagcaaaagggcacttactatgtgccaggccccactaggcacttggcatgcatttatatctcatttaactcctagggctactctatgaggtaagcaattccattccaattttgtggatgagtcaaactgaggcatcaagagataatgtgacttgccaaggtcaagcaactaataggcgagatttgaacccagatctgtctgtttttcaaaagtctccacccagctacaattccccattgaaaaagttttggaggagttacaggagggagaggccattgttgggtggaatagtcttgaggagggactccagtatgaggggatgtcctggaagcaaggagggtggcaagcaaaggtgctgagatgagagtgcacacaaagggctcaaggacaaagagtaggcagagctgattgtcactgagaatgtgtaagaacagtgggggcaagataaaaggcaggttggagccagatggggagttgtcaggcatgtaggctgaggagtttgactgtgctctctcaggccatgggggaacatttggagtgggatttgtaatgctgatgagaggaaataggaagcctgggagtctgcagttcctagagctaccattaagcgttagtgctggggctgtctgcccatagagtcgttatccccttagcaggtgggaaataggaagggtctagtttaggcagaaacatccctcaagagaaaggcatgtcagggttggtggagacagtgggagaaggttccagatgcagcaggacagaccctggaaggcagggaggcaggggggtggcatagggcagcagaaagaatgcatctctggctcatggcagatcttgttcagttctcagcttagtctctgtgaataaaagttatctgaaaataaatttggaggaaagagactttattccagtcaacgtttgcaaaccagggagaagcagccttcagtgtaaaacgaaggtgcattccagagaacaaagagagggtctgagcatttgttttttcttttgagacaaggtcttgctctgtcacctgggctggagtgcagtggcgtgatcatggctcactgcagcctcgaacttctgtgctcaagtgattctcccacttcagcctcctgagtagctgggactacaggcacatgtcaccatgcctggttaatttttgtattttttgtagagatggggtgttgctatattgcccaggctggtctcaaactgctgagctcaagcgatccatctgcctcagcctcccaaagtgctgggactataggtgtgagccactgcaccaggccagggtttgagttttatagcaaaatttccagcccaggtttctttatgcaaatgaagaattcaaacttgcttagttctaattggttgacacagctgagttctattggtcaatacagctgagccctggttagctgaggtaggtgagctccgattgtttctgagttcaggtgaactcagaaagttaaaaagttgtgggtttttggagaactcagagtatgtgacctctagtcagcaaatggccacgtggctctgttttaaatttaggcccagttagcctcttgggatctatctttaaggatttgctctttcaggttcacatttgttcacgtcttttaccacctgtatgaccctgggcatggaattttgcttttctgacactaaaattaaatggtagaactgcaaatttcctcaaaccatactttaatatgctgcaacatgtagcccctctagtttatcatactttccttttgagccccttttctataggcgaacagggacacttaacatgccaattgagtgtctaccagtctatctagtctctttcagtgaaaatgtttccactctggcttttctatcttcgtatcagggctggctcaaatagttcttttgggattactcaatgactctttaagtaaaagctccatctttcagagttttgctcttttgccttctcctctccaagatggtgcctgggtatttaaggggtttactgtaaccacaagacagcagggagaggagcctcaggtccacactgtgtcctccatatccagggctagtccagtctgctccctggactgtaggccactaaggcatgacaggcctcttcttgcctccttggtgatgggctgctggtggcatctatgattttggccatttgtcctcaagtcacaaggttcctacccatggtggcctctttctttgatctcaggcctctgtcctcttggtactttgatgtgctctcctgatggagggtcaggggtgctgccacaggctcattcatcagaccatttcctgcagtcttactgtgccatcaccctctgccatgttggaaatgagtggattttcttgtaggctcacagactcttgctaatagacatgggaagtaggtctttagtttttcggatggccttggctttcctctcaatctatctaatgtatctccttgaggtgaaacacagcttggagaggaaaggtaaaacacattcacatcacctccagcttcccctccctccacccatcttttcctttccataaccccttgaacatgaagggatgaacaccctggctttactttgcagaagtaccttattccaggccatgtggttcttgggtgctgactccatgtctgagttccagggacagacaggtaaatcagtcctgtctaatcagattatcccgttctggctagtgactggtccagggatgaacatgtgacccacatctgtgcaatgataggcatctctgagaacttattagacctttataacagagaagctctctttttcttgaattgggatgtgatttacatagtgtgaaaatgtatagatctttagagttccgtgtaaagaattttgacaaatgtatacacatttgtgtaatcaacacccaaacaaagatatagatccttttcatcaccctaagaaattccaacaggctcttttccagtttatgccagaaagttccctctgtctcttcctggtcaatgccaccctctccctaacacacatacaccagaggcaaccactattctgatatttatcactatagattattttccttgttctagaacttttcattctctgctgtttatttatttgtatgttcttaatcaaatatcacactgacctgatttctatagttttatagtaagtctccaagccagacagtatacatttcctaatttttaaaaaattgtttaccatgtaggttctttatatttttatataaacattagattctcagaaagcattctgggattttggttggtatctgattgaatctatagattaatttggagaaagctgacatcttatccatactgagtcttccattccatgtatatggtatatctatccatttatttagttattctttaactcctctcagtaataattcattgttttcagtgaagaggtcttttattatgttcattccaaagtattttatatgttttggtgctactgtaaaaagtattttaaagaaatttcttttttttttttttggagacagtctcgctctgtcacccaggctggagtgtagtggtgtgatctctgctcactgcaaccactgcctcccaggttctagagattctcctgccccagcctcccaagtagctgggattacaggcacatgccaccacacccagcttatttttgtatttttagtggagatggggtttcactatgttggccaggctggtatcaaactcctgacctcaggtgatccacctgcctcagcctcccagagtgctgggattataggtgtgagccactgtgcctggaggaaatttaatttttaattttttttttttactagtgtagaagttctctttttagagtttgctaagctggtgaaaagtaagccaggcaagagccaccatagggaggctgtatccctgagaatgaattcaaaacagaggggagcagagctgaaaaatggaggggagggagagacagagagagagagagatagttgagggagagaaagaggcttgaagaaagggtttgaactcctatattcaattctgagtgaacttaggtctaccctggactttactggagacaatacattttatttgctaaagtcgttttgagctggattcctgtcacttgcagctgaaagagtcttgactaatcccatgtctgagttggcccagccttgaaggctagtgtgtatgtatgagtgagtttcatgccaatgaggaaaagaaaaaaaacatggttcactaattcttatttctttttcccacgagtgagaattgttgacttgctagtttccttactaggtgactattaagaactaaatgtttgtatcttccaaattcctacccccattgtgatggtatttgtaaagaggcctttgggaggtaactagtgttaggccttaatgatgaaaccagcccttataagaagagatatcagaaagatcagagagcttattctctcccttctctcctttgcaccctccccttctcccgcaatttcatgcacaagcactgaggaaaaccatgtgaacacacagtgagaaggcagccatctgcaagcctgggagagatcccgctcctgaccatgctggcatcctgatcttggactttcagcctccagaactgtgcgaaaataaatttctgttgttaagtcacccagtctattttattatggcagctcgaggagactaatagagtgacctgttaagtgagcccactactcaaaagctttccttccttcttttccctccatcccttcctcactcgcttccttccttccttccccctcccttccttccttcccctacccttccttcctctctccctccttccctccctctttctctttccttttttagagaagcactatctaaacctatatggaagaaaaaatttgtccctattagcaggattatggtcctgccctttaaaagacaacagatctccacagttttgctgaagaacacgggatctgttcttgcttcttttgggtctacggcatcacagatagcacactagcttttgatggttcctttccctgcaactagggcaatgtcactgcctctcactaaaatgttttagcttactctctttctctgatgaatataagaactagggggtaggagtagggactgtgttt

SEQ ID NO: 1975 - DNA, 165537 bp, Homo sapiens
cagacaagcgaaactacaattgttccaatcaacaacttcctctattgtcctgtttctaatttaagggtaactgatgccaaaacacatgacttcctacaatttgctgagtggaaaagctggctgtaaacttaaatttcaccaaaaaggtaactggagagttgctgctgacacacacctcaagcttgggtgaaactttcagatctacagcacagtcccagcgttcaacagcgacaggagaattccgtgagccatgcttcctgggaagcggtctagcgagtccggacaacacgcgtccgcacggtgaccacaaacgtgtgctgcccctttcacagcccctacacacgaagcgcatgtacacgcacgcatgggcctgacaccatgggctgcagacaccgcttgtgggcggcacatgctgatgagggccggctcatgagaacggctgtgtgttttctgcacccaccacccagaaacaggcatgagtaggggcacccacagtcagacaaacccaccaccaccatcagcctcggacggccccgttcaatctttaccaatgcagttcccccagtcacggccggcacgtgtcttcctgcctctccagatggccacggagaggaacactaacagcagcattggcaattctgcgtctaaggctatttcctgaaaagcatgtgggaaatcccactgacttccagcatgaaaccagtgtgtgtcaagggaagaagacgacaagccacaaacggggtaaaagtattcgcaaaagacatatctgataaaagactggcatccataatatacaaagagtccttaaaactcaacgaaaagaaaatgagctcttctacaagttcctccccacatgtattcagtgcatgcctggctgggcaggaagtgtggggcaagcagtgtgtgctggaagggcggaaatttccaaaacagatctaacaagagggcccagatgttgaagtgccttattcccacaaatgtccgccatcactctaccattaagatactggaaatgaggaaatgaagtattaattttctaacaatttgtggtaccctggtctggcaagctgtcttgagctatactggactcagagtaggcacatagtcaagcaacacgacacagcaagggagccccaggacagcggtgggcaggtccctgaactgcgggggctggcaggacggggcaggtgacctgcctgtgaacggccaaatctgtgtgcgcatatagcaagtgctgcattcaccacaagccaggagacttccgtgacacttccactgccttccttggactctggccttcccttggcctcagcagcttcactgctgtccttcaggaatgataccggggcagcagctctgggaagccggcagaccacctgctgccgtgtcccgtggggcctgcgtggctacacagtgcaatagtccaggctcctgcactggagtggagacgctgagggatggaggcaggctcaccagcgagcgtacggctgtgcacatgcgtgcctgcagagttcacagaagccctgtgcgggcaagaatgttgtgactacttgatgacgccggacagtgccagggaattgcatttttgaggcaaggcaaggctttacactgtgtgagatggattcttattacagaaagtaggatgcacatgatgtgttggattttgaggcttaaagagtagcgtctgctcagtttcaaagcaaagagctggaagaacaagagccaataaatgatcttttgctatatgggggaaaagatggcaaaaagtctgaagacacctcaccaaagatgatacacagacagcaaatgagcatatggaaagatactccacactcgaggtcctcaaggggttgtagctgtggtgccaccacacacctatgagaatggccaaagcttagggcacggacaacaccaaaagcaggtgaggatgtggggcagcaggaacgctcgttcacggttggcagaaatgtaaaatgcagcaaccacttcgaaagacggtttgcccattttcacaaaaccagacatactttcaaccatgccacccagcaaccaagttccttggtatttaccaaacagagctgagaacttatgtccacacaaaaacctgtgctcagatgtgagagccgctttattcgtcattgccaaaacttggaagcaaccaagacgtccttgtgtaggtgactgaataaaccgtggaacatccagatgatggaatgtcattcaccgctaaacggaaatgagctctgacgccatgcacgaaaagatatgcgggcactttaaatgagtatttctaagtgaaagaagctactctgaaacggctaccaactgcgtgattccaactagacgactttctggaagaggcaaaatcaagcacacagtaaaagaagcagcggtgaccagggcctggggaagaagagaggctgaggagggtgtcagggcagtggaactactctgtatggcactctaatggcagacgcatgtcactatgcatttgccaacctactggagctacagcacccagagtggagaccctgacgtgacctccgcactggggtgacagagacgtgccactgcaggctcatccaccgtaatcaatgtcccactctggccggcgacacagacactgggggaggctgggagtgggggcaggggcacacgggaaatctgttatcttcctctcaattttgttgtgaacctaaaactgctctagaaagtagtttgttgattttcaatgttgtgtccttgtatttacataaataaataaggcaatcaaaaactcctgataatccctggttgtccagtgttaggaagaaaccaaaactcttcatgagaaaggaattaaggggcatccatgctgactgccgcgtacttggggaagctttctgtgccacctgcttacacctgaacaaagtgtcctatcgtggaggcgcccatctccgggtgtgctatgcatcacctggaaaaacccagcttggctgcctctgatcatacaacgagcctctagtcccagacacatgggctaaagaaatacaaagttcacaccagtttcaacgaggcatgtgacatcctggcatcctccaaacactcagcgcctcacgtggatcagtgtggaggggcttccctaaactgcaggttctggggctccaccccagacccactggatcagagaccaagagtctgcactgcagccactcctgagtcatacgctgtatagggagcgccacgagctccacctcacccgacagctccaggctgcgctgtcaccctggcggggcagctactacgtccccgctttcaccctcaagagtgtcccagttagaacaccccagcacttcagagatgaatgatctaaagcttaattgtgccttaagtcttctgataaccgtctttgtgcattttgtgccacaagtcagggcacttcagaaaccgaaaaggacgcacagcagaccacacatccatccttcttctctgctctcctttcaattagagcttgctgtgaatctgcagcggcagaggggagtgggcagaggccaggtgtatgtgtgtcgatgtctgcctatgtgtctgtgtgtgtgtgtgtgtgtgtgtgtgatgtctgcctgtgtcgcgtgtgtgtatcgatgtctgcctatgtgggtgtgtgtgtgggtgtgtctgtgtgtcaatgtctgcctatgtgtctgtgtgtgtgggtgtgtctgtgtatcaatgtctgcctatgtgtctgtgcggggggtgtgtgggggtgtctgtctgcctgcgtctgtatgtctgtgtgggcatgtgtatgtgtgtctgtgtctgtgtgtgtctgtctctgcatctctggatggatctatatgtgtctgtatgtctgtgtctatctctgcatgtctgtgtctgtacatctgtgcatgtgtatgtgttgtgtttgtaaaataccctaagtttgaagaaactgaatcaaggaaaatctggaagggcccccaggaatgagcggacaccgtatggccacagtgtgtctatggctggcatccccacagcagaggcagcccagtgtgcatgcccccagcatgtctttccccgcactcctctgctgaccatatggggcggcctggcccaagccccagacagtgccctgaagtctcctcccgcctcctccagacccttgccctgcccttctcacacctgcttgcagaccttgcctcctgccccacagaccctgagggcacagcgcagttggactacctctgggtccagcacacacgcagcgcaggcacccagatggtctttaaaagaaacgaatccctaagtgctaaaggcagaggggccagtccaacccataattactccatcaataaagaaaaccagggggcggtggctcaccactataatcctagcactttgggaggctgaggaaggaggattgcttggggccaggagttcaagaccaccctgggcgacacagcgagaccccatctctacataaataaatacattaaaaaaaaaaaaaggctcggcgcggtagctaacgcctgtaatcctaacactttgggaggctgaggcgggagaatcgcctgagctcaggagttccagaccagcctggacaacatggcaaaaccccatctttacaaaaaaaaaaattagccaggtgtggtggcacactcctgtagtcccagctactcaggagactgaggtgggagaaccgcttgaggccaggaggtggaggctgcagtgagccaagatcgcatcgctgcactctagccagggtgacagagtctctgtcccgtgtccaatgccagcgtgaccctcgcagactcgcccagacctccaggaggcctggtgcaagctcatttccctttgctgggcctgctttctcagcagtaaactctacataccaaagggcccttcccccagcccagggggctccctggaccccaagacttcctctgggtccccacggcaccaccagctcgaccagctcgtacctccctgtctagtcagtcacgtgcttgtgtctccccagccacggcaagatccctgaccccaggggcaggcagagggcatggcctggcgagacagggactcagaaggacctataaatgagcaaatgaagcgccttgggtgctaacgccaagccagagtaaaggacctacaatggcactattcccacaaaggctctgactgacatcgacaatgctgttctcatagttactgatgagccagaacgcttgcccgcctccggcgcccagcacacggggctaaccccacacattatggctaggaaatccactggaaactgagcttactggaagagctcccagagacttcctggagaagatgaccttcctgccggtgaagtcacaggccaactgtaggatgctggtggcaaggcccctgcaccacaggctagagcatcacctcacagcttctgggctctcctggctggcaccacactcaattctggaagccatttttccatctgcaaaggcaaacctcagacttgccaacagctgtgggatcctaccaggaactcccagggcctgtggggcagggcacatggctggcgactggctcagatgcccaagaaccacgtcattcagaaaggccacacacagctggacaacggggtgccaagcccctacctcgagaggctgtgtgggtggatcaaatgggagcaggcagcaggcatcagggtaatccccctcctgatccccttcctgaccccatttcagaaggggccagggaagctcagctcttctccaccagacaccgttctatcccccaaacaactggcaggggagagccactctcacagatatgatcatatgtcaggggaagtccgcagttcaccaacactcttcctgacaccaccccagcaccaacacagcacaggacaggcactgagtgtatatacacaagtgtgcacacaacacacacaccacgtgtgcatgcaacacacacctgtgtacacacacacacacgcactcacacacgtgcatgcaacacacacctgcgtacacatacatgcgctcacacgtgtgcaacacacacctgcattcacacatgcactcacacgtgtgcaacacacctgcgtacacacatgcacccatacacgtgtgcatgcaacacacacctgcgtacacacatgcattcacacacgtgtgcaacacacacctgcgcacacacatccattcccacacatgtgcacgcaacacacaggcatgctgagctgaaagtgtctctttcaaaaattttcattttcattgatcttcctgatcttcaaaactatataaagacaggaaatgcaatctccctggttgccatattctaatcagagaaattcattcagtttagaagcatgattatgaagcctgctgacacaggtcaggacagtccccaaaatacactaaagccaaaatctgaacaggaggtggtgtgtggtgtgttcaccagctcacgcgctacggctgatctcgcagactgggctctgtctcccagtgcacccagaacctcccctcccaccttctcctccacatctgtgccagtgcatctcctgcccaggctaccacgggagggtcgtgactggtttcacagcttccacccttacccacagtacccgctgtcagtactgtgaacagggcggtaccttacaacacagagtcagaccagccattcctcacctcacggagtcctgcctggctccccaaacccttccggagagcctgccagcccagcccaaccacggggcccttgccacacggcacctgcaagccttaggccctcaccccccctactcctgctataccctctgcccgctgcccctcagtggtgctgtcctaggcacactggtcaaacagcctcctcgccagcgctgcctggagccgagttccaacaggaccccaagctctcccccttccctccacaacaccagacagaaagtaaacgcaacagtgtatttcaacaggcaaaggccagtgacaatttacatgacggtaaatactcctcaatactgcatcgaatcaaagcatttattactccactttctaaaatttaagggttaaggtgttaggatttgaaataagacacctttttaaacagaatccctcttcatcttctaccaaaacaaactgttacctaaatgtcaacaggaagaagatgcagtgtccgacacgtagcaaacacgcgagaagagctcatttaagaggaaatcacatgaaaacaaggacacactgcccccaaaagaaaatattctccgcgccactgagcttctgttagaacatacaaagttttgctcatctcccttcttacctgtatatagtctccttgatttgcatgatcagctgagtaggtttttggatttttaattaagaggcaatgaggggtgtgcccttctttccaaatgctcaagcactgacctggtgtgtgtgccagggtccgaaggacgctttggctgccatggaaacggtggcatgcttctagcctgcgcatcccctgaaatctcagctgggaattcaggaaaatcaagcgccagtatcaacctgaaatgcccataagccctaggataaactaggtctcctctgagtcgcggttactttaggagcaaacgcaggtacaaacaaactgagtctgtcacccgcagcgtgggagaggcaggtcgcgtgttcctgacagcacgcgaagcagctaaatggtatccaaacatggaagcagaaaccctcacatcacacacatataatcaagaactgacctcacagacagggcacaattgaggaataccactaatgactgccaagatggaattagaccttttgatggttcttccatgtaaaatcaagtcaaatcaaagcggtttccaggtcctgaacttaacctcaagcagaaaagaacatagtgaacgtcgtgctacgaaagtgaaaaatggaaatggctaactgtccaatgatacggagctctttcagttatggtgtgcactcaggacacacgatgtccgtgtgtttgaagggaagtatgacggatatttcagcaatgttaatgtcaaagcttgtctttaaaaaacgtaaagtttgggccaggcgtggtggctcacgcctgtaatcccagcactttgggaggccgaggcgggtggatcatgaggtcagaagattgagaccatcctgcctaacacagtgaaacctcgtctctactaaaaatacaaaaaaatagctgggcgtggtggcaggcgccgatagtcccagctactctggaggctgaggcaggagaatggcgtgaacctgggagacagagtttacagtgagccgagatcacgccactgcgctccagcctgggcaacagagggagactcagtctcaaacaaacaaaatgtaaagtttgggccaggtgtggtagctcacgcctgtaatcccagcactttgggaggctgaggcgggtggatcacccgaggtcaggagttcaagaccagcctggccaacatggtaaaacccagtctctgttaaaaatacaaaaataagctgggcgtggtgacagacacctgtaatcccaggtactcgggaggctgaggcaggagaatcgcttgaacccgggaggcggaggttgcagtgagccgcgatcgcaccattgcactccagcctgggcgacaagagagaaactcggtctcaaaaaaaaaaaaaaaaaaaaagtgaaatgtgggtgaatgaccaaaacttacatatggccttggcctggggctagatttattcctactttctaagaccaagtaaacaacaaaaccaccatgggaccctctccccttcactctcctcaataccaggggctccgccagaaactaaggctgaaggtcagccatctcgagggacagaatgggtcacctctactacttgctggatgacatggcatggctgagccactaaaaacatgggctaaggtgacacttttaacagtacctcatgatgccctgtggccctctgcaaaacccttctacttcctcgtggatcccttgtgtaaactcacaacaggggttcaccacaaggaaaagggggccccaggggcattccggttcagagggccactgcggatgggagacagaggagagggcagaacggccactttctcttcgtgctctcctgtcttcatgcagggaagtggctggacaactctacggggcgtggcgccggcaggagccagctctgaattccgccaaccacatcggttcgactgaaaacccacgaaacatctcccctcctctacgagagaggagttatcccataacctcgtggtcccccattttctgtgacgaggaaagtcagtctatagttcagcgagcagcccctcatttatctggaaaagtcagctgttcagaaccaagcgttttcttgggattatggacagcagccacgttcaagatgaacaatatctcctagggaattaattgggacagtcccgaagtcaacaaaaatgacttcttaaaaactggagtcctggttaatatgtatcaaaaaccttaaaatgcgtacaacttttgatcccaaaattttaccctttagaacttatcataagaaaacaaagccacaggaagccaggcttggtggcatgctcctgtggtcccagctattcggtaggctgaagcaggaggatcacttgagtcctggaattcggggctgcagtgaaccatgactccacctgtgaataggtggcgtgttccagcctgggcaatatagtgagacccctgtctcaaaaaaaaaaaacaacaacaaccatgaaacactacagagcaatgcttattacaccactaagaaaccttaaatatccaaaaaagattggtaaaataaagcatggcatatccacatacaaaatcacaaaatcatgatgaatgacaatttgttgacatgcaaatatacttacccactacctaagtttaagcaggttaaaactacattatgatcacattgagttctttagaaaggtacggatgcagataaaaaggtgttatttacgcatgtttcatagagtctttctgctcctataggacctaaactttacttttttttttttttgagatggggtcttactgtgtcacccaggctggagtgcagtggctcagtcacggctcactgcaacctccaccttctgggctcaggcaatcctcccacctcagtctcccaagaagctaggactacaggtatatggcaccatacctagctgattttttgagatgggatctcactatgctgcacaggctggtcttgaactcctgggcttaagtgatcctccctcctcagcctcccaaattgctgggattacaagtgtgagccaccttgcctggccaaatttacttttaattaaaacaaacaaacaataagttacctctaaaaacagattttctggttccctgtccaacatcacacaagtctgggtaagtgatatgacattcaggagtgttttaagatgacttactgaatctcagatggcctagaccttccaacagaggtttgcgatgcgagcagctcctgaagctcagtagggagagcaagtctgaaaagctgactgcactgaggtgctagtgggtccagctatttggtacggaaacactacagaagccttccccaatctggcaacagcatgaaagtggcaggtccataaccccacccaggaaaacagcaggttcctcccaaatgttcttggaacctaggtgctactcattcctccaggatccttggcggggacctcactcggactctgccccagtgtcgcccacgcctctgcacagcactgcactcacaggtatccatgagtcagccccaactacaaggcactgagcctaccaggaagaaaggagtcgactgcccttttcccttctttccaggctgaaagagaccacaggacatggtctgctacaggcccacacgggctcagaagctctacttcttgtctgggtagtttacagcatcctccctgcctgaggcccagacagcgctgggcttccaaggccaaacacctcacgcgggctcctcagctgaagatatcacgggcacctttccaactcattaattcctaggtgctgacgtccccccggcctaagcactgccctccaggatcggatggccgcctgtgagccagcacaggatgtcgcctccagcaagctcccagcagcaagggaaggcaggcagagcccttggacacctgcgagccaggctctgaaggatgcccggcacaggggtgaggagcccgcgccgccctctacagatgggtgcgccacgatggcaacgggcaatgcaaagccacacacgccggccacatgtggacagacatcgttttgtctgcatcctgtgacactggtgaacttcatcagaatcttcctcatctggggacacaagacaggtccgggtccggcgaggaccggaatgaaaggaccatcatgggctaccaaaaagaccagtttcagaaatgtcaactgatccctgcccgaatattaaaaccttgctaagtgatggacaaaggttcatgaagctgacacacaacagtgtttaaacctagaaaaataattaagccaagctactctggacacaatggagtcctcaaattcatcaataaactgtatttactttatgtgaactccaaatgatagtgagacctgaaagcttatcacagacgtgataaaatcaacatgattcacgtactttagatgttttagattttactgttagttcactaaaaagtccacccttttactcttaaaaaaaaaaatcttcaaattgtgttatctttaaacatttttttttttgagatggagtcttgctctgtcccccaggctggagtgcagtggggcgatctcggctcactgcaagctccgcctcccgggttcacgccattctcctgcctcagcctccagagtagctgggactacaggcgcccaccaccacgcccggctaatttttttgtattttttttgtagagatggggtttcaccgtgttagccaggatgctctcgatctcctgacctcgtgatccgcctgcttcagcctcacaaagtgaaaaaaacaattttttaagagataaggtctcaccatgtggtccaggctagaatgtagtggtgcaatcatagctcactggtgacctcaaattcctgggctcaagcaatcctccggcctcagcctcccaagcagctgggactacagatgcatgccaacatccatgtccgacttataagtcactgttttaaatacagcacacttctcatctgcgaatagttccaggacacacccttacacttttgcacctgcctcagcagcagccccgccctctgacagccccagcaccaggcagctgagctgagctcctgcagcacatagggagcctgggctgaggccacactcgtgaggcagtgggtttccccgatgggatctcggtgcaacccaacaactgagccaactgggactcctcggtctgtgaaacccatgaggacattggcgagactgggtgagcacaacccataaggacactagcgggacaggggtgagcacctgcggtggaagcggggcgggcggccgacccacgaggacactggcgggacaggggtgagcacaacccacgaggacactggcgggacaggggtgagcacctgtggtggaggcggggcgggcggccgacccacgaggacactggtgagacaggggtgagcacctgcagtggaggtggggcgggcagccgaaggagagacaggcctctgccccctagccaccagcagctgagtgctgaccacagcccccacgggcagcacaggcaagcaagtggaggaaatagaggaactgtgagtgagcagaaaaatgcaatgcaatcagctgaccagagaggaagctgggctccttgctaacgtctcaacaaggcacagacgcacccgcaagggagtgggcagcactgcaggatgcagcaagggctgctcagacctgctgggggcatcctttgccccgggctctgtccctactgcccccaggcacatttcactgccaggctgctgggggccagggctccagcctccagggcagcacacctcagcctgctctgtccccttcaaggccagacaagcaaagccccagcccccaccttggcccccagcctgtgggcacagtttctctccacaggcttggctgggcctggcttccacaccttccagctccagccttcaccccaagacccccacctctgtgacggctcccacattctgcgggacccacctccaggctctgctggttctcctctcacctccttcccccacgcagcctggaaaggaagggccgatgctcgtgggagcccctgtggcctcggggccctggctctatccccaccgtgccaggcggcctttccttgcctcccatccgcctactcagaagcccaggatggctgccaggtgaaggaaacggctctggaggggagccaggacaagtctggctttactgaaaagtaacatccgcaggacagactcatagctgactttgtttgaaggagcaagtcggctaagagtgtcattttcctttacacctgcaatcccacggaccacatctcaatgccctctacccccattcttacgtctgtcacttgctctttcacatacgttgcaagtctttgatgagggaggccagctttccctctggaaggagatgccttcagttgtaaaccgacaattcataaaaagttgggggcttcgagtacacaattccgcattcccgagaagcctgccaatcatgcagtggaaacacctgacctggtgcatcgcgcacccctccctggccaggctgccctccctggcacacgccccgcgctggccggcaacaaacaaaacccacacggacaaaggagtctttacaagaacagccaaaacaattccatctgcgaacaaaaactaacggcagaattaaaggctgcaagtccaaacacaatctggctattgtaaacagtgcctcagtttatcaatgtaacaataactctttcaaagattaataaagttccccccaaacactcagcaatctagcattgttaagatactttggaggataaatattagcttgggactcgcctacatgagaagtgaaagctgccaagacagcagttctaaagcaagaaccagcggcagcagcggcggccacagggcagcgaggcatgggcccaggcactgcttccagccttgccgcacatcagttcgactccccaggcacctccttgcacccagcaccacgctggcccctcaccccgtgtcacactccacatgcagccccctgcgagctgagcagcaggactcaccttgggcactgtgagtgagacagagcaagggcaccaatcctctgggccccacgtgccccctgcccaccctgtcctggggtcactggctcgtgagggcgggactgcgactctgtctcctggatccctgatggccaggcgcctggcaacagataagccacccacagcaaacaggaataggtggaaaatggacttaactaaaaggagaggttttaagatgattgttggaaataaaagggaacaaaggagcattcaagcttagatttgattccaacttactttcttgaaagacatttaagtaacctgggtaaccaaatgcaacatggtgttggggccagctctgagagcagtgggtcacgcggggcccctgcaacatggtgttgaggccggctctgagggcagtgggtcactcggggcccctgctatcagcaatcccaggttgagactccaaacagccaggctgagtgggtgctaggctggcccaccctctgcagggtgtgtttttgccccacccgtacctccaccatgggggtttttgttcgtgtaatgcgacagcgtgcagctccacacacacaggaagcaagctgtcaggacagagcctgactcgcacaggtaactggaatcctccccaacaggtgggtgtgcagagagcaggtccctgtccgggcacctcccgaaggactgtcttagcacgaccttgcttctcccaggggagggaaaggaaaagggcctcgtgaggtctccgcaagaccgggctgtgcgtcctacaccaggctgccttctcctgcacattttcctactcaaagacaacggagtccaggcatcctctcagcatcgcacgagttcccctggtgcagaaaaacagactttaaaagtctgaatcagtctcagccaagtgtggtggctcatgcctgtaatcccagcactttgggaggctgaggcgggtggatcacctgaggtcagaagttcgagaccagcctggccaacatagtgaaaccctgtctctactaaaagtacaaaaattagctgggtgtggtggcaggcgcctgtaatcccagctacttgggaggctgaggtaggagaatcacttgaacccgggaggcggagggtgcagtgagctgagatcacgccaccgtactccagcctgggtgacagagcaagactccatctcaaaaaacaaaaaaacctccgaatcagtctcctacagtagctgtgactgtgacaggctcagccctcagtttccccacctgtaaatgggagcaacactgcgagtgttgtaaagggcaggtggcgacacagcacagtgcctgtcacagcaggctctcacggacagagcggttgctaatggccttaaagctccgcggcagcacgtggcccctcgactgctctcagagacaaggtactgtcaactaaggcgactttctgaaatggccttaggatgagtcaaatccttggttcaatacatgacagtgtttgcacatacacagactcagcctgaaagagacaaaaaacacaggaccatctagctgaaaagcagcagctactgaacatggtctaatttttgtttcaatggctcaaaagaataaaagaatcatctaataatgatgatatcattggtttcattaggatttttacccagttgtcactaaaagggatatatttttggtttagaaaacgaaaaccttaggttaataagtgtttcgcactggttatcagaaagccagtgaaagcctggcccccgtccggagctgcacggcacctttcctaacgccaggacgcgtggtggctcctgccccgagctgcacggcacctttcctaacgccaggacgcatggttggcaaggacacgggtcagccatggggctcccaggattgacctccaattcctcatctggggaagcccagagcaaatcgaaggatgcatgggaacctcctttggaagtaggacgatcgtcagaaatacaggcaggcccgggtctcaggacgtcgaggatggaaggagcatccgagctgatcctgcccaacctcgaacctgcagggtagaaacagagcccgggaggccaagggggggccctcagcaaagaggacaatgacacgtgagcagagccgacctgacactatgctcctcctgccttcccaggtggccccacgatggagtttcctcgaatttcctgaaaactggccagctgctctgaacgagcctgaagaaggcagctgcacaaacttaagcagccactagtcaagctcacccgctgggcggccccgcctccaccaaactgcacttctgagcctctgtctccatcgctgccctccctccaggccgccgctcagggcacgccgcctccatcgctgccctctctccaggccaccactcagggcgcgctgcgctcagctcacaccaccccgtgcacagctcgtggatgcggtcctcccttttccatgaactctgcactcgcctcccctttgcacttcacaacattaaacttcaacccaacgtccaaggcctgggctacaggtaacagatgccaagaagtcaaccatctttcccggggctggcactgccttcgcgatttgggacgatgtcgcaagagtctgccgtgcgcctccagtgcctgaacaggcagctgcaagtccgtgggcctgagctcagctcctttcccgctcaagtgccacagtgacttctcatctgggtgcccagaagtggggctggctggcacgtgagtcagagatgcagggcaggggtcacacgatgtcagcgcggcctcgtgcctaggccatgaggcctagcggagacgtgcacagacctgcggcaaagctgcagaccggcatcctgcctgaggctcagtgccagaggccagcagaagtttctggcaaaacctgaagggataaagaagtgctgataaaccacccctactgcctctggaatgtttgtgattttatgattttctgcatccaaaatttgtcacatcactgcttctcctatcccacaacctcacgaacatgagattcctcaagtcctgagctagatgctagatacggaacctctgaagcatgactctgtggggagcccaggctacgacacctcaagaacactgcagcctctgcgaacatgaggaagatgagcaggtggcgctcagtacttctctctaaggggcaccagtggcagtgcctggcctcctagcaggcccaacagtctcacgtcctgggaaggttccctcccagccccaaagctccaggcctacctctagctcccagtgcagtgcaccctgggacaggcaggagaaggcagcagagaggagaaccaatgaaggcttctcgcactgcatccctggatgtcccaaccgctccagaaatcaattccaggcatcaacatcggtgtcacccccgcctacgctttaggctagtcccagggggcagcaagggacaaagggcaccaccgggctgtggtcagtcagctttcagccacccaagtgcaaagcctcaaggattttcctacagtgactgctgggcagcttgaaggagcagaagaaaagtggcagtgtgggtacagcccagccacacttccacgtggacccagaagaatcaacggcagccaggttacaaagggaaacctccagctccaccctgctccctactgcagcagggcccatgatggctggacatttgaaaacagaaaactcccagaaccagcacgttacaaagcacttagggacatcaaagcccagctctgcacatgagctctacggaaggagagtttcacctgctcaaacccaatcaggctgtgtggagctcatgccacctaaagaggctgaggaagcctgagacgcaaagtcttcctgctcatcctaatggcaggagcttcctttaactaggactgctgatatattttctccactggctttcatgtacacattatgcaatttgcttaatgactcagtgattatttgatgacagtcaccttcccccaaaccacccgcacctagatcaactgtccacctagatcaatcgttcatctaggtcaactgtccaccgtcaagtcatgaagactctgaggtctgggatgtaagaaggacagcccaaaagagagctcggctggtgggcacagggacctggggcctcgagagcaaagaacaggtggccacagggccagggtggcagtgtgcacttgagggcacctgcccagcgcccaccccagccagtgcgggtctctcctcgcaccagctcgggagggaggggccacccccagcactccacggccatccggggaaggaaagttggcggggctggcgaggacgtctggtgtctataaaaaatgtttctcccaggagggccgctgaaaacagagactctgagatactctcattcttttccttatttgccactctgaaaaataagccgttcttcctattctgaaatggaatacaggtcaaaacctcctacggtgaacagtgacccaaagaaaaagatcactagatccaaaatatttctagtttggccagtggccccaagtaactctgtttatttggttagagcaaagctctcctgggggatgaaacgcctaccccagtacaaagcctgcctgtgtctgcctgggtcccatgaagaaggactgaagggcaggaggctccttgcccctccgcaccccaggaggcccttctgtgttcccaccagggcctgactgtggaagagaacagctgcccgtgccccctgccccgcccctgtccctgccacggctgacatttaggagctctgtcccaagcgtccaccgtggcatgcagagccgccccacaccccgactccctggggcctcggccccccagcaaggccggcttgacaggaaccagtagccagcagaggcctgagcagaacagggtccggagctggcagtggggctcggggccactggttcccaagcagacttcccccacctcacaggcagcttctcctctccagcggcccagcgggatccagcacggactgagggcgggtgaaacgccagctcctgccttcagcacgtggtcactgccctgccctgcctgcaacagcagccaccagagagcgtccgctgggaaccacaacgcgcccgcaccccagcggccatcctcgggtcacgcagcctcatggcttccttcactgccgtggctgagattcctcggcctgcgccatgacggggcctcgcctacgttggaagataggtggttcccccgtgtgctccccagttacacgggttcgaccttcactaaatctttaccgaatccccactccacagtgaccggccttgcacttggcccgaggtcacggtgtgtcatgtttttctgcggaaggaccccacttcagacaagaccaggggtataaaccgcacacgagcagtcagcctccaacaaatgcatctttacaagtcctgtgaggtctgcactccacccactgcacatccacggccacgtccgtttaaacatatttcccaaagagacgcgcaccccaagttagggaagcgccgccctgggataacgaggaccaacaggacaagactgagaggcaggagcacaacccacggcggaaagcacgacaccgggcaggggtctgcaaacgccccgtgcccccttctgaccggccgagggcacctgaacacatccttggctttcagtctttcccgagtgcatcctaaagatgtgagatcgtgagttctagccatggtcccagtagggcaccctcaagacctctggaacctgtgtggtgcttctcacaacagaacagggccgggcacctccttgacactgttcctcaggagaaccagcagcgtgaaggggcctgcggttgcctggggtgggggcagacgtgagcggcacctcgtggctctgtggctcttgttactgaccccacaggcgtgggcagttgcattgcagggaccaaggacacactggctcccctccgctggggacttcctggtcgtgagctatgcccagaggagtcaaaaaggcacaaggggagacaggcctggctccagcccttggggtgcccaaggcactgggtgcccacagcccctcctcgggaaggtgaggtatgggcttgtgacaccccttccttccctcgggagctgaggagaatgggcggtggtggtttactgcatgttcagaaaaggcctccaccctcaccaccctgcgtgagacatgggatctgtgccctcaggaaactcagtccgagaggtggcctcacatgcgcggttgttacaagcagagccaggtaagcgcagaagcctgccaatgtatcttcctggtccctttcggggcaccctttacccacacgccctacttaaaccacttgaaaccctttccagatgagggcaggtgcaaatcgaggaatttatacttcacaagaaaagtacttcccccattgaatatttaaaagagtaactgcacccatctgcatttgaccctgcttcctactcacactttcttcagagcctgccccccagaaatgtgaccccctgttatcagccaggagccccaggaatgggtaaggccccaactttaacttctttcccacttgttcgcttatcagcagcagcccccccgcccccccgctccccaccaccgaccccataccacggcctccaacctcttccccatcttcccccagttaagttcaagacttgggaaaaatagaagcagctgctcttcacaaactactttaaaccttacaacgaagccaaccaaaataactccatagttcaatgtcagctgcagtggggaggagctgcagagttctcttgctggcggccacggggctccctcctgaactcatccaagttagtatttttatcaccaaatcctaagactatcagaaaacatctgaggccgaccaagcaccgtgtgaccttgaggaagtcgcctgaccgctccaggtcatgtgcgaggccttagggtgtgaacagagcacttcccggttccttccacttctacacgctttcattctacaactgaaaaccacacacgaaggtgtgtgtatcatcatgagagagaggccttcagagcccagcagcaacctataataaacagactataaactcagcacagctcatgctttcttcaaaagactgattttaacaggcagaagacataaccgcagctatgaaaacctctcccggcggatactaactacagcatcgtgactcagctgctctgatgctctgataggtgaggtcacctggatactacaggtgttttcacaagaggaaataacccacacgcagggcacggagcgcagactgtgcccctgccacagaccggccttctccccaaagtccctcgttaacccttcacggcaagtctggagtttcccatttccatggccaggacgctgggcttctggcctccttggctgactggacaattacagacagttgagtactgtcttttctgtgaacactagcatgtatttagcttaaaaggatcttctgtgcggcatcttttcagtctagcgagagaatgctttaggccataacaggtgaaaagtgcctcctttcacctgccaccccgttcaagagctgccaaggtacagcaggctctctgctgggcagaagcaggcagccgggtggaacagctagaatctccagcatctgcagacgggcctcagtggggcggtgaggagacggctctcagacctcccagggcacagtccacagggtagcacacaggagggcccgggccaggggcacctggaggaagacggggctcagagaaggagcagctccatctcgtaccctcttgcgcccagccaccgagggggactagacggctttgcaccgacccccacgtttctcccaccctccttgcccctttcaagcctatgtcatgtcaacagcctcctttttggtggtggctcacatctgtaatccctgcactttgggaggctgacgtgggaggatcgcttgagtccaggagttttaggctgcaatgaaccatgatcctgccactacactgcactccagcctgggcgacaggcttgagtatgtcttaaattttttaagacaggctgggaattcatattcacgctgcccttcagagcctcgagggctgcccttgtgcagctcattcaaaacctgcagaaggctggccgctcagtgcaaaacacacaaacaccagaaacagaaagttcacagaaaaggagatgcaaatggcacttaggggtgttcaagctcacgtccagtaagagaaatgcaaattgcaagcgcatcggtacgccacattttcacatacgacagagtgacccaccacgggacaaggctccaggcaaaagccctgaccgtgtctgatggggaccacgcctggttggaccgctcatgagaagcacacttctcttgccccaccaagttagatcttctggagcccagctagtctacacacaggaatttctcctacaggcctacttcacacagccagggacctgtgtactgactatggcactgtcctgtcctgcaggactgaggcagccagggcccagcaagctgcagtgagcggggtcacactgcctgaggtctgtgctggacacacagcagggactggatggaacctatgctcttggggcactcacggagggtgccggccctggctacttcatgcagagccactgctgggttgggaaagatgacaggaagacgagggcaaggggcacaagtccccgtgcagccacattttctgtgggactccccgtccaaatgcagatggccaggcagctggcacagcagaagaacttggggagcagtctggactgcagtcagagatgagtcagtaccatcgaggcgctaatccttcggcgtgggtgggaaaagaggtccaggaaaggaacccagctcccaagagggaggcagaggcagagatgtggtcccagaggaataagcagggcctcagccggccatgaaaccagccaggtgcgcgatggagtcagggcctggggaagaggatgatcggagaaggcggtgccagggaacagtgggcacagaggccagggcgagagcagaaggggcagaggcggggatggcgggggagtgcacactgcactttcgagaaggagtgagaaacagggctgctgcttgggagactcggagccaacaggggttgtacttttgtcctttttagtgaaagacattaaatcctacactgatcaaaaacctaagttccacgccttagttccccttaactcactcaccccttccatctatgacagacagtcatctggagtgaagtctaagagtcacaaagatgttatctcaaccgtggctcagcattcaaacaaggattctaatctttcagggctccagatgggaaacagattgctgagaattatcagttttatttgaagagtgcagagaggcgatttgtacaaatgggtatgactgggttttccttgggcggagaagagccggctggcctgctgagaagctggcttcctactccggtggacgccatgctggaaagggtcagcttcctgtagtaagagaagctaagaggtcaggggccagagggaccttcaggggtcccctgcggctgtggcctctgcagaggggggctcagggaggcctggagtgagggctagagaaagcccatggcccggggtcttccagcccagcccagggagcactccaggtaaggcaaggcctcaccaccctccaagtcctcagcactaggagcccaccaagagccaactctgccctggaggccccggacactggagcgaggtgcccccagccctacagcttcagatcccagatctcagtcccctacaaagcatgcagtccctcacctcagcagggaaaatgagctagcagagaactccaacacccagacatcgccctacaaagaactttaaagaagtaaaaagcaaaaaacatattatgttacattatgctagacagtactatcattatacatcatatgtataattatacatgtccatatataatatatacacgtatgtatgtatatattatacatgatctacatctacggtcatctaacactgcactgtatataaaggaatctattttttttaagtgcgtggtgcacatctggctgtgagctcaccacacgtgcaggtatctgaccccaggctcctctccaggactcctcggcaccggcagaaaggccccaagtgccgcagctccaagcccggccctcccactcaggctgggctcagggttgagaattccacccgccactccaacgctgccaagtcttatctctgccacatttctcaatgtgacattgcacaattcttttggacaaccttgactttccgtggtgctcactgctaattttaactacctgatgtttccccacaaagtaaatatgaggtgttcatgccaccaccatggcagcgttccagtcactctgcaaattcggccagtttcggtcatgacaacgacatgaaacacaacaacccaggcgtgaggacagccacccttgggatttatctccactggggatgaaaccaggccgccctcctccagggctgccaaacacagctcccatgaacgaccaggtcaagcacgttgtccttgggtccagagacagaccaggcagcccacgctgcgtgtggtcttaccctacggtccagagactgcagggatgtggcgggggggcctggggaggatctttcctggacacacataaacaacacctaaattgttttgttttgttttgtttgagactgggtctcactctgtcacccgggctggagtgcagtggtgcgatctcagctcactgtaacctccgcctcctgggctcaagcgattctcctgcctcagccttccaagtagctgggattacaggtgcctgccaccatgccgggctaatttttgtatttttagtagagacggggtttcaccatgttggccaggctggtctcaaactcctgacctcaagtgatccgcccaccttggcctcccaaagtgctgggggtgatccacccacctcagcctcccaaagtgctggaattacaggcatgagccaccgcactggcaaaacactccctaaactgtatacaaaattgcatctatttgcatttttgtgagaacaagtttacagctttcaccacatctccaaaggaatccatgacccagaaaagatagagaaccagcccagtctggagaaagagggctgggggacacacacgcgttcatctaactggccaaaggaatttttgttgtgatgtggttattatcttctcataatttttttttaaatcagtcctcccttttgtagtttacttcagaatttagttgggcaatttaggttcataccaaaacaaaaaagggggggcaaatagaaacaaaggaaaatagattctaagtttaggaaaagctataagtaacagcgcagatcactacagagctattttctgaagctcatcaaacacgtacttggtgatgtcagaaagtaacagtcaaaccacattttctagaactgatccaagaggaatggacaaacgtatgaacgactacaggtaaaactactggcatctgtcaaataaaacaaatcaggcgagcagtggtgtctggagtggagtccctgggtcaatgttactggcgtggcttgccagggcagtgtgagcttgttgtgaaccctctgtataggtgttaactcatgcattttgaaaagtaacccaggacagacccagccaaggaaagactgagctagaaaaaaacagcaaaatactggtttcacatttcataaccaaagcacaggccgtcctccagataaaacgttcatctcatctgcatgttaggttcaaagaagcggctgggacactaccgctcaaccctcagattctggggtctggccaccgcgttggccctcagagctgctgctcctgcgtgcctggtgctgggaggccatgcgctaacttaggtatcacagcacagagaaaccagacctcacggccctactccccgcccctcaccgccctggagctgcctcgaagctgcacacggcagacaagcgggtgtccatgcacaacctggggcaggttctcacaggagaaaacggctcacactcaggagacctgcatacatccccgaccagggcacgcggcattctgggcccgccaatccagctgtgggctcaggccacgtggcacactgggcccactctgggctcaggttcctcagctatgtgggccgacacagacttctgctccctccccaaggctctaagttaccgtaaacttatggccacagctcccacccaacagggaaccacacaaggaggccgtggagcacagagccccgcacgcgcccagggcgggaggctggccaagcacacaggctcctcgggtccctcctcggaaggctgcggcccgctcctgcacccctgctctcttggggggttccagtaacagctccctccgtgtgccccttgggcctggagtggaagcagcagcatgaggcttcacccctccttgctggtgtccctcagccctgcccgaccctcggtccagtccttccactgcctcctctctctctctccttgcaggtgccacttgccgcctggtaacacgaggacctgactgacacagcaactaacatcgctccacaacacacacaggcatacacagtcttcatgggtcactgaaggtgtcagcgacaaaaaccacaccctatcaacgctgatgaagggctggctctaagaagttctccatcagcttgttaacaaatcaagactagaaccatcagccttgaagctggctctaaactgcaggacagatgagtgcgcagatgcctgactctgggacactcaggcaaggggcctacataccccctagggcccagattacaggtcagtcatcggaaatggggattggacacccacatgcatggtgactcgaggacagcaccatcctcccccacccccctactgaggctggatgcgtgggcctacgtaatgcacgccagcagttcactgtgactacagccacctgcttcctcaagcccacaaagtgaaaaagaaaatgcggccgggcgcagtggctcacacctgtaatcccagcactttgggaggctgaggcaggtggatcatgaggtcaggggttcgagaccagcctggccaacatggtgaaaccccatctctactaaaaatacaaaaaactagccaggagtggtggcaggtgcctgtaatcccagctacttgggaggctgaggcaagagaatcactcaaacccagtaggcagagattgcagtgaacccagatcacgccactgcactccagcctgggcaacagaatgagactccgtctcgaagaaaaaaaaagaaaataaaatgcacggcaatggcactgtacaaagtgcagggtggaatccgcaaagttccactgaagacagtgtggcaatgtctgcctttgagcttagcttagagtgttgggacaagggggaaggcatgctcggaaatgcattttctgtgtacaaaacttctctgcaatcaaaaaatggaaacagaccgggagcagtggctcatgcctgtaatcctaacactttgggaggccgaggcgggcagattgcctgaggttgggagtttgaaaccagcctggcaaacatggtgaaaccccgtctctactaaaagtacaaaaatcagctgggcgtggtggtgcacacctgtactcccagctacttgggaggctgaggcacaagaatggcttgaaccttggaggtggaggttgcagtgagccgagatagtgtcgctgcactccagcctgggcaacagagcgagactctatctcaagaaaaaaaaaaagtaaatgtaaaaaaaaaaaatcatccgcggtaaagatctacagaagaaaaagtgagaaaaaatggtttgaacaagggttgagacatctggtttggggattcaggccagctgggagcaaaaagaagacccttgggcacaccacgctgcagaccaggaggacctgagtccgtggcccaggatctctgtagaccagggtctccgtggaccagggtctctgtgtactgttagcatagcactcccccagggccaaccgagggaccctgcctgagcttcctggggacaatgtgccacctgagaaaacccacagcgactggtcagggtggctggacagaagcaggtctcagtcaacgcctgctgtgaatgaacaagccgcatcgggagggaccagtgcgtgcagagggaacgtgcaccggggccagcccctgcctagaagcagagcaggaggtcagcagaggcagccctgaccccagcccccgcctcaccaacccaattccaaggtagcactgcaggcagatggccagtggggacaaggctggcctgaggcttgctgggacacacggtccctgctggtccaaggctgggactgtggagccccatgaggcctccccagagcggtcccctcacagccagttccctgtgagcagtggaactgcaccagcactcctgtggcaggaacggctgtgagctcaacgtggcaacccacgtcccggggaacccatgcatgctaaatgggggccaccagccagcatggcaggagaaacacacatgtgaagacagagggcagcacaagagaggggagcggcggtgctgagccccaggcccagttggtgcgggacccctgggagggaggcaccctgggagggaatcagctcctaagtcaccacttgcagagcccaccaagggccaatgccaaacctaggcctcatctaaccctctgggggctcccagggcactcccaagtggcagcctcagctcgaaggtgaggaaagtgagtcaggaactggcaggtaatggagcattcacacccggcagagtgggggcagcaggttccccaggttctccggggacagtcctcccactggacttcaggagagagctgcgggcaggcctgtctgtcttgggttggcagaggggtgtggacattccagagagggaagtgagaacacacactggacaggaggaagcagcgctgtgtggtcagagaggagctgccacaggctggaggcatgtgagccagggaaggcagcccctgtgggtgaagggaaagcaggagggaagctgggaccacacctgctttatgggtggggccctggggctcagagaaattagagatctgccccaggcccctgagagaggcaccaggatccaatctctgcaggacctcccagtcctggcaggaagagcccaagggcaccaggcggaactcccagggccgccaccttcaagttaggctcagttcctccatgaagatctctctctttttaaaatggagataacagcgcatcacagggctattaacattgaaagtttaagtgttatcaggaactaccgcactcagcaggggacaggtataaggaaatcccttctgcaatgacgtgaaggcatctaagatgcaaagaagctggtctggaacacccacttccacaacacagcacccagggggacgcagaaaacagggtaaacggctccacaagcaactccatctccctgaactgccccacggcagcactgactgaggcccctcgattgaccactcggaacccaacatcagtctgaaaggtctccagaggctggaagcacctgggaaggttaccctggttgagtgaacgtgatgagaaaaaacaacttctcaaggctgaaggccttgagtgccccagcagccagcagccctgcaccgcccaggatggtgcggagctcatctcgtaaggtcagaggctccctggctttggtgctggagcccttgcccctctggcacaaagggacaaggtgtccacagcccggggtcagcccgacaagaccaccatccaagcctggcccctaggaaacaggcttccagcctgggcaacatggtgagaccctccctatataaaaatatttaaaattagcagggcacagtggctgacgcctgtaatccaacactttgggaggctgtggtgggcggatcacaggaagccaggagtttgagaccagcctggccaacacagtgaaacctggtccgtgctaaaaatacaaaaattagccagacatggtggttcatacctgcaatcccagctactcaggaggctgaggcacgagaatcgcttcaatccaggaggcagaggttgcagtgagttgaagtgcagttgcccactgcactttagcctgggcaacagagtgagaccctgtttcaaaaaacagtaataaattagccgggcatggtggcacacgcctgtagtcccagctactcaggaggctgaggcaggaagatggcttcagcccaggaattcaagctgtagtgagctatgattgcactgctgcactccagcctgggtgacagagcaagacctcatttcttaaaaaaaaaaaaaaaaaaattaaaattaaaattaaaattaaaaaaaaaaagaaggccaggcgtggtggctcacgccagtaatcctagcactttgggaggctggggtgggtggatcacctgaggttaggaattcaagaccagcctggccaacatggtgaaaccccatccctattaaaaatacaaaaattagctgggtgtggtggcgcacacctgtggtcccagctactcaggaggctgaggcaggagaatcgcttgtacccacgaggcagaggttgcagtgagccgagatcatgccactatactccagcctgggtgacacagcgagactccattgccaaaaaaaaaaaaaaaaaaaaagtggagggaaagaccctcacgccctttatcatatgaagacagagcaagaaggggcgatgtttgaaccaagaaatgggtcctcaggagacaccaacctgcctgtgccttgttcttggccttccagcctccagaacttgagaaagaaatctttgttgttgcaaagccacctggtctacggtacgtgtttgaagcagtctgaccaccctaagttactgagtcccccccaggtttgccacactgaaccagaaacaccagtgagggccttgggaggagggtcagaaactgcttcctctggttcttctctacaccatccacttggtgcttcaggaagcacaggcagctccctggctgccttcccctctgagttattaaagccaaatgcaacagggctccaccaagaagaggcgggcacccggtgggcgccgggcactctgcctggcaatgcggcaagtggatgctggcgggggaggtaggcctggggtccacgcctaaggcccgctaagccgaagcagaactgtgtgggcaaaaataaatccccagatggacaaggctctgaggggatcaggagaaaatccacatggaaatgtttaaaatctatttcccagaaccctatcatcaccaggcagaaaccacagcctgcatttacagggcttccaggctctcccacagacccagaaaacttaatcaaaaacctatctgaactttacaaccacaaactggcaccagccacgggcccttatcagcacacagcctggctgctgcagagatggcacgaactgtcaggaaccaacccgggactgacagcccggccagtggccatgccacacacagcctgcacctgtggactttccatttgcagagatctaggaaatggcaaaatgctttcttctttttgcatagatttttgaattagcaaaactgccactggctagttcacttgttgaaaaaaactgttccaattttattttaaatttgattagctttaaacattacctcatttcatttcaggaaaagttagcaagatttttctcacacacagccacagtattaaagagaaggacatgacacccaaaattgcaaaaaaaaaaacaaaaaaccttctccatgtgactgttcacccagcttctcactccagctgtggatggtgggccacagcgctgcccgggaggcccacctgctgtgcgacagccctgcggcaagcccgactggcccaccatcccccgtgtccacactccccaggctctttctgcaaagcccttcccttcatcccacaggccatgtcctttaaaactcagttcaaagactagtgagagtcaacagaattgctaacgggtgatgaatctggggataacacgattacactattttcactacttttaggcatgtctcaaaacaaccacagtaagaagtttttaagaagaacattctgtttctttcaaggactacctgctcagacgttttccgcacccagccatgggtcagatgccctcctcggggttcccaggcctgccccatcaccctggccagatggctgtcttctcaggcacctgccttgagcctggcactgagcagccacctggggaccatctccagaatggaacataccacagcaggcccagtcccctgctagctcacagtctgagcctagtgacagtgcccaacaagagggcaaaattgggcaccaaaggctcaacccagcaagccaagtggccaacccgaaagaaacaaggaaacaaattggagcggcagcacctcctccctgacctccgcaggagccagggagccaacccagagggcagtgccagctgggcacagctgcccatacctgtggcagccaggagtccttccttccaagctcttggccagggaggaggggtgtgggaactagcatgctgcgtgggccaacagcagggctggccacagagccccctccagcagcagctacctggcatggggagtgaccgcaaaggtgcctcaaagtcgaatccaaggcatggagggcactgctgcatttctccacgcagaagacaaacggcacttttcagtggggggtggggggagctgatgagcagtgcgacccagtggcccacaactgcactaggccggccgtatccggtggctcctctccctcaccagtgcccccaccaggcgctgctccagaggtcccagctgggcgcccggcacggatgcagatgccgcactgtctagcagcgtgagtgctgctgtgaccccttctcaggcgcttactgagtgctggagacagaaacccctcacacaccctggttaccacacggaagcagaagctccgagcactgggtggcttctggaaggtcacaaagccaaggagggcccagcccggactataaactctccctgcaccccacccacaacgaggacgccaggcttcatgatgtttctacggaaggagaaagcggacggggagccccgtgcctttaagaattaaaaacactctcgacacctcaatagttcagtagtggactagacatgttttcaacagccttgatattcccttcggcttacctagggagacacctgtcacactagagacaccagctccaggctgcaagtccataacaagaccacctgagctgtgggtgtcgttctcgccaccaaatcagagctgcccttcaaatgggcacggttagggacagcagagcggccgtggccgcagccccgggatccggcttcatccagcagagggtggtggtgcgcaggccctgatgggggaggacttccacactccaagcttttaatgccgttttacgtaagcaacacgaaaaaaaccactagcagttattctagtactcctggctgggagcggatttgcatactgaagtaaagcctcaggttagggcaggaatttctagaaccagctggactctgctgtacctgttcttcttcagcagccaaaacgtttctcaaagtcttttaagagactgaaacattgatttcagtattaatacccaaaataccacgaaaatataaggatttgctgctttggagaagggaccaatggaggatcccctttccagggtgatttaatccggttctgtgggggtaattaggggctggcctgtcttcctggtcccgttcttcactgtttaaaccgcaggattcctagaacacgaccgtggaactgctcttctcctcacccatccctggaatgaaggcactggccccatgatctgacgacatcatcgcctccccaaatagctgcatggccgaattggaagtgacgcattcttagtggactcctaatggccagccctgaggacagaagacaggttaaaacttcagccggacccacattaccgattccacagagttgggcgagtagcctgctttcctccaacaaagctgggagacaccagagaccccaggtccgtcaaatctcctcttatgtcataaaaccatcacacaacgcaaagttctactgctctcagtcctcagcgtgctgtttctgagtgggatgggaagtggtggttttttggttactaaactgattttcttaccaaatttcattaggtctaaaggctaaaaatagtaaatctttctactttttgagcatctccagatttgagcaaattctcagggatgccaagtgtcaacgccccggaccagcctcatctggttctcgggcagaggcccaccttcccaacccaccccatggccctgatcctaatggcaacctgatggcctgagaccagctgcctcgctccggaacaggcacagcgatgccctgtgcaggaagaagggcggagcagggtgaccagattcctgccaggcaaaaacctctagcaaatctaaagtctggccatgtcagtcttctctgcttctaacacacctttctgtcaaattaaaatttaacccgaggcacaattccactgtcttacattttagcccaaccagatgaaaatgccgcagcgtgcttactcgtgaaatggttcatcttctgccctttaacactgcgcatttagaaaacaggcaattaaatagtaaagcttaacatggagcagcacggaccccgtgactcgacgaagtggcgtggaccttacccgtggaccaagtgtgcgaacacagcacagcaagcgccccgtgcaaacacaggagcatcctgaggggcctccggtgtggggaactcagagagccgcaaggtccccacaaacgcctgcctaaaactggactgcctgagaagctgctgtggagaaagtcccggtgcccagggagcccccacctccagcctgcctgccccgcctagacaagaggaaggcactcttcccagggaacgttccagcaacagagatgtacccggtaccagggacagttcaattatccctttaattaaggcaccttaaacgggccccaccccccagctctttgagacctccttccggtgtattttgtgcatttagtaattgtttatcaagatcaatgatatttatgtttctgtgatcaattctgtactgataattacaatgacataaaacattcttctggatgttaacatagcctaatgatcacagaaatgttttaaattgcaatatatacttttgtcacagagaagtatggagaacagtccataggtcgggtgcagtggctcatgcctgtaatctcagcactctgggagcctgaggcaggagggagggtcgcttgaggccaggagttcatgaccggcctgggcaacatggtgaaactctgtctctgccaaaaatacaaagaaaaattagctgggcataagcccagctacctggagggtggaggtgggaggatcacttgagccggggaggtcgaggctgcagtgagccatgatctcaccactggactccagcctgggggacagaatgagaccctatctcaaaaaaaaaaaaaaaaaaaaaaaaaaaatcctgggcaactcagtgagaccccatctctgcaaaaaataaaaataaaaactagctgggcatgatagcatacacctgtggtcccagctactcaggaggctggagagagagaattgcatagacctaggtggtcaaggctgtagcgagccctgatcccaccactgcactccagcctgggtgacagagggaaacactgtctcaaaaaagaaaaaaaagaatgagggatgaaaagactttcaaatggagcaaacatacaagttcacaaagaaaaaaactgccttgtcaagactgttaagaacaatttgttcattttttaaaagggtgactgatggtaggtatcattaggatatttaacattggatactttttaaaaagcaatacaatggttacttttaaatgccaacattatactagaaattgcatcttttgcagttgtttcaaattaggaccaaaaatttaaacatcaacttaaaaatgtgtctatagtttttcaaagttttttttgttttttagatggagacagaggcttgctctttcgctcaggctggagtgaagtggcgcaatcttggctcactgcaacctccacgccactcaccatcaccaccaccaccaccaccacccccatccccgctgccctccctccccccgaccccacccctgcccccaggttcaagccattcttgtgctttagcctcctaagtagctgggattataggcgtgcaccaccacacttggctaatttttgtatttttagtagagatggttttgccatgttggccaggctggtctcgaactcctgacgtcaggtgatccactcaccttggcctcccaaagagctaggattacaggcatgagccaccgcggcaggcgtaaagttattttacagaacacataagcaaaaatgttttcaggcctttgcttgacagcaatgtaactctaaaacattcctaattcattcatcactgacagtgaaaaagctgcctctacgatactcaggcagtccccctcgcctcgtgtctaacatgctcttaatatgcgatttcatctccagcgtggagatgtcaaacccctcccctcaaaaaacttacaaaatattcccttcccatatacaccaaaccaaaaaccatgctcttgaataaatgtatttccctaaaatgatgactacattgttggtgataaggaacttattttctgttttttcttattttcttgttttctggccttacaatgtctttttttttttttttttttgagacagggtctcactctgttgccccagctggagtgcagtgtgggtgtgatctcccctcactgcagcctggacctcctgagctccagcaatcctcccgcctcagcctctcgagtagttgggaccactgatgtgagacaccgcatccggctaatttttttgtatttatagagacagggttttgccatgttgtccatgctggtctcaaactcctgggctcaggcaatctgcccgcctcagccgcctaaagtgctgggactataggcacgtgccatcgtgcccggctaatttttgttttttttttttttttggacaggtggggttttgccgtgttgctcaggctggcctggaactcctggactcaagcgatcctcctgcctcagcctccaagagtgctgggattgcaggaacgagcctctgtgcccagcctgagtgatttcctaaaattgtgcaataagggtcatatataaaagtataatgaccaccacacctgaccaggtaagcactgtgttgatccctctttattatctattctaagggtttgctatgcatttttcactcaagattttcctttctttgaaataggaaaaatttggttgccagtcaattcagatggctccaggatttcaaggcagaaccccaagagaaaccttggggcaaactacaaaaactcagagcaagtagcataacagaaccccaggttggaagggacttttcaatgcagcaaattaagcacctctgggccagagttcaggaatgcagtttcctctcactgccagcaaaatccttcaacaggtttaggaggatgaaagtaccgagacccaggtctgaacaatacctccctcactggggcctgggcccagtagaggtgggagggtgagatggccaagctcaatgacttgaaaggttacgcaaatcccttcagctgcctcaggatcccactctggactggctggcacccttattcctgcactggggacaaaatgcccagcactattcccccccgcggctcccgacagactctgagagtgaacttgtgttctggagccctcactagacaggaaggtgggccttgggatgaccctcaaaataatgcagctacagcccagcccctctaacttaagagaaatcccaccagctgcggtagtatgaacctataacccagcagctacttgggaagctggggcaggaggatcacttgagcctaggggttcaagacctgcttgggcaacacagtgagaccccctgactcttaaatacacacacacacacacgcaaaggagagagactataatgccagcacttcgggaggcccaggcaggcagatcacttgaggtcaggagttcaagaccagcctggccaacatggtgaaaccccatttctactaaaaatacaaaaattatctgggcatggtgatgtgcacctgtagtcctagctattcgggaggcggaggcaaaagaatcgcttgaacctgggaggtggatgctgcagtgaaccaagatcgcaccactgcactccagcctgggtgacagagtaagactgtctcaaaaaaaaaaaaaaaaagggggggagagagagaacttcctctccctctcacctgaagtccccaagctacacagcagctgagccaaagagaactcagagcccttctctccatcatcagggttttgtgctatttcccgcaatctaaccagtcgcactcaacaaatgacccctaccaagtgtcccgtcttcctggggcaataacacccacgtcgtctgaggtgggaacaacagcaacccatccacggctctcaaagggccactctatcagggatatgaaacactaagtgggttatgcggctgccctctaagtctgtggatgtttttaatcttcttaaaatgcctcctccaaaagtcacttgccaaggaggccacttcgtaaacactatgctgtttctcctgtcacctccacccaaatggcaaggggttgaaaatgacaatatgacctgttaagcttccctttcggcaggccctctcctgattcagggtagagaagattcatttccacgaacattaaagaggtctcccggtcctctgaaagtgcctgatttcacaaaagcttagcatttgatactcgggggaaaaggccactagaagcacattttgaaagtttcacatttaaaaagatccttgttcattgattttggtggggtaattaagctaatctaaacaaggggaccttgtctaggagccggtgggggaggtgcagccgctcaggtcctctgcatgaaaacccactgcagacgcctgcttttggggtcctctcaccccttcctttctacaaggctgctcttcggctgggaggtttgctccctctggtcaaatctgtttcctggctcaggtggagacaacccttctgatggtgtttcactaagtgcgccttcgtcagcataatcacgcagtgatgaaaacctggggaacctaggaggccagcgaggaacagtcctcacccatcattagcaggaacgcggcttccagcatattctgcctccacaaattacagacacgactctgccaggggtgttcccaagaagggcactggcaatttggggttgtctgccacctacagtgcttgtcagtcaccctcactcggtgccaggccacaaggctgttggtcacaaaccaccccagccagccactgggcgtcaggaccctcgggaagagcgggagagggcactgggatgcaccacggtcagaacgacaatcacagcccgaacccctgcgctgcactcctctgtcctccccacctctctcctgacaacacagatacaatccattcaccaccaagcaacctcaagattggctgaaataccttcctcggctcctttcctccatcgggaaagtggggagctgccgctgccgcagccctctccttccctgcagatctgcggggcgggctggggcgggatctcagagctcacggaaaggaggcagaatccggtttacaggcttgctccgcccctcccccacccccctccaataagcaaagttagagggtgttacaagctgcaagacacacaccttggagctcacccagtccaatctctgatctgctttcacgatgcgacaagggccaaagctgcagcacgcatctcggcagggcagcaggccactccccccacgaggcccgggaggtggccctgggcagcctccccactccccgccctgtgaacacctgggccaaaaaaacacacctttaaatacccagtgtgtatttcaaacacatttcaaacgatttgcttctttcctttacagccactgccacaaaaacaattagcctgaacgggtgtgaaatccttgatgtgtaagacgacctagttccccagcctctctctagaaacacatgagttctttactgcgcctgagtctcctccacccggaacctgcagggctgcctcttctcatcaagtggcttctgcaaaacctctcccaagcatttaaataatctctgctcgttcttttaacaataattcaaacctagcagaaaagtgaggacactatacatttcttttaaggacagtgtgtgttacctgctctgatccccatgtgttacactccctaacctgtacaccaatactccagctttttgttttcttattttttcctaaagccagcacaaaataacagaaggataagattcctaccacattctacctgtctgccaatgacacaggaaggatgagaccgtctggggaatggaagcgcagggcgctctcagtaatgctgggcagatgcagtggcttttccccagcagaaatgggcttcgattcagaatctaccagcccacaagaatcatctgaccccacaacaattagttcaatcactcatctggtaaaccctcctcgctccgggtcatagactggaaaagacagcccccaaaacagtaataaaaacgacaagccctgttttgctggagtcagctgaggtatcagatgggggtcagtggctaggtctgtgaacctgaagccacactccatcagtgacccgcactggagagacacaaacacctcaggctccttaggaggtcaagcggcccttcccagccctccctagcccccgccttctagaatcattctgaatagctaaccaggaggctgggccccgtgtggatccgcctccgctggaaaagccgctgctggaagtgctccaatccagagcaggatacctgggggaggaacgggttaagcgcaaaggggaaaggggcagcgggtgctgagacgcagaaggtgcggggacttctacagagcagggaatctgggcccggatgaactgatgccctggcctctttcctccagggacaaggtcggtctcaggaaatcaaggtatcttcaaagggacacaagggagcgcagtgccgatgagaccggggcagagccacagtctggcggtgcaggctgggggtccgaggcgggggacactggctagcagtgctgccagggtcgtgtgtgcactgggcagagggaaaggaggggaagaagggaaggggaagaaggggaagaagggagtgtgttcggttgggaggaccggtccagacagaggggagagggggccacttcgcgagtggtgtatcgctggttgaattctcataagttagagatagcaggcaggggttagaaggacaagacagggtcaggaccaggagttagaggcgccaggctcctctctgggtagagaaaccgaggaactgggggcggggaggactgatgggtgcgaaagcgggccgggtccaaatgaaggcgcgcgccccggggtgggggccggggtggggggaatgagggaggctgcagggctggggaccagggcaggtgcaatccggaaagaggaggcgggaaggaattggggggccctgaggagccagcgcaagccgggtgggggcacgtcccctcccccggagaaggtgcggggctggggctgcggcgcggacccgacctggaggccgaggctgtgcgggaggtgggggtggggaggctgcaggtgcccggcgcccaggtgcgaggtgcagggggcggcggggcaggcggctgcgggcggcaggccactcacctgtctcctccggccggggccgcgggggcggcggggcggccgggccgggccgggcaggggctacgggggcgcggagccccgggcgcaccggggtcgggaggcggctgcgggtccgggcgggggctgctccctcggccggccggccgggcggtcagtcagcgacgcgggcgcggagagagcgctgcgaggctgcggccggcgcgcggagacaacgccgctttatcgggtcggaaacagccgctccgcgccgcttccgctgacgcagcgccggcccctgcgcctcatgactatgcagcacccgccgccgcgggacggggattcggggggcggggtctgcgccgcgcgcgctcattggcctccgctgccgcccaccccgcccccgaacggccgccccgcccccgccgcgcccctgccccgcccccgcgcgcaccgtggctcccgcccccgtctcgccatggccccgcccccagccataatccagccccgcccccgccctcctcccgctacgcccccggccccggccccggccccggcccctccgcaccgagcgtccgccctctctcccctaaagcgctggcccgcaatccaccccatccctctctgcagccgcaggaggtggcccccgcctgtccccaccttctctccccgctcctctcgccactctgtcgcagaggggtccggctagccacgaggccccggcccccggcagcccagccccttggcaagcaccctcccgccccctccgcccctgcccgtggcgcggcgacatgggccccatccaggtgctgcagcccctcctccgctgcaggagaaaactctcctgttttcccctccctgccaccctccgaagacctcctacctggtcccggaccacgcccccgtccccaactcccccaacgccccgcgctctgcgggtcccctctccaacctggagagcggggcaggacgaagacccgacccggagcttcctggaggctgggcctccctctcaggcttggccctggccagggacactgatccgtctctccccacgtgtagaagggccacaatccctagggcaggactgctgggaaaccccatcaagacaaggtctggggaggcggctttaacagacagatgtgatgggctgaggccaaccctgttaacgtcgcagccctgcacccttgccagggtttaagttgctttggaggaattacttcatttctcagaaccttggcgtcctcatctgtaaaatagaaatcgtaagatccatctcacctgttgctaaaggaatttagaagtgaagtgcagagcagagcctccaagagcatcggaaatgggaaaatctgaccatatcaagtgttgacaaggaaatggagcaactggaactgccagacactgttggtggacatgcaaagtggtacaactttcaaaatctttttgaaaggccttgattacccagcaattctgctcctagatacacacctaacattgtgtttctgttgatagcagcagtgtttataattgccccaaactggaaactactgaaatgctcatcagccgttaaatggatacataaattgtgatatattcacacagtggaatgacagcaatgacagtgaataatcaactacacacaacaacatggatgactctcacaaatgatgttgaggaaaagaagccagaggataaaaagccatatttgtttccatgtggataaagtggtagaaggtgtatatgggggtagcagtcaggatagtggttacccttggagggaggggtgccagagccaggaagcagggcacagaggacgtgtctgggggctggctgtgttctgtgtcttggtctgagtgctggttacagtgtgctcagtttatgatgacttttccagctgtgcagtcaagatgcatgtgcctgtggggcacggtgattcacgcctgtaattctaacactttggaaggccaaagcgggtggattgcttgagcccaggagtttgagaccagcctgagcaacatggtaagaccctatctctattaaaaaaaaaaaaagacgtgtgtgtttttccatgtgtatgcagtatctcaacagagggttagtaagtacatcaatggtctgtagacagtccaaagcagcatcagacacatcatgagtgctcaaactgtacatctgcttccctggtgatttttctttcaatggccaaaggatagaggcagcggcaattccaggtgtgctgtgagccaactgtgtgagcctgggcgcctacttaacctccctgagtcctcttctataagtgagcattctaatagtacctagttcacaagttgtcctgaagcttaaacaaaatagcaaaatgatgctttttaaaatgacaatacaatcaagaggacagaacaggtaaagactttgtttattcacaaattgctggtattgattgaattgtcttcattgtcattcatgcagtaaccaactactgagtgtgtgcctactatgtgccacacgctttgctgggtcctagtactggagctgggaacatgatcccatctctcttcttaaggagtgcattgtggggtatgtaccagccatggtagccatggagcccagtctaggatcagccttgtagtaggtgctccataagtatttcttggggctgggcatggtggtggctcatgcctgtaatcccagcaccttgggaggccgaggtgggtggattgcttgagctcaagagttctagaccagcctgggtaacatggcgaaaccccatctctattaaaaatacaaaaattagctgattggggcagtgtgcatctgtgggcccagctacttgggaggctgaggcgggagaatcacttgaacctggcaggcagaggttgcagtaagctgagatcgcaccactgcgctccagcctgggcaatagaatgagaccccatctcaaaaaaaaaaaaaaaaaagcctctaaaagagtaactgaatgcaagtatagaagtataggcaccagcctagcaacatagctaggccccatctctacaaagaattcaaaaattagctgggtgtggtggcacatgcctgtaatctcagccctcagaaggctgaggcaggaggatcacttgagcctgggagttcaaagctacagtgagctatgattgcaccactgtgctccagcctggatgacagagcaagaccctgtctcaaaaaaaaaaaaaaagaatgtaagtgtaggcatgaagtttcttgtgaatgaaacttagaaggcagtttctaagcctgagatgtggaaacccaactaatttacttctataacctggagttaaacacagagaccagagtaaagttaagaaaaaatatatccccattgtgcaagcacctcaacaagtgtgtgtgcatgcgtgtgtgcatatgtgtgtgtgcatacgtgtgtgcatgtgtgtgcatgtttgcatgtgcgtgtgtgcatgtgtgtgtgtgtgcgtgtgcatgtgtgcgtgtgcatgcctatgcaagagggcagtggcagggccaccctgcagcactccttcccagcctacccggccagggccttatattacctgccaccaccaagaagggtgatatgtgtcagtggcctgtggccccattgtccagctgcccatggaagccggggaatggaatcctcagggcccccacacatctttgccccactccaccccctccttaaatggctggctccccagtcctgtgaggagagagcttgatacggggaagccctcttgcccaggggtcagaaagacacggactctggcctggctctgaagcaggcgtgcctgggcccttagctgtcatgggtgtgtgacctgtgtagtcacacatacccagtgctcagaatagctccacgcttggcttagcgctctgctgttgccatctttaaatgcttcacagcttttaagaagggccccacaaatgctgtggcaaatcctgcatctttgtgagcatgacaacctccccgatgctgggacgagtccagggcgtggtgcctccatcactgcttaggttccaaccttgtcttctccgtgcctcacctggggatgccttggagcagggccaggcccctctcatccccagcgctcatgtgtgcacaccttcctgtgagatgggtgtcatcctgcagaggaggaagctgcgacacaggttgttggtacctgtagccgcacagctggtaggcgatagagccgggatttatacctgggtcatatctggttaggtgttaggtgaacaggctgactgattgaatgaatgaatgaatgaatgacgtccgtgaacacacccatcttactattgctgggcatcattcccttcctctcctctgtgcctcgtaaatgaagaggaaagagcctgtttggtgcaaaacgtccacatcccacaaacaggctgtgacctgctctgagccagaggccagctggtgacctggtatggacagctcctaccttggttgaaaagacaagactgccctctttggaccttgtggagaacacactgggccatgggagagaggtagaaggtgctccgcacaacaggtaaatcaggagagaaggagaaggaatgaaggccactcagacttctccagcccctgccctcagcttccctggccctctgtcagcctttccattgcacagacgaacaaaccaaggctcagaggtagcgtgacttgcctgagcagcctctcttcctaggaaaagcaggagggcttccgggcaggaagcccccacggaggtggaggctagagggctggtgaggcatgcgggtgccagtagagcccgcgggtgccagtagagcccgcgggcgccaggagctccacattcctggcaggcctggcaggtcccccctcccctggctctctcctctgtcacaccaggtgactgtccgtgccacccttttgagcccatccccagacctttgcatctgccattttctcttctgggagtgtccctggtgctctcctgccatgaggaagtgtccgagagcaacaaccattgatcccagtttgaaaggaaagggagggaggtggtacatatggaagccctccctgaactggctccaattttactatgattcaaacaacaacccgcctttaaccaagggcctgctgtgctccagctgccctcaacccctgcccagcttccttagagaatggaggcacaggattctctccagagaccacagcctacacagcggtggggtgggggcggcaagtaggtgggccctgaagagggaggaaagagaggggatgagctgaagcagtgtcccagccagacagtcccttagtgacacctcctgtgctccttcacaaatcttttatcttttcaaagcaacaaacacgtttttaaacaaactcgttcacaaaaccccaatatgtcaattagcacgctcatgtatcaccaggtgttcctaagacactgccccgcttggctctcgtgcttagggcgctgatgttcaggctgtgtctactcaccctgccagcgtccttccgcctgctccgccccttccccaggagcagcctctgcttaggtgaggctaagagcgcaggagcagagttctagcttactgtgtgaccttggagaaaatacctaatctctgtgagccccaaggcaaaatgaagagggtgtgagctccacagagggtaggggccaaagccctgggatgcaggtgagtaggtccacaacccgcaggtcttggatctcaattgcccaggaggggacccgagaccctaaagaccatgtgcctgcccagtgtcctgggcagccaagggctttcagagcagccccagggccgggacacgaatccaggtcggaacctccaggtacctgaattggctccagagcaatgggcttctggggtcccacggcttctcttcctggggtcatatggctgcccggtgtcatatggccaccaaggggccatgtggcatcctatgatcgtgagcttcttggggtctcatggctacctgaaccatgcgattgcccacggtcacaatcgctaggagtcacacagctacctgacgatggagtgatttagccactcggggtcataccccaggtcacatggacacctggggccacacggctccccatactggtgtgtctcattggaagttcaatgcaatccaggccattccactgcttctgtgtcctgggtgagccccatcccctccctgagcctcagtttcctcatcagtgaggtggacagaatctttgtttctctagcacaaaggactgtatgagaggattatgtgaggaaatgacagtgcagggcccagcggaggtcattgactaggaagagctcatcagtgaccacagtgccaggaaagggcagctgcccaggactggctgtggccgtcagcacgacgctggccctccaggcctgggcagaacctgaagattccccagaagagactgaggcaggttttcactgaagggccttccccacatgggcccgccctgggcaaaggccgggtttcagaagcacgagaggggtgaggggctgggacaggctccacgcccgcccggcagcaggatgtgcacgcttgcagctctgcgatgcctttctctgtagctgtcttatatcccacaatgaaacctgtaaaataagtcaacacgatcagacaccgactttgtccaggtttgagggcctcagcacttgacctctttcctggggacgtcttcgagcggccagatgggggtcttaaagagctccttgaggcccgtgtgtggggcatatggggtggggctgagaaattggatctagagcctagtggggcagtggctggctagtgcttgttcagctgggctggtcagggcccagataatgatgcggatcagttaccacagggctccaaagccagctgggcccccgcctgatcaaagtaatctcgtgttgacagcagccctgcgctgggtgccattagattccccatctgctagaagaggaaactgaggcacagagaggggaggtagctggcctagggtcacgtatcgagtcagtgactgtgccagggtttgaacccaggccatctggctctgagtcctcgtgcccccttccacaaggtcacagggcctgccaggggctcctagactgtcagagtgtggagtggttgctgcatctgctggcatctctagcccacctgtcaggatggggaggaggggcagggcccagtacaggggctggcactggagccatagccatgaaccaaatgaccagggtgacctggaaaggaagcagggaggcagccacccagggcggccagcagggtggagcatctggcacggcttctcacagtgaagggtaaaggcaggtgatgtctggggtcaccccacccaggacccctgcggcaggccccacctgctgatggcaccagggcagggcggaacccagggtaagcctccctcccagacatcccctccaggccgtggtcctcagcccagcttcgtctctggactcccacccctgcccctgcttagtcagcagcctcctaagccctctgggttggctctcccttttcctgcgtttgcttacactgctcatcctgccggtagtgcccaccatttcccttgggtctgcctgtcccatgtgtcctcctccaggaaaccctcccagaccaccccagctctcaataattcctgcctcccccagcacatagcaaaaataaggcccacctaggctttaagtcctgaatcatcatttaaagaaccgcctatactttacaacgtgcttgtcctgtccacagtctcattggagcctctgagcagccctgtggagtcagttctggtctccccttacagatgggggcctaaaaggtgagggcaggaccagagctcacctggggtgtcactgcaccagtagttaatactcactgagacctacctgggtgccaaagcctggcctatgtgatttctaatcattcattcgttcattcactcattcactaaacattgactgagcacctgctctgctccaggcactctgacatagatgctagggaggccacacctcctggaatctgcatcccagctgagagacagccaaggagcaaggaagcaagtgacatgcagtaagccggccagcgatagctgctgtggaaatgcggggaagggggcaggcagagtcccccttgaaggggactttgaggaagggcctgaaggaagagagggaacgggcagaggagttagcttcatctctcagtgggagttagacaccccctaccccacgatcaggcacagtagggctgccctcagccaccttgctgcagttctcctggccctgccagccagcccccttccagcaccagctgccttcgaccctctgccctcaactgtgagcactatgtgggtgggctctagcccaccctgtccgtccctgggtccctggtacacagttcacaacttgcaaaggaacggacgagaaaggagtgaatgagagagcgtgactggcctggctcccagctgcatcttgtctagggtacaggtgggtgcaggaatgtgccctcccctaggaggaggccctgtaggaaacggcacaccctggagaaactagtggaaatgaggcgcatcctggttctgatgctttcctgttcacccacgggctcacacactcctgcgttcatgcacgcatgcattcattcatgcatcctcccgttctggaagaagcacaggtggtcagggtcccgtggagtgtgaagcagaacggataaagtccctgctctcaagggcgttacatccaaggacatagcaataaatacatagtggaagaccaggtggtactaaatacacaaagagggcagagcaaggagggtgttgctatggatagcaggtggccagcaaagcccccccgagtggggtacgggaaccccaggagggtctgagcagaggagggactcagggatctcgatgttttaaaaaggctcaggctgctgctgagggtggctggagggcacaggacgtgggaagcttcttgacaattcagggagctgatggctgcaggcagggtgttggcagtggaggagccgtggccggattcttggtaaacactgaagctgcagggcggaatcactggagggctgggagtaggatgcggctgtaaaagcttgcataagcctcctgaagcctcagttttctcgcctgtgaagtggggtgctagtacctcactgccaaggctctagtgagaagaagccagggaaaatgtgggagtgaagccagccctcgttggctcagcaaagcctcaatggggccccattcatgctgggcactggtctaggcgtgggtacacaataccccacaggcgcttaacaaatagtggttttggctgggcatggtggctcatgcctgtaatctcaacacttgggagggcaaggtgggaagatcaactgaagcctgggcaacatagtgagaccctgtctctacagaaaatttttaaaatttgccaggcatggtggcacccacctatagtcccagctactccagaaagtgaggagggaagatcacttgagctcgagagtttgaggctgcagtgagccagtggtaatcccaccactttggcaagccgaggtgggcaaatcacttgagcctgaaagttcaagacaagccaacatggtgaaaccctgtccctactaaaaatacaaaaaattagctgggcatagtggtgcgcttgtagtcccagctactagggaggctgaggtgggagaatcacctgagcctgggaagttgaggctgcagtgagatgagactgcaccactacactccagcctgagccatgggagtgaaaccctgactcaaaagaaaatagaaagaaaaagggaggtgggagagagcaatgctaaagccagaggcaactggggccacagtgactgggtgcggcagggcatcctgggtcaagggtggcagcctgttagacagctgcccatggcagggttgctactgtctggccctgtggtgggagagcccaatagaagttgcccggggtgcctgaggtccggagccaggaacgcaggctgcagagagggctgaccccatttcccgaggcagtggtgccaggaggcctgttttccagggtgtttactgggctctccggctccaaggagctctgagtatttgggctgagtgcccggggtcagcccctcgacagcacgctgggaggtgggggtggctgtgctgatgccaccctgggccagtggagaagggtggaggcagcagactgcccggcaacccatgagtgggaggggaggctccaccctccttaaccacagcctgagcagccacttcccaggcccacctctgatttgggtggagctgagctgggagcacttttccaggctacctagtgagggaggggcacagcagatagcaaaggggtcacgattcagtcaacagggtcaggctcagccgggaagcgaataggatcagggcttagtgggtaaaatgagagccagtgctaagtcgagggaaggatcatggtttaacatataaccagggtcagggattaatgtccaagcaaggtcagggctcagtctgtgaccaggatcagggctctgtgtgtgactaggatcagggctcaaaatgtgaccagggtcggaactcagtgtgtgaccacgatcaggactcaaagtatgaccaggatcagggttcagtgtgtgaccagggctagggctcagtgtgtgaccaggatcagggctcagagtgtgactagaatcagggctcagaatgtgaccaggatcagggctcagagtgtgaccagaatcagggctcagaatgtgaccagggtcagaactcagcatgtgaccaggatcaggactcaatgtatgaccaggatcagggttcagtgtgtgaccagggccagggctcagaatgtgaccagggtcagggttcagtgtgtgaccaggatcagggctcagaatgtgaccagggtcagggctcagagtatgaccaggatcagggctctgtgtgtgaccaggatcagggattagagtgtgaccagggtcagggctcagcatgtgaccagggtcagagctcagcgtgtgaccagggtcagggctcagagtatgaccaggatcaggactcagtgtgctacgaggatcagggctcagagtgtgaccagggtcaggggtcagagtgtgaccagggtcaggggtcagagtgtgaccagggtcagggctcagagtttgaccaggatcagggctcagtgtgtgaccagggtcagggctcaatgtgaaccacaggatcagcgctctgtgtgtgaccaggatcagggattagagtgtgaccaggtcacatgctgtgaccagggtcaggactcagcatgtgaccagggtcagagctcagcatgtgaccagggtcagggctccatctgtgaccaggatcagggctcagagtgtgaccatggtcagggctcagtgtgtgatcaggatcagggttcagtgtgtgaccagggtcagggctcagtgtgtgaccaggatcagggttcagtgtgtgaccaggatcagggctcagtgtgtgaccagggttaaagtgcagcctgtgactaggatcaggtttcagaatgtgactagagagttcagtgtggatcaggacagtcagttatgaggattagtaacgagtgggatcaggactcagtctttgactgaggccaggactcaacatgagggccatgtgacagtcacagccctaaagtggactcagggtgtcctggtctcttctcactgaaccagtagccccattcatcattctttctctttcatttgagaaccatcttctctgtgccaggacctgtcctaggtgctacagactcaagggccacttagccacagtcccagccctgaatgacctcccatctcccaggcagcccagttgggtctcaattgtacaacacaccaagataacttagaggctcaggaagggccagggaggcattcttccccaggtactcagtaaggctctctggaggaggttttgcaggctgggtcacttgaagaagggggcaggagggcattccaggcagcaggtaccacctgagcaaaggcacaaaggctggttgccaagatgagtgcttggcaagtgttgggagctggagtcacctgtgcgcgaagagggctcagttatcggacagtgggtcttcatgggctctgagggggccccaggtgacagttcctgccaggtgacagtagttgctctagcagccggtgggcactccctgctctggaggccacccaccttgggtggaccagagtctggaagacaatggaaaggaatgaacctgcgtgaggcagacaaggatggcgggtggaagggtggggacgggtgcggaagggtgggtggaggccagggcagcagagcaggtgagggtgggtagtgccctggaaagacaaaagccaacacggggcacgttggggtgtgtggggaccttggtggctgagtccccaggtgggtgccatcctctgggagcttgatggaatggccaaacccctgcagcctcgaggccccatctgcccacatctcgcttgaaggctttgcctgggggacctcgaggccctgtgctctgccatctgtgcaggggtgtgcaggtgcagggactgggtgggtgggcgcctggaaggacagagctgcatggccttggctcccacctccccgagaccttggctttggtgtccagcctggccctctctccatgtacctcttcacagagcttccagaatcatcttttccttcttgacactcctgcaccccgaggcctggaccaggcgaccagctcctttgaggcctctccatctgagaattcttccaaaactgactcctcttctcactccttcccaccccttccctctgcaactcatccccagagacagggctggggagagagcgggctgttggaggggcagggggctgcctccccgggagaactctgaggccccaaagcaggaagggctggggtgcaggggctggctgggaggaggaggagacctgagcctgctgacagggcaggagcggccagggcgcaggtggggttgaagggcctgcacctctcacggcaactcatccaaccctctaagagcctgcttcattggaccaggtgctatcattattccctctgctcagatgaggaaactgaggcctggagcagttaagtgacacatcaaagtcatccagccatagagtccagactgctgatcccaagagcggtcagggtcattaatagtggagcctcttccccagcaagaggactcgaattagaagtaaagtaaggccgggcgcggtggcttatgcctgtaatcccagcacactgggaggctgaggtgagaggatcgcttgagtcctggcattcaagaccaacctgggcaacaaagtgagacccctgtctgtactaaaaatttaaaaatatacctaagggctgggtgctgtggctcacgcctgtaatcccagcactttgggaggccgaggcaggtggatcacgaggtcaggagttcgagaccatcctgtctaacatggtgaaaccccatctttactaaaaatacaaaaaattagccaggcatggtggtgggtgcctgtagtcccagctactcgggaggctgaggcaggagaatggcgtgaacctgggaggcagagcgtgcagtgagtcaagatcgcaccactgcactccagcctgggcaacatggcaacactcgacctcaaaaataagtaaataaataactaaaattaaaaataaaataaaaatatacaaaaaatgcctgggcgcagtggctcacacctgtaatcccagcactttgggaggccaaggcaggtggatcacctgaggtcaggagttcgaaaccagcctggccaacatggtgaaaccccatctctattaaaagtacaacaattagccaggcatggaggtgggtgcctgtaattccagctacttgggaggctgaggcaggagagtcacttgaactcgggaggcagaggttgcagtgagcagagatcgtgccattatactctatcctaggcaacagagtgagactctgtctcaaaatataataataatagataaataaaaatataaatatacataaaataaaatacaaaataaaaagactggagccttgtgttggtcaaagggctggatgtgggagtataccatctctgagttcagaggtgaccaggcatttgtggggcccctcaccccctgctccccactcaactcctgttcaggttcctgacacaggtatgaccccattgctctcacaaccatgatgccatttgagcctcgatgaccaatgacagctgacatctatggagcattctccatgctaaacacttttcatcccttgctcatttgaggccacctgcaattttagggccatattctgatcaccctttaccgatgcataaatgggcctgggcgtggcccagtggcctggacactcgttaggggaaggcagagccctggcccctctgtccattgccccaggctgtcctcaaggccggtaataaggtcactctcatcctgcaggggtggggtacagaaatgaacgagactaacccagttcttgctcaacctgccaggttggtttgaccctgttggcaccccacacctggagcaccctcaggctacgccctccccacctgctctttcccagagcagggacttctgcggtcgcagctgggctgggggcccctagccgtggggggtctgggcctttgggataccctccttagtctccagagaacatgggtttgaggacctgggcttgaccctcctgggtctccaggcaaagcctcagccccaccagcttcgagggtgagggcaggtgcacagccaccgtgggaggcaggcatgtccagggagcccggtctgtgactgggggagatcacatggagggttgaggccaacttcccacatctacaacattcggccgtgacctcccctcacagaggcccgggagggtcatggattctgctctgaatgctggcccagcaggtgacacacaccacagctcagcccccttgttccagggccatgaggggctggcttcatggatgaatgaaccccaggcccacctggaggctgcatcctggctaccctggccccaagttggggtggggtcaaagggcacaggcacaattggatccaggtgttggagtcccctccactctctgcaagctatgacatcagacaacctgcttccctgctctgtgtctcagtttccccatgtgtatagcacatggcactggtataggttgttgtgagcattcgcttctctgaggccaatgagacagatttgtagcccattgagtgggggccaccggggcaccagatggggatttgagagtgcacaggcatgcccacattctgcctcagactgcaggtgaacaggctcacacacgtgtgcatgcacatacatgtacacatccacatgcacatgccggcggctgtcccatactccccttttgccactgtcccgctggtctatgtgtgcccacggatcctgccccgctgggtgtgccccactgcacaggcacacacacacccctcctgtcctttgctcacacacacagtccctcagtgtcccatgccccagccccagggtgtcttgcttttcattttgtcccctgccccttttgtctgacacatgtttctgtctgtcactcacgtcttcctgagggagtctgccctgggcctaagggtttgaacagcttcagagaaagaggaactggccaggcgctggaccaaagccccttcttcctgctgccctggcctgggccccagtgggggtccttgagagccaaggccaccccgcctgtcctcctgttagtggctgatgctccatctgcctgtgccagacgccctgttggctctcggtccagcggctgttctgggatgtgtctccaggtgcccctcgaggagtcccctcctttctgcaaggaatgccagccacaccctctttgccactgtcctgtgggcccattgggtttggaaatgtgggcctcgctgaccaggcgagtcctgtgtgcaggctcctgagtgtccgcctgcacgcacagcaccgatcaggtggacagacgcctctcaggggaggaccctgatgcgcagctcccacctcccagtggcctccgtgatgacgccatggtgacttctgcagggactaaggctgtccatcccgtcctggtgcccagcccagagcctggtctgtggcaggccagcgaggaacaaaacccacccaccttaaacatggctgctccgcccacccagggccttccaaggcacagagtctttctgaccggcctgcagcagacataagaccagaagtctcgtgcctgggctgtgggctccccagggtaaagccaccagaagctgtgcaggtccagggtgtagtctgtcctcgccatgcttggagccctctggaaggccttgcgctcctctgggcctcacgtatctctcctgtcgaggagtctggggaccctccctcccctcgctgccatgagtggggtgtggtggaggggcctgggcctcagctcagaagccccagggctgggctggaatcctggctccaatcttggccactgggaagcactgggctctacttcagtctcctcacctgtatagtgggaacaccagcagtacccacctcatgggcccttggaacaggggactaatgggtggccctgggtgaagtggtgccacatggaggctccaggaaggccagcctgctataggaggtgctgacttggtggggctggggggtcttgatcccccattcaggtggctccaggacactcatctgccataatcctggggtcacctgaataaggtctctgctcatccctggaggctccttcaagaacactgtgctccttccaggactctgcccacagtgggtgggaggagccttcgcctcgagcctcagtctcctcacccatgacagggaatgcagcccgacgggaccacaggccttgcaggagggggtgataggccctgcataaagggggcagcgatgagacggcagcaatgagacacaagctcttcagccccaaggccatagcacccctgagagtgagctccttccggaagcttctcaggctccctgaagctgctggggaactagaagcgttcagtctgggtcacctagcatgacaccccgggaagcacagccccagctctgactccgagctctgggggcgagagggggctctcgcatcagcacgtggcagtccctcaatgtcgaacccagaagagtgaagaaaaaccaagagacaacagccggcctcggtcctgagcccgaccggccttcggcattgaccccagcagcgccccgtggtgtggctgctgctacgcgaccccccgggggatgcggaggccctggggctgctgagcaagctgccacgtggtgcctgccatgctggggtctgaggccccccacctgccgtggccccgacacacatagcacatcatgggacctgcggttcacagaggattgtactcccaggggctctgccgaccctacaaccaacccccaccacgaggggcggcaaggacaggatcagcccactttgtgaatgaagaagctgaggcccagggacgtgaagggcacacgggggctggactcctggccaggaggtaaggggcgggcagggtctctgcagacggaaaagatggaaaggcgttcccggctgaaggagcagcgctgcggaaacagcaaggcctggagaccctctaaggctgccagccccctcgagggctgcagccacagaaggcgggggtgggggtggcgggggcaaggacccagagagggcctggggtcaaaggtcatccatactctggcctcttcgcacacactgttccttcagtcagatgccgcccggccttgcccagctcccatgccctccaatctaaactaaaacgcagcgcccctcccaaatgctttctcagccatccctattccagagcaggaacaaagacgctgggaccagctcaagacacagacgtctggacagccttactggagacggtggggacttggaggccagggagggcgaggggccggggggacaaggaggggcggaggaggggaagctttggtccagcctggcagcctgaggtccagtcctactctgcctaccccgccgttaggcgagtccagccctgcaggagtgccctaagcactaaagagatttccccagcttgccagctttcaccccggagctcagcagatggctgtgactgcctatggtggggtctccggcagcttgcttcccgcaaagctccttccagggctcagggcttccttcggggtttcctgctacggtacgaactcactcgagcctcatcacacccatttcacaggtgggctcagagagacgcctgctggggcacacggctagacagcagcaggctgagctgagaatatgcccaccgggggtggggcggcagggctggaggtgccagggctgctccccaggtggggtgggaccgggagaagagacatcgatacccctgtggatgcctgaggtcaattagtcgaggaggaggcagaggaggaggaggcagaggaggaggaggctgttgcaagggccagattttgaaatgtagctgcaacaactgccctggtaaacttgattcaccccaccaggctgggagccaccttctcccggagcctccttctccagggagggctacagcccccagcccacttgaagcaggggtcccagccctcttcatctgtaaaatggggtggagagtttctttcttggggtgttgtgggttgaactgtgactccccaaattcaaactgaagtccttagaatgtgaccttatttggagggagtctccacagaggtaatcaagttgaataaggtcgttggagtggccctaatccaatgtgactgtgtccttggaaaaagggagatttggagacagatgtgccacatgaaggagaggatggccctctgcaagccaaggaggcaggcctggaacggacccttccctctggccctcggaagaacccagcctgctgacaccttgatttcagacttctggcctccggagctgtgaggcaataaatgcctgttgtttcagccgcccagcgagtggaactttgttctggcagccccggcaggtgacagggggttgttaaggttgtttagatgtgtgcgaggcacggagcgacgcccagaagacgagggcctccggtgagtgtgagtgattcctaaacacggcacacagccaacaaaacaagacaacaccaagaccgggtgtgaggtgggcgggaaaagcaggacttgtagttgacctctgggtcctggggatgggggcgggcaccaggcatcatgatgggtaggagcacagctgaaggccggggccctcgggggacacacttagcccccctgtgcttcggtttcccccttggccaatagcacccacccaaggggttggaggattacctaaggcaggggttggccaactctttcgggaagggcccagggagtaaatcttttctcctttgcgggctgtgaggtctgtgttgtaagactcacttctgcagctgcagtttgcacgcagccttacagcagatgtaaaggagtgggtgtggctgagttcccaggaaacttgattcgtggacactgaaagcagaacttcatgtaatattcttgttctttggtttttgttttgtttgtttgtcttttgagacagggtctcgctctgtcacccaggctgggatgcagtggcaccatcttggctcactgcagcctccacttctcaggttcaagcaatcctcccacctcagcctccttggtagctgggattacaggctcacatcaccacgcccagctaatttttgtatttttagtagagacggggtttcaccatgttggccaggctggtcttgaactcctgacttcaggtgatctgcctgcctcagtctcccaaactactgggattacaggtgtgagccactgcacctggccccttctttagttttcttttcaaccatttaaaaatgtaaaaaccattttagcttgcagtcctacagaaacaggtggctggccagctttggtctgaaagccagccctgccctaagtgaaggagccctctcagcactaagaggcgccgggccagacctgcttatcgatcacctttgggcccagtgtggggctgctgctccggaaacaatttttctttttctttcaagattcaccagctctgttcaggagggtggccagcttggcgacctggacatttaatcctccagccaaagattcccttctgtgcggcagccctgagggggctgtctagatgacctcacttgagctgagtgactgcctgggatgtgggtcccgtgaatggggcacctgtttcacagatgagcaaactgatgctccgaggcaagttactcaatcccctgaccccggcacggtgccccgcctcttggagcccaagccagcggggctgaggcaggggctgctgggggtggacaggggaggtgggcttgggagcactgaagaaagggtgacactccaggcatctgtgaaagcccagaagacatccctagacaaaggaggaaacagggttagggaagggcactcctagagaaggagcagcttgcagaggcccagtagtggcaccacaggggcagctggaagatgtggcaccacgggggcagctggaagatgtggcaccacggggcagctggaaagtggggttggtgggcagaggtgagactgagtcctgggagaagtccacaccggacatgggagactttcccctgacctgatgggctttatttaagcaaggaagggactggtgtgaattagattggagacactccctctgtcggcacagagacagcactctccactagaaatctcatgccagcctcgtgaataatttctaattttctatcagccacgttaggaaaacggaaaaagaatttgatgcaaattattttagtaatatattttatggaacctaatatatccaatatattatttaaacgtgtcattcatataacaaattatgaatgagatatttcacagtctgtctcatactaggtggggacatattccacgcttaccgtacaactcaattcggactggctgcacctcatgtactcagaagacaggctgcagtcttgtatgacatcttggatgagactcaggccgcagtcttggatgacacatacgtggacatcgggctgtggtggccggagtagagtcagagaggctggaaggaggcccttttccagggcaggaatgatggtgcctggcctggagctgtggtggggttcctggccctccattcagctgccagcccatcccagcttgcaccggagggaagcagcgggcctgggctctgcggcatcccaggggggcaggtcacagggcagctaccctaccccagcctcctccctgaccccgccggtgtctgcccagacagccggcatccccatcccgctgggctggctcccggccctgccctacccccaactccagactcatgtcaggcttcctgtcccagccggagggtgacccgaggcctgaccccagaggcccaggcgatgggcccggaaggaaggccgcctccttgatgcagccacagcaggcggggctggggcttccccatggactccctcgggaagcacttcacactttggtgggcgctcagccagggcggcccccagcagcggcaggaggcgagggcctctggggcagggaggacatgcacctgcgcctgggcctgtgaggggctcccccaccacagcgtggggtctctgggcatgccagggttgcccccactagacagccagggttctcagggaacacagagcaggcaagcaggccggcttctgcttcagcctcagcccctgtccgcacctggggcagcacaggacaggtttaggaacagaccctagctgcacgcctggtgaggaccttcacctctgggcctcccgctgctcctctgtgaaaatggaggtatcggggtgttcgtcccttctagggccagagagagatggcagcgaatgcacgtggtccctaaaggagagccgtccgtggccacgtaggaaagtgtcaggcccagctcctcattcctgggatgtggccttttctcacctgcgctgaactctgctctcaggactcaaaccctgagctgctgtggaggctaactcactcatgctccaggcccatcttctgaataagtttcccagaccctccaacctgccctccgtgtcggccctggggtgcctgcctctccttccctcttcctcttcttctcacaaatatgggccgagctcatgtgatacgtcaggcactatgctaggacgtgggggtccagctggaagggacaggacagaaccctgccctcctggagctggcagtctgtagcagacactaatcagttaaacagatcacaaactgtgactgtctccagcagagacacctggttggccttgggggagcacatagcagatggatgggggtccctgcccagggctgccggcaggcggtgcaccttgcactgctcacttagtcccacagcctcgcttgcccgcaggcagtgtgtcctctgcacactttcagggctccgtccttctgcccagcgcctctgcaggctacgccttctgtgctgggcctctgggcatagttactaggcagccagggctggggccagcccttggccttagctcagctccagggaggatcaagagggtgtccagtgtggccgtacacctgggcacctgcttcagaatccaggtccttgggaaacaagtggctttggtcttgccaatgcctttgctctgttttcagctgggaattaagctggggaacagcaggaggggcagcatttgctggccctggtgcaggaggttgtgggtgagaagagccgagttcaggtccccacctgggcagcctgtggtgtgagctagaggtgcagaagcctgcggggacacggagggcagccgggcaggagcctgcggggacacggagggcagccaggcaggaggctgcggggacgtggagggcagccgggcaggagcctgcagggatgcggagggcagcagggcaggctgggctttctccagtgcttgctcccctcccaagggagttcctaatttgggtccccctgctcttccttggttgagtgggccccacgcacttggctatgatccagcagactcctgcgtcctggtgtgtccctgccccaccttcccactgccctcggcctctctcccagcccctgggagctgggttttttgcttccaatttcaaatacatcagactccatcccactgtcctatcccaaggtgtcttttgcctttctgggaaaataaagtggcaggggagtgaacccaccgcaatgggacagccctcctcctgtcctccgcgggagcagcatctcgcaggggctccgccaagccttcgaggcccagccaaagctggggtgggggcactggccggaagcttaggggagggggagcctgcaggacttcactcctgtgcccgtgtggccgggggtacctgcttgacctctgagctgtcaccgggaatagtgtccagcctgcctgcctgctgggacctctgcagagaccatgagctcagtcctcagggcctaggtcctgggttaacactgagggctgtgcggccaaggaccccggggtgggcatgaccggggtgtgtggaggaaggaagggggtctgggaaaggatgcagacaagaggtgggtgctgggccagcacctgcttctgttcttggcctcaggaccgtctatggaattgggagtaattctctgcaacatgggccctgcagccgaggtctgggcagaggcgtcagggcacagagcagtggtaccaccatgccagggagatgctcaggccaggaccaagcagaaaggggagctcaccataaactccctggggggaggggagcgctttacccccacaagaatgggcagcaacaggtcatctatcctcagggcccataaccccttcacctgcttcctggtgacctgctgccgggaagggccctgggcctcagggcctttgtggggcttcctgtacccccctgaatgctgtcactgtgcctgaaacctcaccagtggggcctcatttctttggtcctataacactccttgattttccagcgttaagcacacagtcatgagctgttgcctgaagctgacacttactgagggtgttctgtgcagcaggctttgtcctgagccttttgatttttttttttacatgtcttgtttatgcaggataaatcccagtaacccatttgcagaaaaggaagcagcagctcagagaggttaggtaggttgcctaaggtcacccaacttgtggcagaagcaggatggagccctgcctatgtgatgatggggccaggagcaccctgatcatctttagagcccacccctaacccaggtgggggcagcaggtccctgtaagcatgctggatgaaaccaggcggctgacagaacgggagggaggctgcccttgggcttccgcatttctggattcgagctctgctcagtcacaatgggctgtgtgcccttgagcaagttacttcacctctctgagcctcagtgtcctcttatcaaatgggatactaagatataattcaaaaatatgttcttgagaattcaatgggaagatcctgccggagtctggagcctgtctatttagtttgacaataaataattgggctagtatttacactgatctctagtaaggggggcacagagcagggaagggtgtgccgggagggctgaagtgtgcccctgggcatcggggcgactgtgccagcacccgcctctaggtttacagcccttcctgagaactagaaaaatcccctcctctgagcagatgccatccttggactcatgggcttggcacctggtttggccccacagaagagactcctacccagttctcttttctagcccagaagaatggcatttctggaccatctggaacatctggatcatctcccctgctgatgcacaaacagccaggcctccggagaaggggggtgggacagggtgttgcaggcagagggaacggcccctgcaaaggatcatcagggagactgagcaggtcaggatggctgccggaacaagcagcgtctcagtggacctgtggagggcaggggatgagcaggtgaaggaggagatgggtggagagcgtgtacctggggcaggcctggaggcgggagggaggggctggagccagagaaaggggcggctggtggagggaggtgaggctggaggggctgggcctggtactttggatgaagccaggtcactgcaaagatgaaatgtgatagcactgggcaaaggaagcaaagcccatcaccatgagaccagctcccaatccttccctggaattcatttaggaaaagatctagagaagtcaaggtggggcccggaggggatgggatcagggtccgtgggaagcaagttcatgtctttgcaccgaggatggacaggagtgtggagtgtgggagggaagaggaggaggaagcagccgaggggagctggaggggaggggtgagaggaggggctggaggaaagcctggggttgtgtgcagggacccacagaggactcaggtgagtgagaccgcaggcaggccgtgaacagccccaatcccacgacagaggcagccaaaccctttcccaaagatgttttatagagacctggcggggcagggggggactttggtctttttcagacacagaagttccttctgtgactgagggtaagtgtcttagcctcctgcctcagtttcctcattgcataacaggactgtttcagtgtccacactcagagtgtgagggctagatgaggaaatgcacgtgcagtaggatgccacctgtctttggaatgtctgcatgtcaggtgccccagccctcaggatccaggacaggtctggctgcggtgggtgctggatggatgctgaggaggggagggacagtcactgcataccagcctctgccaaaatggggagcccaggggcaggagtagacaggaaggacttcctggaggaggagggctggcagtttgggaagatttagatggggagaaagtggggcaagggcatgggggtgggaagtctgggaaaagatgtcctggcagggtggaggggaacggaagttacgatggtagtggggaaaagcatctgcccaggagccaatggtgcaaacacagtgtgtgtgtgtgtgtgtgtatgcacacccgtgtgcacaagcacctccaccgctttcccagcctcctagccagagccctggggctcagctcaggcccttacccccagccccacccgaccacaggcttcacaaccagaggccaagaccccggcaaatgcacatcccctcgtccctctctgtcccagccccactgctctcccagagcctgctgccatcccctctctgtcctccaggccttgggtcctccacaccctcctgctgccacctggatgccccaacctcccgtggactgttggggtctcccaggggcccccgcacttctgtctgtatggctcttgtccactctgcccggctgacacctccggccacccgagactgctcgaatgcccagcaccccacacagctggcacctcctctgcagaccgcagcctgggagagaggggaacccacgggcctgtgagtctttcagatcctggtaaacagtaggagcacgggaaatattctggagagaaatcgccgccctcagctccagtcccttgttccagcctcctgctgggtgcccggggggagcggacgtgatgcagctctccacccagtacctggtacccagctccgtgcggagcacgggggccagccctgaggactcctactgacctgcaggttcgcggtccagagacggggcagctcacaggcaggggacgcagctctgacatcctcaggtgttggagctggggccaggaggtcatggagctgcaatcccaactcaaggactggttgagcactggcactgcccaataaaggcccctggttgagactgtgggtagggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaatgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgttgaggccagggctcaacgtgtatcaggagtgaccagggccagggctcagattgtgattgaggccagggctcaacgtgtatcaggagtgaccagggccagggctcagattgtgattgaggtcagggctcaatgtgtatcaggagtgaccagggtcagggctcaggaggtaagggagctcagggtgctctctgaagttaggcctcttagtgaccatcttcagctggatcttgctggaccagaagccagagctttgaccccacaggtgtgccctacctgggccctggaggggcaggtcagtctttcttgagtgccatcctttcacccatgttttaagcctcctgttgacaaggatctggacacaggattacattccaagtccttgctcaaagcctgagccgtctccaccccatcagccacgttggttgtgtccctgacccggacccggcctcccctgcagaccctcggggctccctccctaatcccacccttctgcacgcacctgggccaggacatgggcagtcacagctgacagattgtttaggggatcaggaagccggtgggtgtgcagcagatgcctgtgtggacatgcacacatgcacactcatgcccgcttccaggcaggaagaccggaggctgcacgtgggcagcggcgggtggtggtagtccttgaccagggtgtgagtccagtttgtcttcaacctggtgctgggaagtggggttggggagggtgtgaggcatcctggggtccttggtgggttagactcctgaaacccagcaggtttcttgtgtctctgagcctcagtttccccttcccatagcttgggaagaagagactggcatctccccagggttcctatgtgggtgacacagatcaacgtgtcaatggtttcctcactgtccctatctgaccgcatggccctgcctgtctctcctcctccctggagcccatgtttgggacttccacatttggtccctgagccttcatggagtagctcctctgtggggaaccctggaccaggtgcagcagggagtcgggagagagcagatggactccctgcactgatggggctcacggggccctgggagagagtatcaacttggatggtgacgatccagcagggccacagctgaatggaggtgaggacgagggcccacggggcttggggcacagtggctgcctctgctcagagacagcttcccagaccacacggcggcccagctgtgtgtgggaggcataggagctctcctgaggaaaggcatgggaaacagagggaatagcaagtgcgaagacctggtatggaagtaagaagtgaccggagtgttgcttgggggtggtgagcaggaggcaatgcatcaggcaggcggaaccctgcccctcccaggctgaccccagccagacggggaaggacctgggtccctgctgtgggtggtgagtcccatacatgtccctgcccaccctgtcatcctgcagggagcaaactgatcccagagggggtgcccagcccacgccgtgcagcaccgcagggggaacccagcgtgatagagagcagtgtcttagacctggctccagcgccgaggctgcggcccaatcgaggccgggtccttcccctcgagacttcagcctcggctctcctggacttcagggtgacatcaccagggtgttgggggtcttctgtgatcctcctacgaatacttctttttttttctttttagagacaggatcttgctctgttgcccaggctggagtgcggtggcatgatcacagctcactgctgcctcaacatcctgggctccagcaatcctcccgcctcagcctgctgagtagctggtactacaggggtgtaccactaggcctggctaatttttaaaaattatttatagagacaaagtctcctatgttgcccaggttggtcttgaactcctaggctcaagcaatcgtcccgcctcaggcccctgagtagctgggtctatgggtgggcaccactatgcctggctaatttatttacttatttttgtagagacggggtctcactatgtttctcaggctaatcttgaactcctgggctcaagtgatctgcctgcctcagcctcccaaagcactgggattacatgtgtcaaccaccgtgccctacccacttctgttttattattgttattattatttaagatgggatctcgctgtgtcacccaggctggagtgcagtggcacgatctcagctcactgcaacctccacctcccaggttcaagagattctcctgcctcagcctcctgagtagctgggactacaggtgtgcgcctccacgcccagctaattttttgtatttttagtagagacagggtttcaccatgttggccaggctggttttgaactcctgaccttgagtgatccgcccaccgtggcctcccaaagtgctagaattacaggcatgagccaccgtgcctagcctgttttttttttattatttttaaaattttatttatttatttatcgagacagggtcttgctctgtcgcccaggctggagtgcagtggtgcaatctcagcccactgcaacctctgcctcctgggttcaagcaattctccagcctcagcctcccaaatagctgggattacaggtgccggccaccacgcccggctaatttttgtatttttagtagagacagggtttcactatgttggccaggctggtcttgaactcctgacctcaagtgatctgcccgccttggcttcccaaagtgctggggttacaggtgtgagccactcctggcctcacttctatttttcaaaccgagggtgatgcttaacccaagagtaggtgctgtcaggccgaaacatctgttctggtccttggctggctttcccaaggccctgagtgtcctagggccttgtgacttcctctgtgaactggaaaacagcccccaactccagtccctgcctggctaggcttgcctgagcagagcagaggtgagaggcaggaaagatccagcagcctcagagctgtgaacggtgccagccccgtgattgacatgtcagccgcactaatagtatcgcttcatctctccagactctccctttcccggtttgtccactgttctgtttggaaataaggttgtgcccttagtcataccttgataagaagggagacgcccctgcctgccctctctcttctgttccacctcctctgccgaacgttcaggagctcctcattcaaaagaccgtcagatgaaatgtttgctagagataacactgtgaagcatttagaaacaccttgcaccagcctacttcttaaatacttgttaaaaacgagatcacaccccaaatagagtttcatagaatataccttttttatttttcattattttttgagatggagtctcactctgttgcccaagctggagtgcagtggcgcaatctcagctcactgcaacctctgcctccagatttcaagtgattctcctgcctcagcctcccaagtagctggaattacacgcatgtgccaccacacctggctaatttttgtatttttagtaaagacatgttttcaccatgttggtcaggctggtcttgaactcctgacctcaagtgatctgcccaccttggcctcccaaagtgctaggattacaagcatgagccaccgtgcctggcctcttttttaaatccagtttttattcagcagaatgttccgaaagatccagagggtaacatgtgggcaaagtccctgagccctggctggggtggcctgggtggggttgccttcctccgacacccaactcatgtgggccctgggcgcccagcaccgggttccttccccccaaacccatctcatctggactctgggcacccagcgccgggttccttcccccaggccttgagcctggctttgcagctcctgctgccccagggcaggtggtggtggccgcccagccctcacccagccccgagtcctgtgtggaaggcgattcctcccactttaccggggaggacacagaggctgagcgtggtcacggccggagccccagcgcagcatctgagctgcaggctggccgccccccaccccgctgcacccccatattccactcacagaccttcttcctgctgaacacagctgggccctgacgcctctgtgccttggccacaaggcaccttctgctcactcagctgtccctccagtccccgtagggctgcagacccaggcccacccagtcacaggcctggcagcgagggggaacaaaagggtcaaggggccgcccagggctgggaagggccttgctccacctcgctctcctccattccccgtgtgggcctccgtctcccattctgtgaaatgacccgtttgggccacagggtccccaagtcctcttggcttggggccgtctgttccaagaggaggggccatattggtccttgaggcccctgcggcccagtaagtctgcagtgaggcctccctggacgtatatatcaacaaaaagtcaaactccgtaaagtgtttgagacatttattctgagccaaagatgaatggccgggggcccatgacagccccaggagaccctcagaccatgtgttcaaggtggtcgggccacagctaggtttcatacattttagggggacacaaggcatcaatcaatacacataagctgtacattggttacgcctagaaaggcggaaccaccggaagcggggatgcttccaggtcataggtggattcgaagattttctgattggccgttggttgaaagagttattgtcggtagataggaatgtctgggttaagataatgggttgtgcagaccgaggtttcatcatgcagatgaagcctccaggcagcagactgcagagagaatggatgggagatgtttattatcagactgaaagactgttctgccagtcattccaaaagggaggggggataacaaggtatgtccgtctcccgcttcccaccgtggcctgaactcgcttttcaggttcactttggaatgtccttagccaagacgagggtccgttcgtttggctgggggtcttaggattgattttctggtttccatatgcaatgggagtgggggagagatggggtgggggcagcctgaggctcagccctggccaaggaagccccctccaggcattggccaggttctgactcctacagtgttacagccggcagggaacttggacccacaagctcctcccctccccaagcctcagtttccttgtttgtaagatgatgcctggggtccttgcttccttgtagggctcaaacaagatcccaggctctattaggaacagtgccaaggcagggggcccccaacagctcaagcaggctggagtttggtgctcacggagtaggggaagctggtggcttctcaggctcatgacattgtccctgcagggtgcagggctattccctggtggggctgggggtgtgtgtggccattggcaggagccccgatgttctcatccatgagtcagcagagatgggaacatcaatttatttgagtggctggtgcagccgagtccttggaggacaaggagtttttgccaagcctgggccgaatgtgccagggcttggggcagggaaactgtgtccagggacacagcttcaagggcccctggttgatgtccccagggcctgctgagtgccaggccctgggactcagagaggacaccacccgatgcaggccctgggactcagagaggacaccaccggatggagctgcccaaagggagtgccagtcggatgtgggggtgggggaagaggagggaccaggatgtgacgggtccgaggtctcacggggtgcccaggtgggctggatttacagagcatgggcggcctgcaggaccatgaaggggcaatgggggcagaagacagaggttggaggcagggtggcatggagggtctcggggcaggggcaggagggtctccagggtggtcagtctgctgcagtcagcagagggcactggaggggcctgggctcaggctccaggtagagctgacctagcccagaatgggcaggtgagggaaggccaccgcctggtgggcttggctgtcccctcacctggaccccatcgccggcctcttccttgcacggggtagatgctcattgatgtggtgacgtctagcaggaggatggccctgggcagggctgtgagctgggagacctgggctgggatctcagctttgggcccacacactgggatggaggagtgtttactgctgtctctgaatggctgcaggaaggctgagggggcacatggttgatgggccaggccactctgggcacagttgctgagagtcggctcttcctaagtgggggcacccggggtggtggaagggagtcagatgccaattcccaatgggtcctggtggtcgtgccctgctgcagggccttggcacccgccgccatagccatggagtccaggggggcccccaggggctggaaaggcagggaaacagattctccttgggagcctccaaggaagccagccctggctagcacgtctgtgctctgtctctggctttgcctgttctggacatctctggaggtgtgagcaccatgtggcctttcgtgtctggcttctttcacttagcacggtggcttcaggtccctccgcattatcgcatgtgccagtgctttgctcctttttacacctgagtaatcgtccactgtggagtcatcctttcagctgctgagagatgcgtgggcagtttccacctgcagccatcgtgagtagtcgggtgaggctgctgaagcagacgagtgagggcactgcccgggccatttgggctggagcgggggtttgaactcctctttgtgggacggaggctgtgttcttgcccacacctctccctgctccaggcctgtcttccccttgggactgggactatgacttggtggcttcagcctccgcagggtgagcctgatcctgagagtcaggctgggctgaggaggacgggtgggcctcctgggggaggtgacgacttcggactggaccttgcaggagggatgggctgtctgaggatgggagatgggaggaggtattgcaggttgggcagcaggtgaggctgagctgggaagggaggtggttgaggctggttcttgggctgagtgctggggaggggtcggccggggatcaccgagaggtccctccaggctgcatgagcagaggagacaccctacgggtgatcttcttgcctttgtttctagaattcacaaatcctacaattctaagctctcagaacccttggatctgaaggttctcaaatgctaaggtttctagatgttagcagacgaaggtgtcaagacgcatgggatctacgatgcagagttctgagtggggatatgcgtcccccaccccgactcaccccacgacacatatcagtaacagcctctgcaactccgccttggtgcccccgcacgttccaggggcagccacactgatggattgctcagaacgggctggaggtgagatgtgtttgcccggagcccccacacactgtcgtctccagctgtgcctgtccctccccaccttccactctgtgtctcttccctgccccccttgtgccccagccccagccccccctgttctttcctgccacccaatcctgtgccccacgacaaggaggctgagcccagggatggccaggaaggaacccccggcaggctctcagggtgggagagaggttgtggggatcaggggctttgcagaagggacagggaggcagcccagagcaccccagcttcttggccagcagcaggtaacctggctggagggcggggcccccatgggccatccctgggccagctgcccagggctaccaggaaggcagcttgttttgtaggaggtcaggcagcgccctaaccccacctcttgtcttccctgatgtcacaccccagggtcagccccttgggccagaatgggggtgatggtgggaaccgggaagctgagagaacagggaggaggccgggtggggcacaccaggctgtggctgtggggatggggagattcctcgcctgggcaggccgggcagcagcggggcagtcctggggggtgtggtaaatgcttctgctctcttcccctgactacatgggagcctccgtcccacctcacctggaaaaggggcttggaactgggctgctcggccttgggcacaccaaacggggcccttggagccctgggcttcctggggtggctgggtccccaccctgcctctgatccatcctgagtctgcatttcttctccaggtgccccctgcccttggcctcccaccacggcctgggagtagatagtgggctggggcaggcccagcgctgtcctctgtgggaaaggaggactctgggcctggaaatagttgagtgtggacagaaataaccctgactggcctcaaaacagaacatggaaaattaaatagggaacattagcattcaccccgcgcttgccacagccactgtcccatttgggaggcgggcgcgcttatcctcatttagagacagggaaactgcggcccagagaggggaggtgaccttcctgaggttcctctgccagccggccaggccctgtgacccctgtgcctctgtgcttccactacacagccgcatctccacttctgccccgacagttcctgctgcagcagatgcccttccagatgcaaactcctacgcatccttcaaaacccagctaaatgtcacttcctccggaaagccttccccacctctctagcaggcagttgagcccagcttacatttccgacaggccctcactgcccgggattgcagctgcgggctccttgagggcagggattgtccctcattcatcctgattccatgccaaggcttatagtaggtgctcaataaatgcttgctgaatgatagatgggctgtgtgtggtgctaagttgaatgccttgtccctttcccacaatttcatctcaaccacccaagaatttagcgtgagtatggctgttttactaaggagcaaacaggcttacagaggtgaactcacctgctccaaggtcacacaacagtcaagggctggacctgggatttggtcccagccccgcaaacacagccccactacgtacctagcatgggctcaggtaggccctaggggtgggcagtgtatctgaccactcgtcctgtccaccttcccctgcacctgtggccccacggacccctgggctggctctcaggtgtggcatctccaccttcccccacaggcccagaacccaccctgctgggccagcatcgtctcccaagggctcccacacagacacagtgggagccccttccctcaggctggcccccaacttgtccccttagaggggtcgttggtaagcactgtggcctgaggcttcctctgtgagagacttgtgggggtcatgccacaggggaagagggaagtgaatggatagaaggttctagaactattagctattgcagggacaagatatgaagaaaggatttcaaatcctggtttaaagaatcagccaggcacagtggctcatgcctataattatagcactttaggaggctgaggcaggaggatcccttgaacccaggaattggagaccagcctgggcaacatgttgagaccccatttctactaaaagtaaaaaaaaaaaaaaaaaaaaaaaaaaagatctgactatggttccatgtgcctgtagtcccagctactgtgggcattggggtgagggtggctgtcgcttgagcccaggaggtcaaggctgcagtgagctgtgattgcaccactgcactccagcctgggcgacagagcaagaccctgcctcaaaactaaaaacaaacaaaaagaatcaaggttctggggttctggagttgtttccatctttccggcctcccgcagtccagcaaaggcctatgggtgaggcagagcaagtgctggagaaggtggcagcaggtggcctgcgggccagtggacaggaaggaagtgagacagctggcaggcgactcggagcccgggagcgggagtgggctggaaagacccctggcctggccctgccttggctccccagagggtgtcagggcccagtggccacactgcccgctccctggggccccctgacaggagttcccaccgacctctccaggaatctggggcccgggccttgtgcccacctgccaggccagtccaccctcagctgaaccacagtggggcagatggatacacaggcaggggcgtggcccagctgtcgggccagggtctactggacactgtcactgtctccctctgtccctacaggtggggcctgtcccctctgcctgacccaaggggccagagaccgccgagtgacacacacccaagcactctctcccttgccaccggctttggggcaggtgccagtgatctggttggcaatgctcaggactgcctgtcaggacatctgagccctcaggctggtttctcactcctgcccacacagcggtctcggctgccaggctgtgtgactcggggtggggggctctgacctctctgggctcacaggtgatgaatgaggtttttaacctgaggaccatggatggccgtgggggctcttggctcccccgacaagtgcaagtgcagcctgtcatccagaaggagaggcagctccccagctgccccctgacccctacacagctgcccagccccagccccactgctcttcgctggggtgactccagacagggcattttctgtctccctgcatgctccccacccatctctacaacagggaaaacagtttcgctctgcaaggcagcacaccacctcgggacctggagagaaggcgaaggtgaggagtgggctctgccccgagctgtgtgccccgggcagagtgagggctcacttcgctgagcctcagcctccttctgcttgggaggagggcattataagaacccctcctgtccgggtatacagaggagggaggagctagcctgcctgtgcgtggagggtggagggtggagggtggagggcacttgtacccgactccatctgcactccatctgcaaggctggcatggggcaggcacacagtgaagacgccctcacttgtccccaagttgggaaggcaaaggaacctgcaaggccactcaggtaaggaggagtgcagacattctctcgaggctgtgacccctgagcacaagccctcccctaggtggggaaagagacctagagggaggggcagtctggaacgaggtccagtctgagaacctctcccaggccggtcaggaagtcacagatcctctgagcattcttccaggattgctcagctctggggacgacgcctggagagacaggcggcagaggaaggtcggagggtcctggtgcctctgcagcagctcccaggccagcagcgccacctggtggtcatatgccccaggcacttcaatcctgccggcattcccagcggatcagtggaggggctggggccagctggaggggctcgcccaggctgggctggggcccagaatgtgcccccttagctctgcccacccctatgtgtgtgcaagttccagggaaagcccagagaaaatagggttggccccaggggaatgagccccattggaggggtcggccactgtgatcatggtgcatggatgtaagtgtgtgtatggggaggcagacgttttgttgggagtgagaccctcagttatacctggcacagggtgggtagataaactgttgattgaattaatgaatgaacgtgctggggactgtccagaggacagccctgctcctttcattagctcagttcaatcactgattgagtgccaaacaccatgggaggacacacacacacacacacacacacacaccaaaagaagagacagggttcacatacacacacacatacacatactcacatacacacacatacagactcacatacacacacagactcacatacacacacacatacacatacatacacacacatacagactcacatacacacacacacagactcacatacacagacacacacagacttacatacacacagacacacacacacatacagactcacatatacacagactcacatacacagagactcacatacacacagacacacacacactcaaatacacagactcacatactcacagacacacacagactcaaatacacacacagactcacatacacacacactcatacacacacatacagactcacatacacatagacacacacagattcacatacacacacagacacacacacacagacacacacagactcacacacacacacagactcacatacacacacatatacatacacacacagactcacatacacacacacactcacatacacagacacacacagacttacatacacacagacacacacacatacagactcacatatacacagactcacatacacagagactcacatacacacagacacacacagactcaaatacacacacagactcacatacacacacactcatacacacacatacagactcacatacacatagacacacacagattcacatacacacacagacacacacacagacacacacagacacacacagactcacacacacacacagactcatgtacacacagactcatgcacatatacatatacataggtacatacacacactcacaaatgtaaatacatgtacacacacatatacagactcacatacacacatacacacatgtacgtatacatacaaacacaaacatacacacacgtgcatacacagacacacacagcgactcacgtacacacacgtacgtacacacacgcacatacacacatcacatatacaatacatacacagactcacaaacacacacacagactcacatgcatatacacatacatacacatgcacatacatacacaatgtacacacagactcgcatacatatacacgtacatacacacagatacgcagacacatatacaaccatgctccacataacatcgtttcagtcagtgatgggctgcgtatatgacagtggtcctgtcagattccaaatagctgaaaaatggctgttgcccagtgatgtcccagccatcgtaacactgtggcacagtgcgttaccttttctatgtgtggatttgtttagttgcacacatacttatcaccgtgttacagtcgcccacaggactcagtacagtaacacgcggtacaggtttgcagcctaggagcaaaggctacggtgtagagccgaggggtgctggaggccattccatctgggtttgtgtaaggacagtctgtgacggtcccctaatgaggaaatggtctaatgatgcatttctcagaatgtgtcttgtcagtgagtgacgcatgactgtacataggtacatggacacacacactcacacatgcacactgctgcagtttgcacgggtgcccctaggttcacatgtcagaaactcgatcaccagtgtgacagtgttgggatgaggggccactgggaggtgtttgagtcatgcgggcaccaccctcatgaatggattaatacgttatctcaggaatggttctttttcccccaaagcaacaaaaggtaaaagcagggaatggttcatcatcctgggagtgggttccttgggaaaggacaagtttggcacactctctgtctctgtctgtctctctatctgtctcgccttcaccacatggggcccctccatcttggacttcccagcctccagaatttgttgagccaattaattcctagtcattaggaattagccagtttgtggtgttctgcacatgtggttatagcaacagaaagtagactgagacacacacacacacacacacacacacacacacacacattcctgcatgtacacatgaatgcctgcgtacatgtagacacacagacacgcaggcatgcataacatgtgcctacacacagatccacacacactcacttaattctcgcaaccttgccttaaggcagagggtgtccgcaatctccccttgacagaggaggaaactgaggcttaggaaagacacgtaacttgctgaggggctagtgtgatacaggggcctggcggctgggccatcctgttacctgggctgtattctggagggcctgctctgggttgggctgtggcagcctctctgtgatctcccgagttagggttctgggagctccccaaaacccttccatagctttgttctggagaggatggttgaggtgggggattcagactcctggacctcaaccctgcacccccaccaggccactaagaggggcacccgtgggggtgagtggaggaccctgaccccaggccactggtaccgcctggatgcctgcagtacacaggggatccgatgtccttcagcccccaggctggccccgatgtgaagtctgatgggtgttgggcccccgtgctgcccccttcccccacaggtagctcatttgctgagtttccaagcagaatagtttgtaaaatgtgcaatgcatttgggaggggatgagcctctcatggacagtagggcaggtaccaggagagtggtggccccagccctcccagtcccctgggagccccacccaggcacaccaggttcagatggtcagtgcctgttcccccaggaactcttggtggctgaagatgcctgtggactcccattatgtaaaacaccgaggattcccaaaacccagtgatgctataatgtcattgaaatagtgagcacatagatgatgtggcatttcccgactggcccttggggtcaagtggtagtccgaagggcagctctcaccgggtggtcagacagcacgctggacacccaggggcccctcgatgctgtgacacgccagggaggcacccgggtccctgatgttccagtgcaggacaagtgacagcccacctggcccactcctccccccaggttcatgccccacccccactccatctcagcagagtgtcccgaggcctccctgggttgtggtgccgggcgagttcccctctctgtccaggactcccacgctggtgccctgggaagctggggggctgtaggagaaggacagactcagagcctggggctggcttataaacacaagagcttttcccacgtcagcccttggcgtcaacttgtgagggcgtccccatgcaggcgtgataggcagaggctgtgctgagggccggggcagcagaggaggtgggcagggcccagaggcactgggtgggtgcctcgcacaccagggctagggaaccatttgttctaagctctggattacagatggggaaactgaggcccagagaggggcagggacatggctgaggtctcgggggacccctgagcagccaggcctccgctgcctcccttgggcgggtgtgaggggcacctgcggtttggtgttaggctcccacctacaggggcaaagcccaggctcagaggtgacctggaatcagcgaatcaggggccgagctggactaggcaggagggtgtgtggttgcagcaggtgagctcatctgtaaaacgggggtgcgacacccctggccctgccagcctgtccaggtctgcgcggcacttggcgctcccagcaccacaccctccaggagaggcccagctgggagtcatctggaagaagtccctcctggcccaggtgggcaaagagaggaccaggagggaatgacgtcgagcacctcttcctcattggagccctcctgggtgaccccgtcctgtgcccaacacgtgactgttctccctggggctggccacgtgggggtaggatctgagcacccctgcagctgagccacgagagcacaggactccccagggctctgcagggggcctggcctcagctccagctgagttctggagaggtgctgcaggggagagttaggtagacacacctggaggcccagaactagccgagggatggtgaaggggtcatccgtgctgagtccttgagggctcagtgaggcccgaggaaaggtggggcagggtccagtctggagggtgaggctgggccttgtggcctgtcctggggtgggggtggggaggaatcagtttcaagaggcagccccaggaagagtaggggcagaggagggggtgggacttgacaagcggaaggccctggctggggctgggcacaggctgctgggccagtggggcgggggccaggagtcatggagcaggtggtccgaggagatggggtgagggaccatccagggggagggaatggcaggggacaggactgggagcaggagagtgtggtctcatgggcggagccacttccccaggcctgtcctggccctccagccgcagcccctcccctcggcccctctatctcctcccacctttcctactcacccctccactccctcctgcacctgggcccgcccctccacagccagagacgttctgcagacgctgagcttgactgccccctctccctggcccacagctttctggtggggggtcaggatgtagggggtggccttgaccctggagtcaggcagggctgggaggggaattccagctcctttttgaggtggcgcctgggaacgctgggttggtcccatgatgtctctaagcctcagttttctccgctgtgaattgggtgcacagaccccttcgggtgggggcccagctctggagggtgggcggatgtggccacgtgggtcccctctcatcccgtgaggggtggggagcacagagcgctgggctgcagaggccctgaaggagagaggaggggctgtgtgtgaagaggcagggaggctggagtcagaactgctaagccaggtggcaagcagggtgtgcgggtgtggagatagggggtgtccagctccaatagggcacacggtgggggtctccagcgcagatagtgcacccccaccccgctccatgccttcaggcctccaggaagctggggcaggcacccaggcgacatttcctgctattaatggagctttaatctaaacaggccctaatatttacatccagacgcctccggctgccgcgggtgccagactgtgggagtgatgagcccccagacagcgcctccccacccagagctctgctgggccagaccagagaccgagaactgggcacctgggggccctggtttgagccccctccctgaccacccccaaagcctaagtttctcctctaggaatggaggtggtcatctcaccctcccaggttcagtgaaggggccactcagtggcacttagtaggcccacagggaggccagtgctccctctccctggtgtgttggaccagctgtcctatcccctccctctccctctaggccatatctctgctgatatgataggactcagtggctgtgggtggtctggctgcctcgcccacctccacgtccttgccctgggtaggcaggttcgggatcagggatggagcgccttgttctgctggtccatgccccccacccagctgctgtgcccacaccctgctggcaagtcagccacttgtgccccctccatcccctgcccatcagagctgggcagggctcaaggcccctaaatctgcctcccagcagggatgacaaaaccacaaaaccactgccgctgcctccctgtggagccctgctggtccgcaggacacagagttggggcgtgcgtagggctgccaccctgctccataccctccgccagctccatgtcccccaccagcccaggaccagagtcgtgggcaagaatagaataaacagctttaattccagacgaggacatctcgtgaaggagattgtttacgtcggatataaatacacacaccatttcacgtcacttgggcgttttgaaaatctggaaagggagatcatggggagggggcgcaaagatctcacgccctgtccccgtgagtgtggagagggggcacgcacagatctcacctctgcccctgtgggaccaaggacagtcttggtctgacttttgaagctcctgggcctcggtgcccacagaggaggctgaagtgggaaggagccggccgtcaggagaaggaagcaagcagccgggggagctgtggggcccagtccagggcattggggtgacccccttccccagccccctgccctccagctgtaaggctgaggagaggagaaagaggagtggggtgtggagaaactgaggcttgcctatcaagggttctgcatcgggggctggcaggcagttctcagaggtctgagggtgggccccaagcctgtgtccctggccacagaagacaggcggcctgtcctctccagcatgagtggtagtggacgcacttgccgcttcggacaggatgtccttcccctcccggcctcttacagtctgagaagcctctgaggcccgaggaacccaagttgaatgattggatttcagatgtggggacaaggaggggacctggctcacctgccttagagacccctcctcctgaagaaagggattgttccagaaaaattgcaagccctgcctcttcaagcacagcaatcctcaagtgtcagccattcactctttagcgtgaattagagtgacaaccaggaatggagccaggctgggggtcattgatggggaggccaaaggcccgaggggcacgtaacaccggtggaggaggggcagggaagactggcggggaaggggccgggaagactggtaggggaggggaggggctgggaagctgcatggaaggcccttcactggccccagcgaggcgggcgcttggccttacctttgcccaggccattccccctcatcttagcactccttcccgctggcccctgcctccttgcagccctgggctggagaggtcttcacagtacagtgcgggaccaagggcagaggggtgtcatactctaggccacgtgcagagcttgcttgaggggcgggagtgggagccggcaggtagtctctggggcttggggcgccccctaagatggagcaagaggatccacagctcctggaggaatggagtccagagtccctggccctggatgacttgtgagcgtgggtggaggggtcccaggtaagcaaggccattcagggactgctgggccacatgagcctggaagaagctcatggcttgggctgggcaggacacctgagccctgacccctcactcctcagctctaggcatgtgaccacgtgggtgccagctcgcagccctgggaatgatggctcgctggctgttggtgcctgcttgcctgaaagtcgccgtgaatgctgcacctgtggtcagcggggtttttctgcatgcacagccctgtcccccagccacgtcctttcctgaacgctgggcccctctgccttgtggaaccctgcatccctggtaagccacggcccctctctgagcagcacccgagagctgggggctgggggaaggttccagaattgtgcctggtgcctggtaagtatcaagaatgctggcggccatggtgatacccactgcttctcgggcatccggacccagggaggaagtaaccctggcagcactcccagttccaccaccttgcggggcacgcctctgactcctctgggccggtgccccccaccccagctgctccacatggccacagctggggttggtgaggacaatactggccttggatgactcaggcactcactctatgaccttggcaagcccctttctccctctgagcctcagtttcttcatttgtaacatggggatataaagtccaggaccctaaactggggtcaggagactctgcctcgagctgaatcggggagccccggccttttcctcctcctccccctcctgctcccagccacacaggccacggtcaccctgagtgtgtaggacttctctgtagccaaaggcctggcctgaggacctgagcccatctcgcctgcttcagtggctatggccaggtctgatggcagggcctcagagccggaagtgccagggatgccccacactcctcttcctcaccacaggctcccttccccattaccagtcctgaaagggctgggagcttggacgctcggcagaaggcacgtgggaggaaatcctggagtccagctctgaggagatgatcagaggccccagccagagaaaagctccctccctagtgaaggcatggggactcatagtgagctgggccagagcagctggtcacgtcctctctgcccccggggggaggaaaatggctgtttgcatggggagatggtggccacaacccggcatgcctgggttcactgctgcgtgactttgttcttggttttcttatccataggatggggctgtgaacactgcctctacctggggcagcaggtgagccattctgaggccattcctagagtgggggctttgggatgatcgtgcactctctgtggaaggaggtgcaagggcactggaggaggtggggctggttttcattctgaccctgccatttcccagctgtggcccctgtgtgtgtcacttgacccctccagcaccaagaaatggatgaaaagtagcgtctcctttgtgggttgttgtgggttcaagtgtcaacctagatatcacagtgcttgctcacagcagagcggcctgtgggtgtctgccgttttatcgtgcaattcacggaggcctcaggtgggggggtcttgcagagacatgcacccccccccacctccattaatgcaacacgaatgctccctggccttttctttctgtccttgtccttcctcctgtgtgtgtgttggagggagcattgttgttgttagctctctcgggaattcaggttgtttcttaactctcttgggaattcccagcacctaaataatctttgtccttttttcttttttctttttcatctcatccttctaatcaatggaatccactgtgcccttttttctgaggaactccttctggagacaaactggccaaagtgaggagcagctcccggctacccctgtgagttttcagtggacgtgctataccccaggaacagcaaatcaccggcattcaggccaccacatcccatcggagccagtggcagacattgctaatcaaccacagcacagtggccttagacgctcaatgcggtgctctgggtagccatcaccaatcaatcgagatggaaccgattgccacccctggcatggtgggtgtccacgctggcatgcccagatgagtcctgaccttcggcccctggcagagccctgctgactaagcctcgggcccattagccagggcctgggtgagggcgtgagggccggcactgaggatgtgatgacggcctgagcccttggagctcctgtgcatgctgaccacgtcaccgctgctgggctcacgctctccgtgctggccgaagaggcctcggacggtggcctggaagccactggtgacgaagcagtagacgatggggtccatgcagctgttgaggctgctgagggtcacggccacgtggtagaccacgaggctcgtgtggtgtggcatgtcgggccacagcgccacggccacttggcgggcgtggaagggcgtgaagcagacgagaaagatgatgagcaccgtgagcaggagctgcatggcccgcacgcggcgctggcgaccctggtggagcagacccggccgcgacagtgcacacatgatgcggccggtaaacacgctgatgaccagcaggggcagcaggaactccaggacagtcagcgcaaagacacggcagcagggccggctgcctgtcacgcccagcaccgacagggtgacggcaccggcggccagccacacgaaggcgcacacggccctggcacaggcaggctggcggcagcggcgggagccttcgggccgcacgatggccaggtagcggtccacgcagatgcaggtgaggaagaggatggagcagtgcatgttgaggaagtaaccgaggacgtgcgggaaggcacagcgcaggcagcccctggcgccgtagtacacagcgaagcgcgtgggcagggacagccctaccagtagatcggtcaccaccaggttgatggtgtagatgactgagggtgtcttggcccgggtgcggcagcagaagacgtacagcgccagcccgttgagcaccagccctgccaggaagatggctccgtgcaccgccatcagcgccagccacaggcctgggaaggtgccatgcagctcctcgtccagccgggcaaacaggtggaacaggggcacctccagcccgctggcattggtccgcactgttgtcactgcggtggcattggggactgccccggccgagggccccgctggagacacagagggcatgacggcagccagcacaccccaggcctggaagcaaggagaccaggtcaccccaggcgccagcctggccttaagccctgccctgaggcccagaactcagctggcccgtctgcccctgcacgcccagcatcccccttctccatgccctcgcctggctggggcctcaaatgcctgctcccttggctctacccagagggagcctcggacagcagcagaaaaggcacaggctttcagagtcagacgcgtgttcaaattccaggactggcacttgccagcgtggagactcgacaaaatacggaggtttctgcgaccgtcctggcacgagggggaggcggaaacacgtgcggtgcagggctgtcctcgggatggagagctgataagggcaagaccacggggctccagtgtgcagttccagggcctggctccagccccagctgtgccactgactagtgtgcttgctcgggtaggccacttaacctctctacctgcttcctaatccatgtcactgggatcgcgttgctgctggggtgactaagcaagcgggtcagcacggcagcgccagcagagttggtggctgatgacccagttctgctgggacagagccttgttcatggtggggacctctgactgccctgcccactcccctgtccccacacccaccgtcatggcccccatcctccgggaccacccatctgttctcccctcctcctaggccagcatcaggtcaatgccctggatgggggtcctcatgagggacctttacaaagggaattaggctgtccagtggggctgcatgggagccaaggaccagtctcactgggcaccccaggctcctactggccctgagaggcgggcacccctatgatccccccaaactacagaaaaggagacagaggcccctgtggggtggctggttggggctgaagcctggagccagagtgtgagtcaaataaacaccgagctcccgtctggcctgggcaggggggccagggtggggggcgggcgaggggctgtgccggagccacccactctgtttatgttcctgccctggcgtgtttaactcggcagtgatttatccctctatttataaatgaagggttaacggccctacccccaccctacagctgggctgaccctccaaataagggcatttctggctttttcaggagaaaggagaagtctttggggccagcagggtggggaggctcgtgggccgtttcttctgcacagcgcccctcccccacctgctggagaagggaggacacttaccccttcccctcctggtggcccctgctgtaaacaggctgtgccccgccactccctctgaccagtgcgtggccccatcccacccctggggaacaatgagccctgccttcaaacagcccctggcctggctcagggcagcaaaagaactcttgctttcagagggccaggtccctccagtcggcggccaccttcttcctcagagtcagagaggtcagtgcctgcatgaggtcacccagcatgccctctgcctctgggaccccagccctgggtgcgtgctaccctggaggctgctgggaggagtcaagtgctgcccaggcctgtgcccagcccctcctgccacccccaccacacaagggcccaggctcagctcccagctccccccgactgcaagcaagctctctatctccaggccctgacacgcgggcattgatgggtgcatttgttggatgaataggtctgtcctccctcagcccaggtgtgccaccagagacgggatttgggggcacagcaggcagccaggggaggagaggaggctgggcacatgggggctgggaacctggcgtctcagggctgtgggcttcaggagccccagaaggtccccccgaaagagatgcgtccctcccctgctgtggatgaaacgctctcagaaaaggtcgaggcggctttgcagctggactgagggactgcatggccaaaaaagtattttgggattcctttctatgtgccttttgcttttccaatttgtctgcacggggcctatattagtgtcccaatcagagacaaatcataaacaacacagaacgtttcctgtgggagtgagtcccagggtgatgctggcccctgggaattctgctgtcccagaaaactccccagggccagcccagcaggctcaccagcaacgctgcggtgctggggtcctggctagggatgtgggggctctgcggtctctggagctggggggatgggcagaatgtgctggacaccccagaggccagaccggagaggagagggagctagcaaagcatgctctgattccccgcactaagggtctgaccctgatctcaaacaaagctgaaccctcatcttggtcacacactgagccatgatcccagtaatgtgatgaacctcgatccctgtcccactctgagccctgaccctggtcacacactgaccccaatcctaatagcacaatgggcgttgattcctgtggcgctctgagccctgatcccagccacgacctgggccctcagcccggaccttctgtccctgtctctgccctcctctcccagcttcgtctggctgtctctgtctccatattgtcaacccccacctgcctcccacagcgacggatgtcccgattcgattattacggggcctctctggggctcccactcaccaccctctttgttcagaaggaggaggaatgcaagcggggactctagaccctgcaggggcccatggaagtggctccctggcgagtgcctggggaaaggagaaggttccgcccctcctgggacagcctggctctgcctgtgggagaggcacagactctgctctccggagggcccgggtgatgagcagtcaccagcacagagacccgggtttgagtccagccctgccactccctcagctgagacctgggcctggtcagtaggctggccgtcctcatctgctgaatggggtcactcgtgccttccacagctctgcctcgccctggtagcctggactgaggggagaggcatggttttaccctcagagccggccggagaggggaggcagggccctgtccccaagcctagtttccctaagccaaacctgggtgtgggggagatggtcctgtctcctccctctttcctggcaggcaccctgggtctgtctgagacagcagactccatggcgggggccaactggccagagtctcatgggcagggactggcaccgtgtcctgatcgtgctgacatggtgttggggctcagggcctggaggctgtgccagggctgggaggtttctcttttccactggcccaggccagctctgctccccacccacacacaggtacttccttggggacagaacagagggaacgagggcctgctctccagggctgagagtcagtgagtggagacccagcagggtagggacctggagtgtggccatggagccctggctctggcctggatggccctgccaaagcctggctccatctctgaacggactatgtggccttacagtctctgagcctcagtttcctcatctgtagagtgggcaaaatagaatctcccctgggggttcttgtcctgatgtgccagcccagagtaggggctcagacacaggaagtgatgaaagtatgggacaagctgccagcgggggacccagagggcgagggggcgagctctgctccaacctgggtgtgcagcctagaccaggtccagctcccacactactcactgcccccgccagcctggagggagggctctgacctgggtgggtcctctctgagcctcagtgtctcctcctgtgaagtgggaatggccggacacgctgccctgcatggctgtcttgggccttggctgaacagagcacctgctgcaggtgtggcggggcaggggcaggtgtgctgcggcatctctttcttttctgtttctggcccacccttccgggtgggcagacccccagagcccccacccctccaggtgggcacacctcccagagccccggcctttcaaggcttcgctgagctcctccaggggagggggcagagggtgaaggaggatgtccctcatgccctccccgtaggtatcacatcacaaaacagccgtcctaggcggggctgccgctgggttgggggttctccctgggaggggcctgaggcctggactgctgggcagggctggggatgtgcctctccagtcactgcacctgactgatgcttctgcaggcgaaactactagcggggcctaaacactccatgcgccctccaggcccaaccccaagctgttcctgctctctccctttcggcttattcatgcccatttttaggacttccccctggacttgcctccttaaggaagccttcttcctccctgggctgcctctctctggtgcatcctcccagggcaccctgcgcttcctcaatcccagggttcatcccacggcgctgctatgtgctgcaggcttccctgttggactctgagcatcttgaggcggggctgtgggtgggggctgagctcccatctgttccaccagcccagcacccagattggcctggcagagagcagcacccgtcttcccccttgtctgaatgaacgccctgagcaagcctcatcagggctggcaaggtgtggcctggtttctcaacctggcattcagggtgaatgccacctggcctggccccctctgaaacctgcctacccagtgtcttggtactggtctggaattggcttccacccccagccccatcgtcactacccatgagtcctcccagccgagcaaggctgacacctcctcccggaagcccgtcctaatcactctgaccattgtgtccacacttacattccttcccaccctctatctcccatcaccactctttctttctttcttttttttttttgagacggagtgctgtggcgaaatgtcggctcactgcaacctccacttcctgggttcaagtgagtctcatgcctcagcctctggagtagctgggattacaggtgcccgtgccacacctgggtaatttttgtatttttggtacagatggggtttcaccatgttggccaaggtagtctcaaactcctggcctcaagtggtttgcccaccttggcctcccaaactactgggattacaggcgtgagctactgcgcccggccccatcaccactcttgatagcaatggtctttggtttgcaggccagctctaccacccgccaccttcgaggcctcgggcaaatcatttcatcactgggagcctcagttccctcacctgggactttgggaaccatatttgttgaatgaatgaatgaaatcaggcagggtggctggactaagtgagaaatactgcagacacccccaacatgggaggcgtgcgatataagagcacgggaggctcctggttttggcacctggatggggccctgtgtggaccagcccgctcacacgtggggagaggccagggccaacacgtgtgctcagtgcaggacttctcagagcctttgtgaaactcacggtcctgggaacttccaaggggtgggagcgagcatcgagcatggaagctatttgaccctgtcccctccctgggggttcctgctccatccatcccaatggccacaccactagtccatgcccagagcactgatgggggctgctgcctccctgccctcacccacagcttgttgaatttctgctgggcacccggccatggaaggccagacccctgggcttggggtgctggcacctgcccagaggcctccagcggggcaccagggtcatgccggcctccgtccttggccggtgggtggggagggctatgtcctctcttccctgggctcctctcaaacccaccccaccaacctgggagttctctcttggctgcccagcagcctgtctgcctctgtcctgccacatgtgagaccaggcagcagagtggccccggccccagggcagcagatggcccagggtggctgttgagcctgcctgggggtctggctcaggaccctgtgtgctgtctgtggacgtgtggaggacgggcccagccttttccccacagaggggctctgagcacctgctaagggcgctttgcatccacacagcaatcccaggttttacagatgaggaaccggaggcccagaggggtgagtggtgtcctcacggttacccagcatggagctggtggggctgggaatcagacccaggtccactggcaggacccggcacaggccggagtggagcagagtgcgggctggggagcagaggggctggattaggcatctctggaccgggagtttgtgcacaaggggattctccgggccctgaggccgcatgtgtgaccacgggtctgtgtgtgcttgagcctgcaccccagacggcgtggccctcatggccttccagggctaaaatagccatgattcggggaactgtctgcctgtttatttttatgattattcttggtttcacagcatctgcttttgaatatcatctgctgtttttgataagtctgagcctccgtttcttccaccaagaggcaggtgggtgcttgctgagctctccaaatggggtcagactcaccccaggtcacctagcaagtcccaggtgaccctggccagaagccaagtctttctccctgtcccccacgcccacaggccagggctccctccaccccagtgcagagagagacgtcactggtgggcacagactgagctctgtggggaaggacacctgggccccatctgacccgactctgcctcagttccaccagctaagagccctcttgctgagactgcggctctaacggaaacaccagtgtctctgggaggggcatagccagttggaggtcctgcatgtcacctgccagcccctccctgcctccccatcattgggttcattgctcacctctagctgggtgtctctgggaggggcatggccagttggaggtcctgcgtgtcacccaccagcccctcctttcctccccatcaccgagttcattgctcacctctagctgggatagccgtagctgcagcagctcctgaaacccctccccaacctcagcctctccaggagctgctgggacaggcattctgtcatgtgcacctgcctggcctcagcctggtccttccgcctgaagctcctcagcctggtcctctcagcctcttccctctgcatgtgctgttccttctgcccggaatgctgtttctctccctgtgccacctggtgaaggctccgggcacccacagtcattgttccacagagctctccctgagcccctctgatgccctagtgccctggatgcccctgccccagggggagagctatgatcccacaatctgaagggcacccgctgggctcatccttcccagggtcttattgacttccctcaagatgcccctgggtgggtgtttctggccccactgtgcctgtggggaaccaatacagaggggctaagtcatgtgtccgggctcacccagctggggtgcaggaggggctgagctctgcctcaatctgcctgctggcactttgtcccagtgcctgggatcagccttctgcggcacccagccctgtgtgtggagggaatcagaggccccaggccacacagccccgtgcagtttggaggtgtcagaccaggacttagaccccagcactgcgggcacaaatgggtcccaggcagacctggccccacctttccgagctgacagctcagggtagggtgggaggtggctggtcacggccgggatgggcctcaggacaatcagagggaagagcgctcccggcagcaggaagggcacagtgagcatgaagggccagaggtgggaaggagagtctgtgttcagggctctgtgagacaccgggggcgtggggagggctttgggacgtatggtgaggggatcaacttaaggttctttgggccctgacgcccctcctcagggaggccctccagagcccacagccccgcacgcctgcaccgcctggcttccttcgcagtgccctgccacgcgcagttccctatgtccctgctttcctgttcgctgtgcttccctcactgaactggagtgcctcaggggccctggccttggctggcccctctgagtcactgagtcactgctgagtgatggagtggatgattttagaatacccctctgatctccttgagcctcagtttcctcatctataaagaggagatgctaataccacttaacaagaagacaatgaagccaccccgtgggctccaggagctgctcagaaatggtccaaactgcatggcccccacgcccggctctccagccgcagaccccgcctttgctgatgggcccacaccgtgtggctcagagaggggcagcgacttgccacggccactcagcagaccgccctggagcccagcgactggatgagtcctggggggagaggggagggaagacccaggatgaccagctgttgaaggaagaagacagggcaagtggacaggcccagcctcctgcggggtgcattccccgtcctgcgaggtcgccagctgctccacgtctgccccgccagcaccctggctgctggccagttcccagcccgctgccccctcgggaccctgtcctgccgccttctcacagcgcagtcccagtgcgagcttcgcggggctggagccagcttctaggtccacactgagggctggcaagcaagccttccctgggactcagtttccccacccctaaggggtagagacagcaccaaggctactgcagagggcctgagctgtgggatggcaggacgggcactctgaagagggagcatggcgcttggagcccatgcccacaaagccctcaccatggccctgccccagctgcggggtggtggtggctgaggccccagagcctgccaagtgcctctggggtcccccaactctgtccctggcttggcctgtgggccaccctgctgccttgccaggtggggaaaccaagacccagctctgggcacccagcagatgctcggtgagtgttgaacggagggatgaatgagtgaatgaatgaaatccagagttgggtgggcacctagcagcgcagctcccccttatgcagccagcccaactcacgcccatgttctccctcaggtctctgttttctcatctgagaaatggctccctgtccagcaggacctgctctgagctctccccagcccggatctggaggcagtttctctgccctgcccttcccactcctgcttggctgggggtgagaacccctgcagggagcagctcaggagcctcctatctagggaagctggggagagggaggctggggccagcccacaggggaacttaccgcgcttcacccgggcaggctggagatgggagtcctcagctctcagctctgcatgcagcccggacctcgccttcctacggcctgacgtcaggccagcgcttggggctccttttgggcaaaggcagggtgggggcggggcaggctccttccccgcccccaggaggagtcaaggctcagagcctgagggacggtgcctggggcaccagagtccccacacccactggagacagaagaagaaaccgaggcacagaggggcctggggcaccagagtccccacacccactggagacagagggggaaactgaggcaccgaggagctgagcctcagctgcaccatccaggaggtggtggctggcacttgtgtgtgccgtgtgcagggcaggaggtgggaaactgaggcacggaggggctaagcctcagctgcaccatccaggagacagtggctggcacttgtgtgtgctgtgtgcggggcaggagggggaaactgaggcacggaggggctgagtctcagctgcaccatccaggagatggtggctggcacttgtgcgtgctgtgtgcggggcaggaggggaaaactgaggcacagaggggctgagtctcagctgcaccatccaggagacggtggctggcacttgtgtgtgctgtgtggggggcaggagggggaaactgaggcacggaggggctgagtctcagctgcaccatccaggagatggtggctggcacttgtgcgtgctgtgtgcgggacaggaggtgggagcacacgaaagcccaatttccttcccgggagggggcatgtgcatggtagcttcagcccacgcaagcctgggttcctgcatggctctctgttttgcatgtgtcctgggtttggctgtgtctgtgtgtacccatgaccgacagcctgcacacctggcatctgggcctctgtttgcacccatgcaccggtggcatgtggcatgtggggtcaggtgtgtgggaaagacctggacgtgacccaggccagcaggtggggagagcgtgtgggacccggacctcagtgctggaggaagcgtgagctcatcaacaggcttgatcccagagggctgctggagggccactctccccagacagcttcagagccaggaggccttgtggccagcctggggtggcagcgggggttgtcggggagcggttggggccatttagttagtgtctcctctgccgagagcaccatctcctcttgttcccatcccgtgtgcttctgctgatactcacactttaaccttccagccgcctgagtgccgaggccctgctgagtgggttgtactgcacaccggagactcagggaaggctccccaagggaggggctgggccttcccgagctcaggctggttgtaatgcagaccaacaggagagagtaggtgggccctagggtcctgacccagcctgctggggagggatgccgtctgggaaggcttcctggaaggggcagagggaggtataacaggaggcaggcagcccagatgggcagagggacaggaggccatcagaatatttcctggggagcaaagctgggagtgggcaggggacttctacactgagtctcagcagcctctatgggtaccagagtgctgcaacagggagccattgaaagttctgggagaggatggtttcttcactctggagcagcctccctgcggctgcagggctgagcccacaggctgcaattatctcctttagaacatcgttgtgtctgttttagctggggaaactgaggcccagagaggcacaggagtctctggccaccagcctcttgcacctctctggaccaggactggctcctggcaggcagggtttcaccgggcttgtggaaggtgggggtggatgcaatgtcatttttgtgtgggggtggcctggaggcagcccagattgggcagggctggagccagaggaggctcagatttcctgagcaggcgagggtggctgagtcaccgcaccagtgccaggcctcatgcccacctctgagggcctggggctccagccttgcactctcaggcttgttctcagagaaatctcagagacggtcccccagcaaacagcggggaactgcctggggaggggtcacagcccacgccagcctccctgactcctcccccagggagactcttctcagcaggacccagggatcctcttggggggacaccagggatgggggtcccgagctcagggccaacactccacaaccctcagaggagacagggcacagggacaatttcctccttgtcatctttatcaggctggcaggtcaggccaggctgtctgtgactggggtcaggggtcagaggtcagagagtggctgtgcccagggtcaggaccccttcaggtgtgtctgactggcccttcgcagggcaggactgctcatcctgggctctggcacactttgcagggtgggaggggccccttgggcagacactgtagggaactgggcctggtggagagccctctcaagcccatggaagcatccttggaggccctgccagcggtgaggcatcagcagcctaccattcctccttccccaagggacagggtgcagggaagcgccacaatgatatctccacatgagccgccagcagggctaccaggccaccctgggcaggaggcagaagtggccccttgtgaacctccatgggagccaggtggacccatggctcctgtcctccacccttggcctgtgacgccaaggccctctcgctgtggcagctgcagttgggaatcccataacgctgcaatcaagactgacaagccccgcccatcatgggcagtgctggcactgtagggtccccatcctgagggatgaagccaacaacgggccactgagcagtccccggggtggagagggctcaggataatggggaacagcagatggtggtgacaggcgggttctgccacccctgctggtgcctgacaccgcagacctcgtctgtcctcctgagagaccctcgtcttggtgccactcgaggatgtaaacagccccgggaggctggcagccgttttctgccatgtgtccaggggtgaggtcctcccaagggggcctgcgaaggtggggtgatgccagccagctctgcaggactcccacctactcgagaggccagagctatggaggaggggcagagggggagtgcagagcttccagatgaggggtgatcgggagacctgcaggctccttcctggggggtccagtgcccacaggccctctcctgcactctggacttgctgggtagcgggcaggcacctgccattgagctggggtgggcaggagcctttctctgccccagggagaggtgagcctgcatgtccagggaatgtgggggccccttgtgcagccctgggttcaagcccagcctggcgcctcccttgtctgctctgatcctcagccttggccctgtggcctgtgctcacggctgggaaggggcgtccctcctctcaggaagcgctgggtcctgccggccacatcacagctccacagggaggctcagccccacagtgggaaccaaggaaactgggctgggggtacagggacaggaccagccccaaggcccacagcagtgaggggcagcctgggcccagtctgcggcctcctcctatctgaggggaagacgcggaccccacggtagcagagcatgtcggggctccaggggtggaggctagaagaaccagggcaggctatgagaccctgcagggcagagcctttgagaggtgggtggggaagtacccagagtccgggatcatccaggccagtcttggctgaatgcctggaactcagccacaactggggacgtccagggtacctggtgctgtgcctggtgcacagttagcgcgcggctctggggctctagggagtcatcctagggtggctgctgggactgctaccctctgggctggccccctcggtgccccaaggcacccccttatgcctgctcaacactgagggttccccccagggcatcttgtctcaacatctgctcttacacacagggaaactgaggcccagaaagggaggaaggcctgtccaaagtcacacagcaaatggggcatgcagaccctggctggaaccatgcctggcttgcagccccccagtacccttctgttaaacccagtctcatggactgtgggaaggggcacccacagaacactgcctcatcatggggtctggcagggctgtggccctggccacagctggcacaaggtggtgagactcagtgtgggctggtactgctgaaggggcccacacggaagaagctgcagccttgagccccatggagcccagggagggtccccgcagggaatggcgggggacagcagcgcggggcttattggtgagaaagcagagggaaagccccaggctcctaagacccaatccgggagggattgctggtggaggaggtctggtgaccagccttgcaggctctcccaggattcacactggctctgcctggccttgccatgggtccaggagcctggggtgaggtctgagtgtggagtgtggaatgcgtgtggggctagctgagtcttagcttacagaatggggcagcagggcctcagggggaacactgggaccagaggaccttggaacccgccaagttggccccaccttttatacatgtggagatgaaggccggagaggggcttcagctatcgaagctccgaggcagctcagctccatgccagccttcctgccacctgggcaggggtgccccttcacgccctggccttcttgtggccagccaggttacagctggcagctgggcaggggtgcagttcccaccatctgggtctccaggcccacccagggccagcccaggaggtgctgggtgagtggtgggttcccccagggcagagacagcaggaagaggattgccaccgtggggggcttcccgtgtgtcccgttccacctggcctgtgcctggaccagcacttctcatcccgcccacctcctggtgagggtcctcacagagagcaaggggactaagtcccttccctccctcgggctcacacagctgggcccctgaagagtcaggcaggaacctgggagctcagaggccaggccactgggctcccaccaccccgggaccttccacttggggtttgaggaggcggccgagcctttggggtctgacccacgttggggctgctgtggcaatagactccccagggagagggagaggggaagccccgggaccctctcaggggcctggccctgctccctctctccacagcctcctctgacacttggcccagccagggaggggctctagtgggatcagcacaggtgccagagcaagcacaggtccagcaggcttggtggccgggggtggtggccatgcgggccctgcttggcacctcttatcccaggcactggaacacaaaacagggcagagtatgaggcactgctgcgtggagccctcctgggatgtgatccaagggttgaaacccctggtctagcaggtcagtcactcaacatgcagcgctcaccgagacaagtctataacagctgccgctcactgagagcttctggcgggccaggcacaggggaagcacttcaggtctattaattcccccaaataatcttataatggggcatcctgttcccatcttcagaagaggaaagggaggctcagagaggcaaagtcacttgcccaaggtcatgcagctaggagggtggagctgggaccaggcctggagtctctcagcccttacaaagcccccaaattgccagagctttctctctggaagctccaggaacccatcacctggggaactgtgacaaggaccccacagcccgggaaccccaggggagagagtgtgaggtctaagatccctcctgggcccaggcgcctgcccggggtggcccaggccagccaccacaaactggccaggctgggctgagctgcaactccctctagagttggcccagtccacccaggtcaagaacaggccacgtccccagcagggctcgggacctgctttctatttcagcacttcccagcccccgatggccccttgggacaggaatagctgtgtctgtctgtgtctgtctgctcggcaggcctcagaggagcggccccgggtacccgggttctcctgaccttggcttcctcgttggcccaggagcagggagcatggatgtccaggggtagtgtccgtgtggggacgctgcagtggcagctgctgttctctgcccaacccctccaccttccctcatagcaatgagctttggtcactgtgagtggccaaaatggcctaggccagcacaggctaaaagctactggctggacatctggcaccggtgggcagggaaactggtgacctctaaggagcaggacgtggagacccaggctctgaactctctggctctgagaacaacttttaggaagttgcttgggttcagggtttctgggacaagccctcccaagcactggtcacaagctcaggaccgagaatgtgaccccaaggtctctcctcactgtctctgcagaagcctgagagccttcccacctgcacaactctgccccactgttctctccacctagaaggcctttcccacggatccaaaccagcctctagccacaaggccacctcttccaggaagcctgccctgactggtttgtcttagccctgaattctgagggcagtctgggcctggatcaattgctgggattttcctgggccaagtttgtctccagccaaatgtttgactcctctgagacacggccaacgtttcgctggtttcttcctcctttctgttgctgagcatgtggggaggtatatagtagaagctcaataaatgcaaatgcctactcattttaaaaatgggtgggaagggcagggctccaggctgccatggccccattgcaggcacttgggccccttttctgcctgtataaactttcccacagagccttccggggtggcacacactgctcttacgaacaggaagttctttcccgtttctaaccttagtccttcctgcagcagcttcatctcattctggctcctaagagctggacctgctcaccctgccctctcctcctaggggccaggagaccatctcttagtaagtgaaagggatgcagtggtcctgggggatggcggcagtgggatggaccgctgatgttacctccactgtcataagcaaggaaactaagctctgaggaaccacccagctactgagaggtggagccaggatttgaaccattcaggtgagcccagggcctcggactggctcccatggctgtgagcctcacatttccctgtgcggagaccctcctgcagtgggttcctcccctactcaccagggctgacccctacctcccaggggagccctgggcaagtcccagcctgtctccttcccgacctgggtctgtccatctgggcagtgggggtacaaccccagcgaggcggtggaggagtcagggccactatttatagaggcctgctgcctctgccgactgcctgccgccctggaggagtgcgcgggaatgggaggagggaagctgttgttggcggggtaggttacgttccggaaggctggtgccaactctcccggttggcaagcgggggagggcgctgggaaccgagcaaaggggagtggatggcacccgccaatgggcggtcccaacagggtaggcggggccctggcgggggctgcagaccagatctcacgtgcctctgctgaggccccagcccaggaccccgaaatccaaacttctctgagacagggaagcatttaggtaggtttgacacaagctcactcagccgcgtaaactgactggacccaacccgagggtattcagcatccatttatccctcccggtgggcataccaataaggctcgtggcagaagtatcagtgtgtgtggtggaggtgcttcccagaccccatggggtgtatgtgacctccgctaggtgcatctcactgtctttctaaaatctgagccagaccctgaaatgcacacagcctcaaaagtttctacaagccactgtgaacctgattgtctcctgcattttacagacgagaaacctgagacttggagaagggaccagcgggtggccgggacctgccctgggggctgagacgaggactccttgggatcggaattccagcccttgctggtggggcccagtttgaggttgtcccaagagctatggagtctctcactaaggaagtaccttccctgtctctgctaccccctaaaatcggcctgttctgtcctgagcggtcttcctggaggcctcccaggggagctcagcccccactggcagccctggctctgcctagttctgaacccctaccggctgttgttcactgtctggggcacagaccctctctgcctccagccccatgggtgctgatccaggaggggctacctcctccaactctgtcactgctcctccagggtaccagctgaggccaggtcctcaggtgctttggaggtgggagtgagaactaggctcaaagtctaagccccgggctcaggtcccagcatggcccctgaccaaggccagggtttcgtggctcagagcctcagctggctcacttggagtcaagagcattggactctgtcctgaccaactcgtggggccatatggggggtcaagtgtgaggcctgggtcagggctcagcctgtgaccagggtcagagttcactgtgtgaccaggatcagggctcaggctgtgactagaaccaaggatcagtgtgtgaccagggtaggggaccagtgtgtggccaggatcagggctcagtgtgtgagcgggatcagggctcagtgcataagcgggatcagggctcagtgtgcgagcgagatcagggctcatcctctggctggagtcagcagtcagggtactcaacccgatgcaggttaccccccatctactctggcccccttaagaaggcctctcatagaccaggtggccctacgtagggcatttctcatgacctctgcgccttgtcccggggtggggttggcggtcctctttccagtgaggaatagggaggtgctcaaagtcccctcccaggcgctccccacatcccctcccaggctctccccacatctttctcacagtagagctgctggggtctgggatccagcaggcctgcccgtgcagggccccaggccacttcctgcttatgaggcgtgtcagaaggacagagagcaggcccggaaggtgcttagctggtgggggcggctgggagccgccgaagctcaggaagaggtgagggagcctgggtagggcaggcacattcctgggagcggctgaagctcagggaagaggtgagggaggctgggtagggcaagcacgttctcaggctgcagggtggctgcccatggccggggtgcttttggatggccagctccccggttcccatcctgctcgggcctctgcttttgaagagggtcatggtgaacgtctggattttgggccctgtgttccctctgatgagctggactctgggctccagtccccactccccccgccccccaccctgctctcaggaaatgagccttgtgcccagactgggcgccttccctgaccctgcgactcaggcccttctctgtggggggcgtgagagccttgagcctggcaggaaactaggtagcagatccacaaacacaaagggacaattggccgtcatgatagcgatggtggtgacggcagtatcttcatgacagtggccccgcagcagggcacggagccaccttgtgctgttcctcacaagggccggccatggggtgcaagggctgcaagtgagaaactctgcagaccccagccagacctgggggagccccgtctccaaaggccctgcttggtgtggcaggtgggattaaggttggcggtcggtggaggagcaggtggggcttcctggaggggagggaggagagaccccactggtgggtggtgggaggggcagcaggtctcaggcgggagtcacggctaaaggccagttctgggtggggcctcctatcactgcgggcaggggcaggacagctggggatgggctactgagggatcgtgtctagaagcagatggttgctgtgtcccgcctgtgggtgtctggggagtgggcagactgggcatggtcatgggtagggaagggggtgtggccctctcagacccagcaaagaccctggggtcctggccaccagtccagcctctgtttctaccagacacctgtgtgtgggacaggtggacagtcaggtcatttgaaaatattctccaagaggaagctcttagaatctttcgtccctttagctggggtgggtgggggggcaacatcctttgattcagagttttggatctggggtcctgggcagctccaatggcttcacgaacccctagactttgtgtgtgtgcaactgcccatgtgtgtgccatgagggtccattgggactgtgaagggtctgaaaacccacgtgggttagaaccacggtgtggtccggccccgttcagtgcagatggggcaggcagcccccaaagccacgctgagagttggagagttagagccaggtcagctgttgggaagggcttctctgcccccatgccccagaccctccttcaggggcagatttctgtcagagagactgggatgggcctcagatgagccccatcaacatccaaagagaaatggattgtggaagatccgcctcacttgtccagctgaccatgtgtctatctgtccttctccaggaccctggcagagaaggctgccggggggccggccaccaccgtgtggggttagttccaggcagcagcgtcccggtggctttcatccttcacctttgtacatcctggccgtgtttgacatctttacggtgagctcgtgccgttctataaacatacgtccttttcttccttaaagaacagcaaaaagttgcctggagtgactggaagcaaccctcgcaggacattagcaaggattagttctgggcgggagaaagcaggtgactgttaatttcttctttccactgatttgtatttattattaatttatttaaaaattttaatacagaaacccctctgctctctaattgttcagtcacttgcatatcaccatcaggcctgtacatcagtagaggcagaaatgtgtagcttaatgccaacttcccttcccaggttgtgggtgcagggtgacaggaggagagaagccctggcgcacgcctgcctcatccctggctggtcctgggcaggcgtcaccaatcaatgaggctcttgctccccaggagcctggatggacaccccctccccggccctctgggcaaccggcccagtggaccagcagagcaggcaacatggccccgactggattgggtccagactccttaatttatccatgaagaacctgaagcccagaggcatagtaattgccaaagtcccacaagtgttcagggccaggctgcccctggctcagtgttcttcctgctgggagctgggccatgggctctgcacttcctcactctgcatttgggtccatctggttgggactgccaggcagggtgagggaagcctcccagcactgtccaccgtccgggggaatacttaatgtgtcatgtcctccacctgggcaggggcagggcaggggtgaaacacctccctgcccaccagagctgcctcccccagagtcccagacccaggaaccagcccccgccccaccctgaagcctgccaggacccagcccttaccaaggggcccaggggttgtagctcagaggcgtgggatgcggacccccgaccacctagctggcagggggcagagtccggactcagacccaggaccacccatgccagcacacagccccttccccacaggcgcctgtggagcaagtcaggaggcaggacacagccttgaggactgcaggtctgatgaggacagtatctgccctggggaccctgatctgagggaggaggcaacaaaaaatgactcatcaacggggtgatggggacattttgggatggcaaatttggatctcaacccgggccccaccgcctcccaccagaagcagttacttagcctccctgtgcctcagtttccccatctgcatagtgaggacagcaatgtttggggccgtgtgaggagtaaatgaggcaacagttgtggtttgggtctggtccgtggctgtgtggggtcaagtgagcccgtgtgtgcccatggctgcctgtgcatcagaatcaccgggagttcccatcaaacacagacatccgggcctggcccagggaggctgactttaatggtctgggcagagacctggtcatcagcacttttttttttttttttttccgagacagagtctcattctgtctcccaggctggagtgcagtggcgtgatcttggctcactgcaacctccgcctccagggttcaagcaattctcctgcctcagcctcctgagtagctggaattacaggtgcccgctactatgcctggctaatttttgtatttttagtagagatagggtttcaccatgtttgccaggctggtctcgaactcctgacctcatgatctgcctgcctcggcctcccaaagtgctgggattacaggcgtgagccaccgtgcccggccggtcacagcattttaaggactctgccatgattctgatgtgctgccagggtggctgtgcctgagccggcctttggctcttgcgcacacactgagatgccggttcgagtggatacagggggtcagcccacttgtttcccacggccagcctccagttgggctcacattgagtaactgtctgagcccagtcccaggtagacatcgtcagtttccacgtgttccttcattcactcaggaacaaatgggctttactttatccgaggccttgtagataattattttttccctctgtaaaccaagtcctgcttaaatcccatccaaatccctccagccagagcccatgctgcctgcgagcctgctccccatctccggctgagcaggtttgtttaaggctgggctgacacttcttctccccgcgccttggtgtgtttacactggggccatcagcagaaactgcaggtgcggcagggaggctggagacagggcagggaccatgggggtttcagggcgtcctttccacacagtgtctcaggtcgccctgttcccagcctcgtcctcgttctcgttcccacaggcgaggccttggaggtcactcaggacaggggaagtgctgaggcgaggcctcaggctgctaagtggagtgagcccaggaaggctttttgagtgggggacgcccgaattggttttctgtgaagaccagggagcaaacgtgcctgccatggagtgaacggcaggacccgcagggaaaacctcaggcagcggcttgaaataccatggccgtccatggagggggctggtcagatgctggcggtgtgggcagaggaggctctgggccactgcctgagtgtgagtcctgccaccaccacctgatggctgagtgaccttgggcacgttacttaacttccccatacctcggttgcctcatctctcaagggagtaatcatattaacttctcagggtcattgcaagggtgaaatcatctagagacacagagcctagaataccatactcaggagtttgtgctctgccctataggcagtggggagttatggcgagtggttgaatagtgctggagctgggctttctgagggtctgagctcccaaagccttttctgtatggctgggttgtgaggcttttatattgtcactgctgaccaatcacagattggctacccttcctcctggccagtgattggtttagggtgggttagcctagccagctttgggccaatgacaggtgaccagaggcttattgtgggttctgagctccctcctgtccccggatagacaggcagcctttttgtgagcatgaggggaacctgcctgagaatgatggtggggaaaatcttagagaggcacagctgggtgtggtcaccctgtcctggagcccacagtccctctgcacttcccgttatgtgagttcctaaatttcctcactgggaagcctgggattctgtcacttgcttctcaaagtacccagtgtccacatggcagagtgtcctcctagagcccacatctgattgcatccctccctgctgaaaaccgtcaggggctcccaccccttgatgaggaagcacagtgcttcaccccatagcctgtgcctcccactgcgggttctgccggcccctgactgtccttgaacacaccaggcacacatctgctgtggggccttcgcgctgctcctcccttggccaggagcattcttcctttaggccggtcactgctcacctcattgagggccgagctcaaatgttggcccctcagggcaggtgggtggccaggaccatctgggtttgctgcagccacacacacccctgattcttctgtggccttattgatggaggtgtgggtctcgctcacgccatgaattgctggtcggtgtggtgggggatgggtctcttgctccttggtggctcggggacctgaatgacagaggctccgccattgcctgcagccggtgctgtctcaacacaaggcctcaggtcccctgtggtgggggagagtggaagaacagggcaccagttcctaaaagctttgtccctgaagtgtccatcacattcatctcttctactcgcattccaaggaccacagtcagtggtggtggccatgcctaatatgagggggcatgaccccaagcctggaaggggcctggcacacagcagtggcttcctggccatccagtccccgtgagcggtctctcccctccacagcggcgtcctgttcttattcgggaaaaaatgcacataacacaaaattcaccatgttaaagtatgcaacccgccttcattcacagggtggagccccatcacctctgcttccaaaacatttccatcacccgaaatgggaaaccccattcctcccgccgagccctggcaaccaacaatctgtgctcatctctatgatgtgcccactctgggcattttgtataaatggaatcatgtgatatacagtctgtcgtgtctggcttctttcactcagcctcattttctcaagaatcgtccacactgcagcctggatcagagtgtccttccttttcatggctgcatgctattccactgctgagatgtgccaccttttctttgtctgttcatccagtgatggttgacggacatttgagtgtttcctggctttggtcattgtgaacagcactgctacgcgtgttcacatacaagtttttgtttgagtcctggcttttttttttttttttttttttgagatggagtctcgctctgtcacccaggctggagtgcagtggcgcgatctcggctcaatgcaagctccgcctccctggttcaagcaattcccctgcctcagcctcctgagtagctgggactacaggcgcccaacaccacgcccagctaatttttgtatttttagtagagacagggtttcaccatgttggtcaggctggtctcgaacccctgacctcgtgatccacccacctcggcctcccaaagtgctgggattacaggcgtgagccaccacacccagccaagtcctggcttttaattcttttgggtagatacctgggcctcatcccattgcattccttctataactgatccccctccgcagttacttgctcccaacgtgcctctgtttccctctctgtgaactgggcatgttgctgatctccagttatgagcagtgtctctcttaggtggtgtgttctgcagggaggggaagcagccgctgcccctgcacgcgcctggccatgctcacagcatcttcccgtcgctccttgacttgttcactgacccctccctgatgtggccggaggacggggcctggtatcaccttgtcctgtgcaggcctgacacgtagaaggtgtttggctgatgcttgctagtataggaataagctagttctctaacctggagttcctccctgtgaggttttgtttgcaagaaaaaatctgctgctaagccagctgtggaggcacatgccacagtcctagctactctggaggctgaggcaggaggagcgcttgagcccgggagtttaaggctgcagtgagccatgctcgcaccgctgcactccagcctgggcaacagagccagaccctgtctcttaaacaaacaaacaaacaaacaaacaaacaccctgctgctaaaacatgtggaaagtgtgatggacgccacactggcagttttgcttcctcagccagcacctcccacatgctcccagggtcagaggtcagggatcaggctggctcctggtagggggctctgtgtgccctggcaagtcgcccctccctgggccaggagcgaggtgagggtgtccacagcaacaggctgtgtttggacacaagcggggtggggctgcaccacacggggctcttcctgtgccttataaatcagctcccaagagcattccccaaaaggagtttcagctgctcccgagcccaggacagcaggctggtctcccctccggtgagaaatctcctctcccgtctaccaccccaggagttccccagagaggctcggttatcctccaaggaggggatactcgctgccttgccgagatcggaatccacttttgcctgttctctaagccctgctggagatgtgggagtgcccctgccccacagcctgttccgaactcacttgggccatcgcccagctccagcctgtctctcagtgtgaaccccgagagcatcttctgcacccaggtggatgggtggctaacagcatgggcatcaggggctcctggctttgcttccccgcgcctgcatttccttgctgtttggctttgggtgatctgcaggaaggaggactgccaccgccatggcacgcgcctggcctctccactggcaccttcctgttgttccttcccttgttcgccaacccctccctgatgtggccggaggacagggtctggtgtcgccttgtcctggcacaggcctggcaggcagaaggtgtctgactgatgcttgctggatagaggaataaactagagctagatcttggggctccctgtggggttttgtttgcaagaagaaatccccttctctgcagctccctggggctctgtcattgcagagggggactgggatgactggggaggcacgcgccctgctgagggcagccacttctccagcccagcaggctgtaatccgacatccacagggattatcctggtaactggtggtgcatggcccctgtgctgagagggctgcagtgtgcacgccccgtttagagcatcgtatgggttcagcatgtgtccgcggatgggtgcttgaggagcacctgtcagacgggtgcctgtcaggccatatttttggcaatggtagcttcccgggaatgagggatttttcctgggataaaggcccccgtggagggtggtcagcagccctgaggacgtggtatgagacccacagccttccttgactccagagcggccaggaagctgggactccagcaagctgtgctgcccccaccagtgcctgtgttccctgcatctcacatggagcctcactcaactcctgtccctgagtgcccactggtggggacgagggagatggcaactgtggatggatcccaggccagtggagaagacagacccacacgccaggaggatgaggggttgtcaggttcggggggcctggaggctgcctcctgcaggccctgtcccacgtgagagggtcgggacctcaggttcctcagcctggacctgccgtgtcttgggcagcatccagtgtttgggccccacgacctccagggagggtcacttgttctgtggctgccctctgtcccccaccaggctccccatggagggctcagcatgcaggctcagcacacatcaggcatggaggccctggccccacgttccctgctgctgggcagtgcacagcctgcctgagcctgggtccctgggtggggccagctgcccccgccctcttctgggcctggtggggacatttggaccctctgcattgttgcatccctagattcagccctgctctgctccctgtggggacaccaatctcccttcctcagcctcccaacaggcctcatctgctgaggaacgggaggcgtggggcccaggcaccaggcccgtctcttgtcccttcccagaacatcttctgcctcctccccttctcatcttccccttcacctcctccctcctttctccctccctctctctctttcccttccccctccctccctctttttcccttctccctcctccccttcttccttctgttcctcgctctcctccccctgtctcctctttgccttcctcatcatctctcctctctcgtcctcagctcagggaccttcactgaatctggaaaaaacaggagaaacagcctcatcacaaattctccaaattgttcttggattgagggttgggaacttcaatgccagaaacagtgtcattttcctggtttggcaagggtctctgagccctgtgggcccctccagggtctaagaggtccccagaaaacaaggtgggatgaaagccttctgtcaatacccttgcccagaggtacacgtgagggcttcaggacaggaggcaggagcctcactcctgggtccctggtgggccaggggtacaggggagagcggcgttctgaacctgtgtgggtcggggggttgggcaggccccggtggaaggccactccccactctccctggagacctcccgtggggtctccccctctgaagatacaggttttcctaagtcacactgaggggcgggcttgctgaggcccagctgggggtcttcctgcagaccagcctgtcactccccacttgccagtggtctgggctgcagctggggagggcttctgctctgggtctcaggacctggtgggggcaactcatggagcaggctctccctgcattggtgggggtgaaaggacaggcccttccaggctgatctctgggggagggtcctgacccctgggagccctgggtgctgaggaggcctctcccagggccatagtctccatggatggaagtagggggtggtggctgggccagcccccgacacccaccagctgccaggcctgctctgagagtccccgatccctccaccacccttgaggccacacccagctgtggtgtcccaaagccctgctcttggggcggacagggagcacggttctactttccccaccagccgctccaggccggctctgctggaccctgcagtgcagagaggacggagctggaccccaccttgatgggccacaggatgggggcacatcagacgcacgagaggtctccctttggccatgccatgtgtgcgggagcctcagtcaagctgtgaacacactcagcctcaaaggactgagcggagggccccgcgcttgcagatcgcatcctccttcaccgggattgtggggtgaggagcagaccccggctgcggctctgcctcttgccctgaatggggtgctgcagggctggcatgtggacgctttttgctggagtatcccctgaatcccagcagatgaggaagccaggtagggacccgcaggcaggacctgatacagaatttcagggccctggggcaaagtggaaatgcaggcctctcattcaaaaatgttcaacgtcgccctacagcaacagcagagcattcaaccgggctgagggtggtgcccgtgacctgtgcccagctcgtacccagtgcagcggccctgccccacaggccccacgagggggcgcccgtgtggcgtgcctgaggcccgctcctcgcaagcttgcctgccccgaccctcccggcatcctcaatgccgcagcgtgggtgtcccggcctcctcactggcggaagcatctatggacggtggtcctccaggagctgggggtcacaagtgcaatggcaggtgccagatggggctgaggccagcagggctgtgtgtggtgggacacctggccacggtcacccccagggaggccccgtcatccccaggagacaccctagctcttgcctgggaccccagcaccaggccacagggtccctgctgactcccccatcctccctccgccaaggcgcccctcctgcctgctgagctccagcctctttcctccaggaagaacgcttggccggcaggtccctgctcagatgcagtgcctgggacgtgcctcctggatgcccccacgacagtagctgcagcactgtctaggggggctcccgctgcaggtcccagtgatgcctggcacaggtgctcaatgaaagtttgccaaactcaggggcagggggagccaggagcgctttcagctgccaatgggcgacacagctagagcatccaggcttagggtagccccactgctgcaaaggtcccagctcagtgtcccaccaaactcccacaccctacctcactggtggtctcagaagtccaggtcaggcactgccatacctccaccccagcccccaaggggccggagctcagcctgcagtggccttccctcatccttgtaggtggcaccagctgcaggcttgggaagccgccccaccctgcccacaccaagtcagggcaggcctgggtgccccacagaacacagtgaggtggcactgggtggcctctgaggtcagatcacacgtgtcttgctctcctgggtagctccttgtgggggaggccagccccagcactgggaggacacccaagcatccctacagaggggcgtcttgaggaagactctgaagcagcagctaataacctgcatggcctggccagctgggacagtgagagggttccgaaggggatcccccagccgcagtcgggcccttgcatgtctggaaccctggccatctgactgcatctcatgagaccccagccagagaaccgccccgcccagccactcagaactcttgaccacagacgcggagagagagcaggttttacaggcacaactaatacacaaatgaaaatgtcaccatcacagtagcgtggctgcattaacgaaactaggggaaggagggaaatgaaaatgactttcccagctcctgcacgccaatcccccgagtcctggcctccctcaagccctgcttcctcttcgcatcaggggcgtggctgcttacgctggttccctcgatagcagagcctgagatagggacattggtgcaggtggtttatttgtgatgaccaggtgagggagccaacacaggtgtgttatggaggtctcagctggtttcaggacctcctgagaagtgtgccggacacctgaggaaggtccttctgcagatgggaggcaggtgtatccgccagagccctgccacactgcggagggctggccctcctctgcccttcagggcttggtacacacggaaggcaggcactgaggaggagggtccaagctcgctcagaatgggccactgccactgaaatcagggaacagaggggacgtgaagtggcccagagagcatcgttccgcacacttactctcttcctagatgtatactcctgcaccccgctcctgtttacctaactaaccactgaacaacaagctcttttttattttgtttgacgctcagggcttgaggaggattcaaaaggacagtcataaagacatctacttctgcgcaggcagaagcaacgcagcacttgacagccaccatcttgtgggtcttcccaagagccctgtgaggttggagctattactatgacatttatagatggggaaactgaggccaggagaggtcaaagtgtgcagcccagtgatgggggctcaagagctgctgctggtgccattagcccacccatgccctccgtggctggatctaggtcccccagcctgggcccctcctgtagggccctgctgggctggaggaggctttccagaaatccacttaacgctgacctcgtctttgtcctccttggagctaatctgctaatcctgccagccccagtgggcctcaccactgtctagatcgtcctgcatggttggcatccctctccaacaatcccccacctgcgggggcctcctcctggccatgcctccagggctgggcaggtccagtgactggggtaggtggagctgggattctttctgtggaacattcctcaatcctgggggagattctggagtctggaattcaggagactgggcctggcttctgaccccaccttttcacggctcagccatcatctctgaggccccgttttctcctctgtaaaacacgatcactttgagctctcttccggctatgaaatcccaggattctccccaagcctgttcatgcccggcccattccactcacagcagttggacagctctggtttcaccgtgcctgggtttgaatcttgattctgctttcgcttagcttctgcttcctaatctgcaaaatgggggtgtcagggattcctctgcagggctcagtgtggacttggtgggtgggtgtaagtccctggcatgtggtcagcactcggtgaatgtctgagaactgaaatgaatccagcatggaggagcctcctcctttgctcccgactccctgcaggatggtaagagcgtggggaggaaggaggctccagcctctcgggagcccactcaccccagcaaatttgggtggctgggatagaaacctctctgagattttgggcaggagaggaggaaaatagcatgaaacaggcagggggtgttggtgctgctcaggctagatgaagccaaacatttatttattaatgctttttttttttttatcttttttgagacaggctctcgctctttcacttaggctggggtgctggcgggatcagggcttactctagccttgtcctcttaggctcaggtgatcctcccacctcaatctccaagctgggactataggagcatgccaccatgactggctaattttttattttttgtagagatagggtcccactatgttacctaggctggtcttgaattcctaggctcaagtgatcctcccgcctcagcctcccaaattgctgggattatagtgtgagtcactgtgcccggccttaagctaaacatttaaaaaataagaattaaaatgcagccacagtgaaacgggaaggggctgcttttacaggtgctgaacttcccggcaatagaagcatttaatgggaggttccctttttcctaggacctcaaagctggagtaccagggatgttgccttgaccttcccatgtgtggatttctgcttgaacacaccaagtacaggacaccctgtttagcagctaaacgtgggaattgcaccagctttactcccaacttgctgggcaatcttcgggagttgctgaccttctctgtgtctcatcagcaaaacagggagaacactagctctcccaacatgggctgtgtgaggaccaaatgagctgaggagcccagatttgaacccgggtctgcaaggttatgtcctctgagccatccccacccctgcccttaaggaccaggggcctctggacaccatcagcttgcccacctgtccaggatttgcacgcacctgctcggtgccagatgctgggcactggggacaaaccaggtgaggtgtggaccgtgacctgtgttgtcactgattgggggactttctggcagagtggagagtgcagtgggctgagagacaggatggccagtggagactgagctctcagaggcggcggcagctgatggggaccatgcaatgggaaggatggaggccctgggatagtctgcggtgaacttccaggcagaaggaacagcaggtgcaaaggcctttagctgggaaggaaactctgggttggaggaatagcttgcaggcgctctgagagaggctggcagccaggtggcagggaggcagcccagtcaggtggtcttgggacagtttagggtctctggccttcaccagtgaggtggtgtctggagacttttgcagacgaaggcagctctcactcccatcttcccggggtccctctggctgctgagggtggatgggtggaaaagcatctttcagggaagtggaggcagggctggagcagttgaacatctgactgggccaagggtccagggactggcatggaacagggctgggtgggtgaggccgcctgggagaccccagcttgcctctgtttccccctgtactggggcctcctgcgtgaaccagcactggtttttccagtaactggagccacaagcctccctaggaacggctgacccataagaggacgtcctcaaggtccccaagggctagaggctgagatgccgccttcgcctgggcgggcctcgcagcctggaggcaggcggtggtgcagctcgggcaggccccgtccacacgcctccccgctcttctgagcaccacgcgtcccgtgggctccctacccgtcctgataacacggcggtccgggggcctcgaagccggtctgaccccaagtacccgggccaggcggctgccgtcttgtcgccccagcccatcccctcagccagcccgcctggcggcacgggacctagccccagtcgacttagggggaaactgagaactccagaagtttcgtgaactccctggcttcgtccgcatcccgccctctgcctcttcgctcgggcttcaaaactgcccctccgacgcccgcctgccccaggccgacctggcctaggcgcccggcaggcacaggagccaaggtcagtccccgaggccgcccgcgcgaccggagccgcctcctcccagcccaggggcggcctcgggggcggcgggcgcgcggccgcggcgtggggagcgctcccattgggccgtgcccccacgtgacccagcgggtccggcgcgcgccctaagccggtggagccgcggccgcgcctgtgcgcgagggcgcgcgcgtcccgagccctccacccgtcgtgccggcgccgcccggaccgccaggtcagtctcctccgcgcccgctcggggcgggggcgcgcggcgctttgtggaggcgcgtggggggccgtccgcgcgcgagcccgccgcccgctccgggcacggcttcggggccgcgcagccgggagggccgccgccttccccctgcccgcgcgtcccgggaccctgcgcctggcggccgatccggcgggaacgtgggcctggaggctgccacgtgccggggccgagcctcaggaggccgctgtttccccaggcgagccacagaacacccctggctggaagggggtgacccgctcccgtttctgggtgcgcgggagacctcctaccctgagttcatcctgcgcagggtcccgcccaggatctggctctgcccccattcacggctcattttcctcagctgcacagtttggggggctggaaccccacagccttccgtgcctccagggcgggtcgtagatgtcagtggaggtcaggggaaagcagagcgtcaggtctcaggccgggtggagtccgcctcagaccataccagtgttgggactcgggcggcgcctcagccctccaagcacaccccggtagaatcaggtcagcagccttgatccacgtgcctcagggattaaacgggtgactcctgacacgcccctgggcagctggtggcccaggggtggggtggtggcatgcttagctccaagtgggcagagcagtttcaccctgccggttcccggagggaagccctttatgagggaggcttccctggccctctgtgatagcggctccaagggcagcgtgaggtccaggctagctggtcacagtgtgtgcccgggcaccctcagccaagacagaaaggcacgtgctgcaccccctctctctgcctgcgggctctggggtgtgccccgcacacgatggtgggtgttgggcatccacctagtctgtggaccctgggggccctgctcccaggttggagcagtgtcctcggctgcagaccagaggaggtcactgaacacagggtgcctgtggccttgcacagacagaagccgcctggcagccctgtgcagagccgtgcttcactgagttcctgcaatcctcccaagaagttcgttaaccccatttctcagatgaggagactgaggcccacaaaggtggagttggtgcagcccctagcctgcggggctaagcagagccttgttgtccccatctgcaaagggggcgttggagctgctgtaaatgggccccgaacctgtcacctgagtggaattaggcattggggatctccccatcaccacgccggcccccctcactgtggttacgaaggaggagaagctgccctgtgtaggaattcctgggctgtttccaaatagccccgctagggagctggtcacccctcaacacccccaacgtgttctccaagcacttactctgtgccaggcccaatgctggacctggagatggggcatggctggctggctgagcggggcaggttgcggacaggcccccgcaggcagtcggcgtgatgggagaaaatgcaggcggggatgagatgcagcctccaggtggtttcctcagctgcctgctcctctctgcctttgccctcctcccggaagcttgcgctgaccactggagtaaggctgggggcctcagctggtcccctctctgtcccaagtaacagcccagaacatggtgagggtggctggctgatgcagtcaggcactggacatgggaggcaggaggaaggccgggaggtgggcagctttctcagacaagtgggcagtttggatggcgaggaggtcttggaggcaccatgggtggctgggctcaaagatgacatgagggcatgcttaacagatgcttaaccaaatcctgaattggcattggccaatttctgtggtgtaactactcccaagctacacagacgtgactttactggctgaggacttgggcagaggtgcacacagtcagactgagaggggggcataagctggtgtgagccctccctctcaccgccagggtgggcagagtgtccgctggtgcccaatgcctatgcacgtgacctccttagggacttacatccagatggcggtgatacagcttggggaggcctctccctggttggcaggtcctggcgaaagggtgagttaagtggaaagtgtaccaggctggtgtccaggtggcatttggccagaggggctgagctgggagctcctgggcctggggctggcagatagtggtgatttttcgccccccaagaccttgggcttgccttgttccatgaaggtcccaaatctgaccaaaggctgtaaccagatggtcactgtcccagaccaccccagggcgctttctcacctcgagagcaccgtttctccccacctccaccctggccgcccttgctgtcacctactccctctggtccctggcacccctccctgcctgcagtggtgtttcctagcaagtgcagcagcccgaggctgggctagaggcaggagggcctggcctcccagtgtcttgctggatacttggtttcttgcccctccgtttccacacctgtaaaatgggagcaatgacaggtcttcctggcaggacagtggtgaagcttggtcacacgggtgaacatgtgtgaggtaaaaaagacttcccatccctccttctgacctggaccggctcgcaggacccataggcagggacctgggcaaggtccgagggccgatgagccccgtcctctctgcacagttcagagttgggtgggagtggctgtgggctgcaggaggaggtactgcacttcgcacagttacgtggtcgggttggcatcgccgccgcctgacttcggcgccccgcgagttgggtgtgtgcggttgggggcggcccagagtgtgccccacgcctgccagtcgggtaggccagcctccctggagagaggggggcctccccaaggtgggacggggacagggacgggtgcttccttccacccaggagcctgagcagagggtggagggtcctggcagctacctacggcagctgagagctgcgctctttagccgagcgggatcagggctacgtggacacagcccgtgccagtgtgggtggggcacgagctgtgggttccgatggcccagtaggcgttcacctggcagagagtgtgcgcgtgtctcccctccttggggcgcctcaggtcaggaccctgagaacctcacttatcctttgagctgcgccaaggctgttgtacaaaagacagttcagaaaataaggacaggctgttcctcccagccaagggtgtggccctaaggacccctaggtggggcatcgcttcccgccaggcacgtgccactcagtcttgggctgctttagtggcagcctcctggtttggaagcggaactgagggtcagggatgaccacatggctcagggctcagctggggtcctgagagtgggccctcaggtttaccttcctcctggaggggaactgggggccattgcccagtgcacccccacttccccttaggtgcgtgggccacccctccctcctgcagcccccgttcatctacccaggataggtgcatgggccacccctccctcctgcagcccccgttcatctacctggggaaggtgcgtgggccacccctccctcctgcagcccccgttcatctacccggggtaggtgcgtgggccacccctccctcctgcagcccccgttcatctacccagtggggatgtcccctggctcctctcctggcatcttcccgggatgtaggggtgctcccatgccccccggctcctctcctggtgtcttccccagatgtaggggtgccctcatgtcagggcttatgcttctagaaggagtggaaatgcagcacagtcattgctgttgcctgccaagggccaccctggctggggacagatggggctgcctcccctctcccaccctgtcctggccacctgcccccgccaaccctgccactggctcagaggaagcaggcctaacctgatgtgtaacccccacccctgccgtgactgtaaccccgtgccatgtgaaggtggggctccttggcagtgcctggtgattgcggtacagccagaaccggccccattatctgggctgtgggtgccattggtcaggaccgtgatggactcatacgtaaaacttgatgcattttaactcccttcatcctagaggattgagacctctggcgggtaagtgttcatattaccgtcctgccctagagccagggaaggaccctaggggagaagtgacgtgccagggtcactgctgggaggagagcaggaatttgaacgctggccatgcctcctttttggggaaaggtcagtaaatgggcaggggagggtgctggtcatttgggtgatggtgccagtggggtgagcagctccaggtcatcaggtggtatggaatctggccccgggcagcccgtccagcattcctctctcaccgagcccacagccctggagcacctactgtgtgcctgctctggcccactgggaacaggacagtcccgagccctgccccgaggagctggcgccaagtggagcagctgcaccacaggcacacgggggacaaagggcaccgctgatgatttggccaggaagagatgaggtggggatgggggctacagggtggggagacggtggcctcgggaagggctagcttggccacgccagcttggtcatgtcaccttctgagtctcagtgttcccttctcacgtgggacaagaccacgcataacccgaggggctgcatgtgtggagccgacaagctgacgtgcgggtcctgagtgcactgagcccgctggggttccagacacagtggatgaacgatccagggaaggaaacagcctgggctgtgctctctgggacctgcccttgagccaggtactcctgtgggagggtagccgggctggctgggggcctggagcccacagcctctcctcccttgctgttttcccggccagggaggaagccaggctggaagaccccagagggctagggggatgaacacaggttgatctgtgttgaatttggctctagccacctcctcagggccagagcggctcctggagccggagtgagagctgtgttacacgcagggaagccggggctcggggaaggtggctgccagggtgtgcagggctgtgccaacctcatcctggtgggtccctgtgacaacaggacaggctgcctgcccattgtacaatgagaggctgatgctctgtcacttcatgaggtcacacaggctccaggcagtggggggctctctgaaggaggtcccagtgacctgaatggagcccccgggtgggctgaaacttctgcctgtaaggcctgtcctgggttggggttgggtgggagagggcaggagtcctgctgggaagggcctctgccatgcccagctcctaccacaagtacagaacaatgacaactccgccacctggctgccccacgctgggcacatgctccccgctggcctcagttgggagtccagtgagtcaggaggtgaaggtggggtgcacgtcccctgcagaccctcacaaggcaggtggcggggcgggtattggtcatgagaaccctgccttggggcctgagtgcctcggtggctgtggagcctggtttcgacctctttgggaccagtgttcttgtccataaaaggcagtgatctttctggatagttcagagagattctgttatctttgcccatcagagctggaagggagttgaacaaaatgttttgcagaaattggacctgagttgggcattgctcctcctgctgcccctggttctgagggcttggcaccactagcccgctctctgtccagggtcggcccggctcctgcctttatcatgtgtgagcctcgctgtgtgtggctcagtcctggacgggccgagacctggatgcaggaccctggacagtcagcgcaggcggagcagggagggaggcgtctgcctgaggcctgcttggaggtgcccaggctggagcccttggccctggaagatgtggtcagggcccagtggtgttgggatggccaagaagagggcccctgtgccttctgcccagggcttggcctagccagtgctcagggtttatttgctggatgaggggtggagtgggccagtggggcccaggtctcctgctaggtgaccctcagaggtgggcataacatcccttggagtctctgctctgcacttgccaataagaggctggaccatttgagtggttataagttgggaagcactccctgattgcttggttctgcttgaggcacagcctccaactcccagagattccagcacccctgcaggagccagcgttgctgatgtgggcagacgggcgtctgggaacaccccagactcagcatactagggttcaagtccctgactcccatcctggggcatggagtggcaggaaccagggaatgttctagagtgaggtggtgaggtggagcagggcctgcggggatcagatttccctggggtggggtcctggaaatagggcatcaagaggaagtctctaaccctgggagttggagggtctcgggtccatggctgagggtggatgtgctagaactggactctggaacctgaagacccccggatgagggtgctcagggcctggctggggagactcttgccttgttctccccagtgtccaggcctgggctgcccaggggacacttcagttgatgacgtcattgtccaggaggcttttctcttggacctcagtttccccttctgcaggatgggctggacccactctgtctagctctaccaccccctagtccctctggggagctgcaggagcctgttcccacggcctcgtcctcacccgccacggagacctcgaagccaggcctggcccagctagaggaggtgacgggtggccctgccctgtccctgtccccatctcagtccccttcccacgggaccggtgctcccggctgctctcctggccctgggtccctcctgtgactcaggcttcctggaagaggctcgggagggctcggaggattccccgccaccccacccagggtttctgcccgcctgcctcaggtccctgtcaccacccctcctgtggcacacggtgtgctttacctgctcatccactccgcccttgcccctagagccggtgcctcttactcctggcacccccactctggcatcttctactgatgcctggaacgctggccccctcctctggctcgcctggtcctggggcccctgccaaggcaaacatcttctcctttaatctccccgtcctgggtcagccgcagaggcccttcctcccgggctttgcttccctctggccagctgcccagaggcccatctgctgggaattgccgtgtggagctcagggggtccctgggggtgcccggggctcccggctgcccctcccctcggtggcctccctgtcccctccgcatggccctggggagctacaaggcctggccctggctctgccgactctccctgctcctgccctttctgggcctccgtttttgtgtctggagaatggggagcctgggggagaccccggcccccacagcagatgggtgggatcaggacaaaggcctggcagctgagctccagccacctgagccaggctgcttgcttctgagtcggtgactgcaatggatggacggggtcctggtggcatgccctttactctcttccaggcctgtgacctgggggagggctgtccatgggtgcctcagtttccctacctgccaggttgtgttcttggggcaggctggggacgtgcaatggcagcactgcgggacccacaaggagctcacatgggggagaggcgacatttgaacaacgcttcaaacatgtagttattgttttctcttttttgagacggagtctcaccctgttgtccaggctggaatacagtggcacgatctcagctcactgcaaacctccgcttcccaggcacaagcgattctcctgactcagcctcctgagtagctgggaccacaggcatgcgccactatgcccagctattttttgtagagatggcatttcaccatgttagccgggctgcttctcctggactcaagtgatcctcctgccccagcctcccaaagtgctgggattacagtgtgagccactgcgcccggcccaccactgtgcctggcctgcctctgcgcctggcccacctctgcgcctggcccgcctctgcaccttgcccaccactgtgcccggcccacatctgtgcccggcccaccactgtgccaggcgcaaacgtggttattgttttagacacacatttggtgatgttcattataaaaattcaaacagcctgggaaatacacggctgcagtagctctgggcttctgcttcatttcacaagaaccgtgccggcctcgggtgctgttttacagtgtcacttgaaatttccctgggtgttgactggggtcctctcccgatggcacccttggaccctggtctctgggtctggtcagatgcttgtttattaaccagccatccccccacccccatgatgggctctcctaagtgaggccatggacagccaggatgtgcgtctcggcaccggggtgagtctttcttggcccgctggcagaaccctgggtcagatgggagggttgttggtgcccggctgtgtgtctgccagccccttcatccctatcctggctgctgtgtagctcctgcctccccataactcttggggggctgcccgggtccacactggccccgtggggatggcagtaggcagagaggggcggtcctgaccccagagaaatcccatgggtgagtaggacttgtaggagatggcagttccctccctggagcatgtgtccccaagacttagaggtcgtggtggggcaggaagcaggtagtcagggtgggcttttgggaggagatggcatcacagtacggagggagtcatgcacgaggcaccaggaaggggcaagccgggtgaggacaggctcctcctggggacccaggacctgacggaacggcatcactcttaatggcaccgtcgcgagcctcttctgggccagcagccggagctcacccagggcacatccttaaacctcagggtcccctggtggcagctgccatggtcgtcctgtttcccagggagggaagctggtgtctgaggctggcactctgctaggtagcacagttggggagtggcagtgctgggatggaagacagacaagctggcacctgcacatctgcacgtcctgtcgttgaggtgacctctagccagccagctcatctgctcctttgcagatgaggccagagagacgggagtctctggtgtggaggggagggcactgggtttggtgggctggccctggggtaacttgcctgcctgtgcttcagtgtccccctctgtaaacagggtgtgacgtccccccggccatgtcggaggctccgagagggcagcgggtccatctcagcagatgctctgctgacggatgctgctggctggcccctgctcccaccctcccctcctttggtagcctccctgggccgggctgttcccacggctgcccagccacaggaagccatctggaggccttgtttacccctccccctggcctccctggcaggaagtcaccggaagggccgtcccgaggggccccgggcctgtgaggacagccatcggctcagaggtctgtgctgtggagtcccaggatagcatgcgggggcagggagctcagagaacagcaggtggagcggggctccaaggcactggagcacgtgggccggagcatggacagaaccatttaccgagcgcatccatctgtccatccacacagtcacctacccctcccccgctgtggccccagcagggcccagtcccatgaagctcacagtctcaaggcatggacgaggccactccagcttcagcccaggggggccccgtgatgccagggccattcctccagctcccgggatcccacacctcccctgatatcacacaagccaccctgggtcggggctggaggaggagacctgggcagcagctggggtgtccaggagaagggagttggggagaggggtgccagcagagggtgcagcctctagaaacattggaggccgccctgggtgacgggtctgaggctgcaaggtgtgggtggagcaggtgaagggagaggtgggcaggcacagctggcaggggctgaaggcatggatgggaccagtcggggtacttgtggccctgcagaacccctctctccaccacctcctccagccctctggcgccctgctcagggagggctcccccagataaccctgtaggtctggaccctcctggagtgggctcaggggcctgggtttccactccacaggatgggtccagctgccccggcatttgtggcagccccagtgcccactgacaggcctgagtgtagctggctaggcccagggcctttcccacagacactgccagcagggactacctggccctagggggatctttgacctccgtggggccttgcgccctgtgttcttggcggcctcgcgcctgtcccggcctcctgccttcgggagctgggtggagtgggggcaggcagccctgcccccgcccacatggggaggctgaggattggcccttccgcctctggctacccctcttcccctcccccatacctcctgctcccctttttcctcactttccccccacccctcccccctgcttccgctttctcatccctttagaaggtgcctactcatgatcgtcttgagtaaagccctccctgagagtgtcttggggtttcgggcctggcaagcatccccagcctcccctgaagaggaagtgagcgtgagaaccgggcctttggcggatccaggtgcctgcgggcagcccgggggcttgtttgttgggtgcctggccagcgggccggtccagagcaggaatagatgtctcaggagggtccctggctggtcccaagcacctcctgtgtgcaccagggccgctgttcttccgtccagcctcccagcagccctggggtgtgggtgcctctgattcggagggagtgacgggacttagggttagccagctccccaggtcagagacgcagagccctgggccaaccccaggatgagccccatcagcctctccttcctgactcattcaagatagtaagtgaaagagggcatgcaaccagcacgcagccccagaggaaggctgcagcggcctcgcgcggggccaaggaggctgggcaccgtgtgtgccgtggcactgccctccctggtgttgctgatgctgctgagatgggagaatgttgtgggattctgggggaggctctggtctgagagtcccgagcctggggagatggcctggctgggcccaggctggccacaggggcaccccagacttttttcctgggcatggtgtacagtaagtcctcacatcacatcatccataagttcttggaagctgcggctttaagcaaaacgatgccagttttaagtgaaaattggtttaaggacactagtgttcccataagttgatagagatagataagagttaagttcctgccaggtatttctggtcacaaaaacgtcaccaggcttccaatgaagaccccaaacacttctaacattaaacactgaagtaaatgtgagctacacatacatgtaagaaaagtgaattaaacagggaagagaattgcttccccagctttccgtgggccagtgagtggtaacggaacacacatctcacggcaaccatggtcgggagctcctcctgccaccacgcacttcaaaatcaaacgatcacaaacgtggcggcttcctgtattgccacgcattcgtctgactatgtctatttgacgaatttttattttgcaataatttttattcatttattcattcattttccaacccactaattccagtgcagggtcatgagtggctgagcctgtctcagcagctctgggcacaaggtgggacctgactctgctcaggacaccatcccctctcggggcacactcccatgcacagccacacccactcagccagggccacggcgacacgcctgttcaccggatgtgcacagcactggggtatgggggagccggaggacagggagaaaacccacacagacctggggagctcgtgcacatgccacgcaatggccctgaaagggaagcgatttttttttctcgtcagcgttatcacaaaaccacgttgaaagcaacagtgttatttgaggagctgctgtacttgacggatggtgcaggacaaggtgggccctcttcggggcctctgcgcctctccccctttcagggggttggggtagaaactggatcaaggataggggactctcataggattggagggtccattggggcagggccccccagcagctgagggcctctctccccctgtcctggggtcctggggtctctggcccccatgagtccagctcctgattgctctgccaagtttgctgtcatgccaggaactaagcctttctcctcgtgagctctcttgcacccacagtatagccatggtattcagtaggtgcccagtaagtgtgggctggtgaatgggcctccagggaggtgggatttggatggacagaatggacgggtccttgggaggtggtactgagtcagcagaggcttgggggcagagcatctctgcagaggcaggggctccatcctcaaggaccccctgagggcctccaggaggaggcagccatggggtgcgtggggaagtaggagtggcagctctgagtcagcttgtcccagctctgagctccctcccgcacctacctgtctccactgtgggggccacacagcctttacatataaagggcatggagcagcgcctggcactcaggctgccagtaccaccaactggcagcactcattgggcactgactgtctacattgccaggagtgttcaagaagtaatttaaactgccagaaatcctcatcccacggcattaactgacacctgctttgggcctgaccctgtgcctgatcctggggacctggcatgggtcagtcaacgctccctgtctgccgcccacagtccatgacagggacagacaagtcacgaacagggctgcaggggctgacccaggaatgagcaggacctctctgggactgtttagggctttggccccctggtgagggagcagcgaggctgtggggacccaggtcccttgggccttgcatgcctggctcctgatcctgtgggccccatgcagaagtggcccccagttctttctgggtgcttggcatgtccagtcttccttgggggctccccaggcaattttggctagacacccagcagacgctccttcctccaggccccccaacctccgggtccctgaggtcggagccagttttccccaagaccacccaagcagtgactttgggtccacccacagatgccctggtcactgtgttgctgggagtgcttgggtgagaaggaatggctgcgggcgggtcttcctttcttcatcctcagcatcctcatccatcactgaggatgcttgtctctgccttactcccactcacaggacagtcgaatatgttcacacatccactgagccagcacctgctgtgtacggtgcccattgagaaccagggagccgagggtggagctgtggccggtctcttgtcctgcgtggggagagaggctgacaagctttgccagaagggggacagatgatccctactgtgtgtgggggacagaggacaggtctcggtggctagcaggaggaacaggaggatgctgaacctgagatccgagtggtaagaaggggccagcaccggacgatgtggggacagagcatgctcctggcctccagcacaggcagtgcaagggctcggaggcaggactgtgcttggcaagttgcaggaacagctgggaggcaggtgaggctacagcagatgaggagaggggagtggtaggaggtcagagggcagggagcagctcgcgtggggcctttagggcgataaggatttttggctttcctgagtgacgcgggcaccactggaggctttgagcggagggggctatgatctgacttaggtcgaggacactggtgggggcagtggtggggatacccaggatgccagatgggtatcccagattcttggtgaccctcggtagcccctctgggcggtggctttaggcatctgggctcaggtgtcaccatttcacttgtcggccacccacggctgcttcctgccccatctggggattccggggactttccatttcctcaccttgcacttgattctgtgatgtgcctggactggggattgtggaggcctgtccgtgccctgaagcacttctgagaagccggggagcagttccctggggtttcccctgggaagtcctgccgtcctctttctgctgccacccagagcccgccctttccggagagcagttccctggggtgtccccctgggaagtcctgccctcctgcctctggcccttgctcaagccgcgcccccatctggatgcccacttcttccactctgctctgttggaccaattaggccaactctggggatatgtgaccccagtgtttgtgatcaaacggggcccagactcattgacatcctgcgtgaactacagttttggtagaggtgcaagtggattctgtgtggcacagaagatggcgagtggtgacggctgtgttgcctgcatgccaccgacagcccgcctcttctttccatcttaatccatcttgccagctctcaagggctgtaggcacttcgccctgaatcctcctctgagccggctttgcctcctgctgttcccactgagcgaattaaataagtctttgccctgtgcccactgtatgtgcaaggtcatgcaggttatgctttgaacttccaaaaatgcgctcagaaatctttcctgtcctctagggcccatctctgatgccaccttcaccttctggattctctccaggggaggaggtcaggcccttgggaggtaccctttgccctctctgctggggatcctggagagtccctccccaactcccctggccactgggacctctcttcctccctgacctgcccagcatcctcccttggcagcctggcacagcccggacagaacctagaaggtgtggattctgcctgcctgccctgtgtccccacagtccacatgctggcctggactctcaggcctccccacctccagtccctctcctgccctctccattccttcacacacgtgggcacaaagctggggcttctgtaagggtgcatctggtaggacctcaacctcccgtacccaatggggtcttgggagaacagaagttgtgggtgatggttaaggtgtagccctcttcccaaccttgcacagccccctggctcagtccctgagggtaaaattcagacagagctggaaatgacccaaatgtccatcagctgaggataaacgaaatgtggcaggcccacagagtagaacaagcttgcccagccagcagcgcggcccaggacggctttgaatgtggcccaacacacattcataaactttctattttttttttttttttgagatggagtctcactctgttgcccaggctggagtgcagtggtgggatcttggctcactgcaacctccacctcctgggtttaagtgattctcctgcttcagcctcccaagtagatgggattacaggtgcccgccaccacacccagctaatttttgtatttttagtagagatggggttttgccatgttggccaggctggtttcaaactcctgacctcaagtgatccacctgcctcagcctcccaaagtggtaagatgacaggcgtgagccaccgtgcctggccaaatttgtaaactttcttaaaacatcatgaggttttttgttgttgttgttgttcatcagccatcattagcgttagtgtattttatgtgtggtcctaaacaattcttccagcgtggcccagggaagccaaaagattgcacactcctgcagtagaatataggcggccaacaggtggagcgggcacagactcaggctgcgccgtggctgagcctttacgacgccaggagaagcgaaaggaaccaggcgcagagggccacgtggtgtgtgaggccattcacagcaaatgtcctgaacaggcaagtccacagagacagaaagcagacttgtggttgccaggggctgggggaggaggggtggagtgactgctggtgggagggggcgatggaagtgttctggaattagtggtgatgattacacagcactgtgaatatattaaaaacactgaaggttacactttaagatggctaaaatgactgggcctggtggctcacgcctgtaatcccagcactttgggaggccaaggtgggcggatcacctgaggtcaggagtttgggaccagcctggccaacatggcgaaaccctgtctctactaaaaatacaaaaattagccggttgtggtcatgggcgcccgtaattccagctacttgggaggctgaggcaggagaattgcttgaacccgggggcggaggttgcagtgagctgaggtcgtgccactgcactccagcctgggtaacagagcgagactctgtctgaaaaaaaaaaaaaagactaaaatggtggatttcatgtgttatgaattttatctcaaaaaataaattaggatagcacccccgcctacacagactctgtcctgagcagctctcagaagtccgtaaaatagggtgaaagtgtcgttgccctgcccccgggttcccagtgctgtggggacgtcaccagctgctggggaacagagggatgctggcacccacccagggctcagggcagggcaggagcttggtgtgcgctagagactagagtgagaaggcccttccccggccctcacagagtgccttgccactggggagttgagtgaaggcacagacaaggttgtgaggtacccacgctgccgtgtagtgtcaccacgccctgatgtgtataacctgttttctttgctcatctgggtggactggtggggcatttgattctggagggtggggttccagtctgcatggttccctggggatccctggccccaacatgaaggcagtgtggcctgagggcctctcagtccccaaggtgctgacccaccgctgcctttcccgagtcctccctgggccctgctaggggaggcctgggagctgcagcatccaacaggcccgtgtgaatggcctggccacagcactgccagacagggcaaagttcctggcccggggctgtctctgagccctggagctggcggggtagggatcagctcctgtgagctccctccatccccagatccacccttcaggtccagggctatttggtggcagctcctggtggggcagggggatgggagggatgggagcctccatctgtggacccggcacccagtctgcctgcaggcctggtgattgtggcccgacctcctgcccaccccttctgggcaccacggcgatgcccagagcccctgaggggctgtgcaggcagggcataagatggcagagggctccacatagcccctaggctggcaggatgtgttctgagctgaggtcctctggaaagcgcctgtggatttctggcccctccctggtgtgttccccacctgcctgctgagccttcagatgcctgggagagcaggtctcccttaggtccgctggttctgatggttcccctccttctctcctgggagctgggcaggtgctcaaagcgggcagtgcaggctgcccagcgtgcccagctcccaggatgcaccatgtgacccaggccccctcctgccctgcttgcgctggcgaggggccgtggctgggtgcccagcggtgcctgcgggggcccactccctggggcagtgcctgcctgccacccacctgggctgggcatccagtctggccttggctgttgtcatggcagccaatgcctgcagccgggagctaaacttgctaccctcaagccactgtcaccacggctgtgacgaacatggggacatacagcctgggtcggggaggtgaccaggcctggctctgcccagcccctgctgcggacggtcaccgcggtcacagcccacatggcctgcctgccaccccctcatgccatggcctgggctgtctgaggttctgtgtcatggatgaggccccaggatcacagaagtgcccacagccacacagacgggcaggagtcgggaggccccggcccccaggctcccagccagactgggggagtggggctggcccaatctggagttgccaaggtggggttcggtgaggcaccattgttgctagtgcctggtttcaaaaacattccagaaatgccctgctggccacctgcctggctctgaggtccccacatctgtggaggaacaggggctttaagaagccctgcggggaagaagccccatccacgcaggctcccctgagggttctgaggcacctgctgggaactgtggtcttcttggggcgctcggtgtcctcacagcccctgtgggtacctggcaaagtgccagtgttccagggactcaagcgaggcctcttggaaagggtaataatgtccctcagatcccaggagaaaaccaagggcaggtccatgaaggacagccttccagcgaacccatcctacagacgagcacactgaggcacagaggacagccttccagcgaacccatcctacagatgagcacactgaggcacagcgaggttgagggatgtacccatcacacagctcacaatggggagccaggaggggaaccaggtcacacagccctgtgtgaggacagtggccatgggctgagcaatggccaggccttgcgggtggaaaggagctgtcccctcccctggaccccagagaacccacctgccttggctttgagctgagctttgagccggggtcactggctgagtctcgcaccctctctgagcctcaggttccccatttgtcagatggggaaggccaagacccagggtagatggagcctgagtcagtgctggcagcactggcgttgtgggctggcaaggcgtggggcacctctgtgtgcatggggtggacctgtgtgtgcctagcagcctccctgccacaaaccaccctcctcctgtatgccagggtcacaggagctgaagacagtggccgagccccgctttttctgccccctcttgattgtttcagggacgaggtctggttctttgtcaacccaagtgcccagcacaaggcttggcatatggtggtggcctgtaaaagccagtgatgtgactatgaaaccaatccactcatagcactgcacgtgctttttgggagggagctggctcagagaggaaaggccatcagcactggtccccccagtaggatctaggcaccatggggaacctgcgggcccctccagcccctccaccatgtgtcctgggggtagccctatccccctgggcctcagtggcgccgtgtgcactggctctgggggtgccaggctgcgtctcaccatcgggccagcccagaaatagctgtgaccttccgcagccagcttggcagcgcttggggccaagaggcctacgtgcatgccggctgagtcccctcaccgtgcagggctggctattttggacgtggcctcccgaggccaggtcagagctctttcccgcggttcctcaggcccctctgacgtgcgtccactagagcctcggccagtggccctggctagctccatgatctcgatcccccttcctgtccccgaccccacgggccctgggtggcacagaggaagggatcccagggactgagcacagggtgaccgcgcctgctggggctgacatggagtgtagggcttggctgttttaagaagaaaatgcagagaaagtgcccaccctgggtaggccctgaatcctgtctcagcctctcagagctctcgctgactgcacagcctgagcctcggtttactcatccacaaaatggggtgatgggcgccttccaggactgctctgaggatggacatgggcattgcctgtgctgagggcaccacgcgaggccactacacagaggggttcttgggccttctccgccttccatgggactggacactgggttcagggaggggcgtcatgggtatatgggggtgctgcgctgggcagtggctaagcgtgggctcttccttttctgtgacacagcagaggtgtacatgcctgctgccctgtccagggcgtctgggtatggtggaagtggccccaaggtccagccaccctcagggaccacaagcttcctggacaccctgctgacagggtcccactgtggaggaacaggccggcccagctccccacctcccaagtgagcatgggtggctgggtgggcgtgagggattggctcccctgctagagggcagaactcctgttcccgtgaaggtgctgggtggggtgtgagtctgctcctgggtttggggtcaggcatgccaggaacagcaagcaggggctgcctgcctgcctagtgctggctgcatgctcatggccctcagggccctgtcccctggatggtccaggggtcccgaggaggagccatggcctcttctccgtggagaggccctgtgggcccaaggcctggctccatccaggcaggcacatggaattcagccaaactctggatcctttctgcagagcaggcttagcttgagccctcccacagcgagctcgcccactgcccaccctgccctctcagcctctgtgacaactctgtgggcactgccaggggcagttcctgtgtattctcatctggtgatgggttcataattctcatgttgtgtgggtgactaacaaggtctgggagctcaggagaggggcccagaggcacacagcatgcacgggacggttttgcagttcccagggggcacctggggtggaggcttagccaggcccagtgggctcagggctggcctcatgcccttcccctgttgtggaccactttggggcctctggctgatgctggtgggtgaggaccttcctgggcagcctcctccggccagcaggagggaccatcaggccatgcggacccttggagagcttgggggtcggttcctgccctggagtcagctgtgtctgctgagggtccactggtgtgtggcacagaaggggtaggggctgtgcctggtgtgccagggaggccctgaactctccgggaggccagatcaggggcctcctctgggcctgctgggggcctctgcattcttggcagggcctcagggactggggcggggagaggctccttctcagaggctgtgagctccgaatgaaactccatgccctccgggacaccatgcccacttctgggtactggccttcaggggccttggatgtgggtggcatggcactggctaaatggggcccaggaggaaggcagcaggaccgtgggcatgcaggcctaatgccagggccagggcaggcttcatgtgggcttcctcctgtctggaatcctggagccgcacaatttccgacccaacaccccgtactccagagcgactggctcttaacggaagctgctgctggcaggtgtgttataacagagctctggggtgggaggctgggggcagggagggttagggccgtcagaacacggctccctcctgcccagggcaaggtggggccacgtgtgcgcatgtgagtggggcacctggtctgggtgtggcctgggaacctgcatgttacagacgccatggctttggaaacactcaggagtccagctgtgtctgttccaagatgggtcagggttgccgcagggagggcagtgactggtccacagctggtgtggctgtgccatcctccttccagcctgggcagaggccttccaggcaagatgaaagatgcggtatggacaggaggacatggaggattcagggctcttggtgtaaagatgctgtgtggacaggaggacatggaggattcgggctcacggtgtccctggaggctctggtgggcgtcgtggggctggactgctgcggggcaatggggtccccatcttcccggcacaggcatctgatctggtcatctgtttctgtggcgtgtgtgtgtgtgtgtgtgtgtgcacgtgagcacacatctctgtgtatgcaggtcagtgtgtgtgcttgccagagcttcccattgggcggtttccacactggcttctcagtcatcctgggaggtaaggcatgagcactggactgggagtcctgtctgagccaccgacttggcctgccattgtggagctgtcctgtccactcgctggacattaggccatttgtgtacaataatcccctgagatttgtatcctcccatggggagatcaaaaggggccgagtgtggccctagggtctgggggcccagcctggtgggtagacctggcttctgggactgtagtggtggaaggtggctggggcaggggaggttcactcactgggaggctggaagaggtggcccggtagggagagagaagggcagccagacagagggcacgtgggagcagcagcctggtggcaggtgtgtgagtctctgcacctggccggggtcttgaggagcaggagaggttcgggcaggtggctgaggagaatgcgggcactgagcttgggaagagccctggactggggggggggtagggactgttgggcagccccagactggcacaggtggatcgggtgcctaggcagggggtggtgagttatggcgcagctgtcttggtggctggggggagcagggataagggtggacttcttagtgaccgctctctgccccaggaggtagagtcctgggggctgggctggcctgagagacgccccctcatcctttccagggtgaggtacgagggctccgccccctcctgatatcaccaggcctagggcagcatcctgatgggggaggggcaagtgacccgggccctggactgcaggaacagcccctcctccactggtggagttcccacttcctgcggaaggaactatgttagaagttgtgtatatggggtgggggttgggtgtgggtggcggggggcctgggtggggtccactgagtcgcctcccctgtctccctgcacttcctcctggaggaaatggggacaacaggatgaagtgagggcctgctgagcccagggctgccacctgggagtgaagccggggcaggctgcagggtccgggcccttctgtgtgggcaggtggaagtggtggggatgcagtgaggctccctccagcgcggcaaggaacgggccctgggaccctcttcccagcctgcagcaggcagtggggagacaggccggagccctggacagcccccagtctttccccaccccaactacagggcctgggtctccgtgcgccatccccctcccgccccctcccgctcgctcccgctgttacagggccctagggaccgccctgtcccccgtgggccccagagcccaggccagcgctggagggaccctcctgccctctggccgggaccagggtgcccgccgcagccctgggaccctgcggccccggtccctattcgaggccccagccggagcgttccgggatccttcgggggagtgcccagccccgcgcccccgcctcccacatgactccgggtgggcccttttgacgtgcgcggagggcggggggcagggggcggggcgggggggcagggggcaggggtggtgaagggtagggggcgtggcggggagaggggatggggtggggtggggactggggtggggtggggtggggagagggtgtggggtggggtggggagagggtgtggggtggggtggggagaggggatgggatggcatggggggatgtggcagtgaggaggctgggcccttggagctgccgagtgcaggggcctggaggactccgggaaggcgtcctagtgcatcaagcgtgggcttggcctgcttgggtctcccctcctggcccccctagcaatgggcggacttgggcccgctctgggaggattccaggaacggctcctgcctggttataaatagacttctccgaaaggcctggggctgtgccagctgcagcaggtgcctcccaggcccggccagagggccccaggcaagggggtggagcccgggtgggggtgatgaggatgctggggtccacttttgtagcgccagaggcgacgggctctgtctggttgtagcatcacagagcttgatgggaactttcactctgagaccccttttatggataagaaaactgaggctggggggcaggagcagcttaccccagaggtcctctctcccagagggctagggtggggataagcagggtctcgggggcagcaagacccagctccaaatgtggtttttctgccttctggctgtgtgactcagaagggttgctcagcttctctgtgctgttatggtttgtcagtgcagtgtggcaggtgtgtgtcttgcttgtggaatgcagtgtctagcctggtatccttagaaagtggctgaggttggagattggtggggcagagtccctgaagctgacccattcttgccttcaaccttcagggagacgctgctggaagtggtgagctgagagcactgggcaggagtcagagcctagcgtctccctgtggagctgggtgcacccacgtgggtgggtgcccttgccagggagctcacacccttgggggtccatgagctggcaggcagggctacctggcttggtgtgcccttgggtggaggctcccatggggcccttcagactgggcacagccctcctgtcctctgctccccagcctgcttgcccacctggaggtgggaggaggcgagggttgccggcacagctgggccaggctgatggtgatgttttctggaagtgtgggtggggagagcctggcagggggagggggggtcgtgctctcagctgggccccttgatgacctcagattgcagggaccaggttgtttgagagctgcaagcagggccacacctccagggaccctgtgctgggggtaccacccttgccgctccaccctgctctgagggccctgggtggccagggcgggcacagagtgggtggtgatgccagctgcatccctggggttcatagtctggggagcacatgagttcccggcacaatgctcccaggaggcagagccaggagtcgcagggaggcgtttgcttgagagggtctgggagggcttcctggaagagggggcatcagtgccgagcctcagagtttgtggagcccgccgcctggctgaatcctgcctgccggtgttacctcagggtgttcctcgttgcagtgcctcagtttcctcaccagtacgctaggagagaccagcgtagccagccacagcggggtcgtgaggattaagtgaggggacagcagtgtctggcacggtgggtgctgagtaaattcatggaggagtgcccgggcggtggggctggtgggctgggcagggggtctgaactggagggactcgggcgccctcctcctcagggtgcaggacagcacctgcacggcggggccgcatttccatttccaaagctgggcgcgctctgtccaggcctccccaccaggagcgcggcccggcggctcctgccctccggacccccagcccacaggcccgtgcagccccatgagggggccagggggagctccgaggttctagggagggcgcgcaccgggagagggcgccgggccggccggcgggaggaaggaggggtcccgggcggcagcgcccccggccctcgccgcgccccgcacttccctttcctggctgggcttcctcttccccgcgcccgccctgcgcggcccctttgtttcccgggcagggcgcggctatatttaggcggcaggtgtgggagcccccggcagccgggtcgcccgccggtcacgccccccacgtgacgcccgggcgctataaatagccgcaggcggcggtggcggcagcgcctggagccggctccgcggcggaggggcggcgccccgacccagggccagcaccgtgggcaccgccaggccggcgcgtatggaggcggtgggacgcctgcggcgcgggtgagcctggcaggtggggacgcggcggacccaggccttccgggaccccagccccgccggggaggaggtggcgccctccggagggctgggcgggagccccgctggcacccagggagggggccgcgccccttaccacgaccccacccgcgactggttccccgggactccccagagcgcccgcctcagccctgaccgcggcgcagcttacttctcctgagacccgctgagccccgggcctccagcctcctcccccaaaatcacagggggcgccctgtctgaagcgggggctggattcaaacttcttaagctgctgtgccatcgggaaggagggcggtagcctccctgaacctcgatttcctcttctgtgcagggcgctgcgtgttgttcctgcctcctagatttgagccagagagaacccagttaactggacgcctggtgtggccctggtggagaatgttctcccctctccctggcttgtttcctcatctcgcaaacagggacaaggatggactctcccttaaagggtcttgagaaatagctgagggctctgggcctgctggcccgaggaggctgagccagatcttgggaagggttctgcagggcttggtagcaggagggaaggaggtagcaggagggaaagaggggccacggctgccagtgggtccccgtgctgtgggccgcgggcctggtgggggtggtagcgactcaggacacatggaggcaggggcaacctgtccccatttcgcagatgggaagcctgaggctttggcttcagggagttctcagtgcccatccctggggatccttaacccttgctctcagggccctacctggtgacctcactgggggcgtgtggttatggaggggttttctcccttgggggacagccaccaggcagggcagagccacatagtggtgccagggcatcattgctttgctctcacctggggcaggggtaggggccctaggctgcagagacaagtgggatgtgtggcaagaccctggtccagcctctccctggacccctaaccccattctagcctgggctgtgacccctgagcgtagcccaggctaaccccctgattccggcagatgtgtggcatccttaggccttcagtggggggtagtgtggggtggttcggagcctcctccctcccagtagcctgcagccctgaggacctgtgcagggccactaggcagcaggtccaggccacgtgctggtgcctgtggggtcttcctgggtccctggcagctgtaggtgtgaggggttggtcagcccctcagggagaggcccaatactgtggtttctctggtgcttttcttcctttctttctgtaaacatgagctcggctcccgtgtgcacacacacagggacatcctgctgccccaagagggacccaggtgtttgtgtgctgttagcacgtggtggcttccctcacccacactcagagcctgtgctccctccagtcgggcaaggtggggactggcgggaccagggacagtatccttgtctccacctttacctccttctgggggtcccaccccaccaccggtttttttttttttttttgagacggagttttgctcttgttgcccaggctagagggcaatggagcgatctcggctcactgcaacctctgcctccagggttcaagcgattctcctgcctcagcctcccgagtagctgggattacaggcatgcacttccatgcctggctcattttttatttttttatttttagtagagatggggtttctccatgttggtcaggctggtcttgaactcctgacctcaggtgatccgcccgccttggcctcccaaaatgctgggattacaggagtgagccactgcgcctgacacccaccgcccattttaaccttcccagaaccatgcagtggacagagcctgaggtgtggcggctgctctgagcccatgagcactggctgccacccagggtgtggagggcaggcagggaggagcccactgtcccaggtagccaccctctgagtccaggggcccaggcctcaagccctacctgcacctgggctgaagctccaagggcccagcctgcctggtgggcagctgggaagggggtgctggggctggggcaggggcacaggtgagagggggtgggttggggaatggagggctctgctgggcgaggggccctgaagtgcctttccttgggtagcaggcagtagtgacagggccgggcttgggttgagtctagggggctggagagtctgctaacagctgggtcacagccagggccagcagtgcggggacccctcagcagcagtgcccaaatacagcttgggtcacttgtgtcacccctcatcgtgctcatggggtaacaaagaggccggcaccttgctcaaggcctcccagcccttccgtagagagggaagggggctgcgtgctcctggaacccctttgcctgggagctttggggtcatgagacccagaaagggagagaggcaggcgtggaggtgccttgggttgctgtggccccccctgccgcctcccctcttcagggccctgtcatggtgtgaacccactcctggccacctgtgctgtcaccaccttggcatgtgtgcctgatggctggcccattggcgtgttctgtccccgcctccctgagctcctggaggggcagagctggcctgtttatccccgagcctggctgagacctgtgtgagcagtggagacacagtggcggggggacactggtggacagggggctgctgacaggcaggagactttctgcagaaagcaagaggcgattagggtggcccacggccgcgtgtggggccaggcccctcacctccctgtgctggcagcactgaccgagtgcctgggccccattccctgaggatgggccacccagagacacctgggctcagatgttcacagtggctgagaatcggaagaggagagggcagctgtcctggggtggagtttccgcagatcacagcaggtgggcaggggccaggctcaggcttcttaggaactcggcctctgtccccacagagggatctgtcatctgtgtgctggggttcatcatgtcctcgggggtgtgtgtgtccctgaaatccctgtcccctctgtcctccgtcatgccctgctggctgtgtggtggctaccctgtcgcctctgggccctgggtcagtcctggcaggagccgtgcttccttgtgctcccatataaggaaatagacccaaaagggtcattctctcagcatggtcaggaggagggctctgggagaggtgtcgcctgtgactgtgggctcatgacaggcatgaaccccttgtgggaggcggggccccctgtgatccctttctattcatttccttcgtctttccccacagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggtgagtggagacggaggtgtggcaggcaggtggcccaggtgtctgggaagcccggctgagctgccctcaggcctcgcaagaggggtccccagccccggctggccagacagggctcacagccttggaacaaagcccagtcgcctgttacaggatcctggaggagggagatgggggtgccccgggggttggggttgagggtgttgggggatcaacggggtcccctgggaggcctgcagggggctggcgtgtgataggagggactccacgctgtgtggatagaggcagggggtgaggcagggggatacatggaccaggctgtgcgtgctcagccgtggcctgggctggggccctcccgagccctttgctgtcccagatgttgctgggctctggatgaggcctcaggttagaccaggctggactaggggcttcagggcccagatctctgtgtgaggagggactgagcaagggtcagcgctgaccacaggagggagggaccactgtgccctggagaggcagcagagatacctgccgctggcaaccctggcagatgggacgagatgcgtttacagaagctttcttgggagtggagtctggagcgacctgcatggcctcctggaggagcctggcctctgcagaacgccctgctgtttgcaggcctggggccgtttgcagcgtctgcagttgtgtgcggggccgttgacagagcctctgactgtgccaggctgtgtgagaggctgcagctgtgtgcagggtcatttatggctgagtcctttcccctgtgacatgagataagccatcatggtcttgtcataatgaaacagatttgggcgtgagagggcattaagaactgtagagcagcaggaggcattgggcaccttgccatcagggagcctggaccctggacactgagccaggtgccctacagaagatggctgtccctctcgcagctgagacccctgagataacagcagcatctacagaaagattggcgagaacagcacggtgagtggccagggtgaggcctcagaatatgactgggatcagggttaagtctgtaaccaaggtcaggtctcagtgtgtgaccaaggttggggctcactgtttgaccaggatcagggctctgtgtgaccagggtcagggttcggtgtgtgtctgggatcagggctcaatgtgtgaccagggttgaggctcagtgtgtgtccaggatcagggctcagtatgtgaccaaggttgggactcagtgtgtgtccaggattagcgctcagtatgtgaccaaggttggggctcagtgtttgaccaggatcagggcttagtgtgtgaccagggccagggtttggtgtgtgtctgggatcagggctcagtatgtgaccagggtcgaagctcagtgtgtgtccaagatcagggttcagtgtgtgaccaggattgaggcttagtaggtgagcagggttagggagggctcatcctgtgaccagggttaacgcttagtgtctgaccaggatcagggctcagtgtgtgacccagatcaaggctcggtatgtgaccaggattagggctcaatgtgtgaccagggttgggggctcagcacgtgatcaggattagggctcagaggtgtgtgactatcaaggctcaggacgtgaccaggatcagggctcagtgtgtgaccaggatcaggaagggctcagcctgtgaccagggccagggctgagccgtgggctgggtggccattccctctgctgagggtgcagagggcctctgaggtaccccatggccacagagcccagcaccctgcctgctccctgcattctcagatagttgggtgctggcctctctgtgttccaggtccctgtcccgtgaccagcaagacccatcagctgattcctcacccctcccaaaatagctacgagagcaggtggggtgggaacagcccccgcacgtgacccctgtggagtggatcctccgcagtgggggtataactatcggcctggctgtgaactaccaccaccttttccctggtcgtgtggggcttccctgctggcgtacagggcccagcttcctcctggctgccatctgagcggtgcccaccctccctgctctgaggcgccccagctgatgcccgcccctcttagaccctaaaaactggacccatccctgcggctcagctggggtcgctgttcggatgcaggggctcacacgtgggctggggagtccagttcctgctgtggggacccagtagcttttctggaagaaatgtccttgctggtagatctggggtcctgagcaccccagaggagggagtggtgtgctgggcagctggggtcccagctgccagttaccgtgaatgtaggtggggacacctttgcctctgctgggtggcccaagggacctaggacaggctcttcgacagccagacactacctcgaccagtagtggagcctgaagtccactcttggtggacctcactgcatcagggtctgcctggctggagggtgacatgcccttccctgggggcttcaggggccatgaccctgccccaggggactgaggggacagggctccaccccgagaggtctgaggggacatgtccaagtcctgggtgactgtgggggacacagctgtgccctgggagccctggtgagtgggtcctgccccctgagccctgcagccccagcccagccctgcctcctccgtcctcccacccccaggacctgaagaagtacggggctaccactgtggtgcgtgtgtgtgaagtgacctatgacaaaacgccgctggagaaggatggcatcaccgttgtggtgaggcgcgcgccacggggaccctagtcactgctgccaccgggggagggtggggcggggggctccgggcctgcgcagagggtttggtgcccctcctgtggcagccctgggcatgtctgtgcctgggccacgtgtgtgtctgggtacatcaagggaaggccagggtgttgggccgtgtgacctcaagaaagtcacccttgcgcacccgtctttctgtctctagggtgggccagcacggttcgccaggcaggggtggcacatgcttggtgcatcggccaaggtggcgggtgggctcctctgcctgtctcaggccctcctctgggcctgtcttgggtgcatctcagtcttgctgcctgggcggctggggccctgttgccaggcagcaggctcctggggagggcccttgggcagtttcctcggcttctttggccctggggacccaggtctgggcggggggtggggcggttctgctgcgatatccttgggggggtgggccacagcagctgcaggcccagagccagccccaggggggtccacccccggcccggtggacgactgcccccctggtgcaggcctgcccagctgcgcctgggcctcagtctcctcagtgcggagcacccctcagtcactgcttttcatcccaggactctgcttttggctggggttgcagttttgtgacctcagcttggcggtttggaatggtggcagcgctggcggtttggggtcagacaggccttgggctgcgtcccgcctctgccctccccagccttgcgaccctgcaggtcactccgagccttgggttcctcacctcaaagcgaggctgcttggaagaatgggaggcaaaggcatgtccccgcttctcgcacggggtgcgcccacaccctccctccccttccacagcagcgggagggattggggtcagacgtaagtagccgtgacaccggttgtctctaggagttgccctgcctggaggctggggaggggtgagatgcccccgagggctgtgtgtctgcctcagtgggcccagcgggctctccctggtaccagacagccccatgcctggcacagtccctgcatgaacccgccttcccaagactgaaacgtgtccactcctactgcagcgccctggcccgggccctcccctaggaagactcacgttgcccaccgatctagggcgctgggggacgggacagtgggaagcacaggtcatcttccaagaccaaattaacccccaggagcaatgggccggggcccggtggaaccgcctgtttcgagtcctgccctcagaaatgtgggccctgtctcgccccacagccctgtcttcagtccttcctggcacctgggctgtgtgtggcatgtgccagccatctttgcatgccagcacaggggatgagaccctttgcaccagccgacccaaaacctctcaggctgccaccggcacacaggcgtgagggattgtgaccccagaaccagagctcgggctgacaggtgtggggattaggatttgtgcgactctggagcaggctctattcagaaaggggtggggtggtccaggaaggcttcctggaggaggggatagctgcagtgtacagggaatgatgaggagtctgaagcactcaccatggggtgcccataggcaagctgtgcccctcctgtgtgccctctgggtctgctgcccccaccctagtgggctcctggcaccctctgcctctcagagctccctttcctcgcctgagccccagagccgcctctctaccctccctcagccgggggtcctcatgtctgcttccctccgtaggactggccgtttgacgatggggcgcccccgcccggcaaggtagtggaagactggctgagcctggtgaaggccaagttctgtgaggcccccggcagctgcgtggctgtgcactgcgtggcgggcctgggccggtgagtgtcggggcggggtagggctcgccatgtcaggtggttgggcatctcgtggtctgacagcctcgcttttggatgtgggtcttgaacacacgtccacgcgaccttcccaggaggcccatgcccctagtgctggggctcccagactggtcctctcccagcatcacagagaggaagtgcttcccaaagtctaacccaacttcttcctgctatggttgaaaccatcctgacatcttgtgtaggaaagggctgccgtccccctctccagacacaaagatccccccacacacagctggggcctcagactccctgctgggagaacgggaggaagaatggcagctgggatcggatgacatgaccagtgggacacccccatctgcagagggagacccaggcgagcagagttgatagcaggcatggatccggctcttagcacttcacccgccagctcttatttaaccctcccccagcagatcacagagaggttgcctaggagggagccaggatttagacccagtgctcaggctgggctgtgaggctgtggcctccatgggggagcttcaggcaggggggattctgggccccttgggcccccgtgccctgcatcttcagcaggtgccctgccaaggggacaggggtgcgcaggctccgatgacccccgccctgctgtttgcccccagggctccagtccttgtggcgctggcccttattgagagcgggatgaagtacgaggacgccatccagttcatccgccagtgagtggccgcggtggtggggtgggctgtgagcgctgggggaggggagatccggctgcccacgaagggtggcggcattggctgtgtggttccgtcgctctgaggctgcgtcgatcagcacaagctgggccttgctgcagaaacggggaagcctgaggtgtttctgatgggtggggacagcagcccccgagtgaccatgcagccacacagggacacagcgaggccacccgccacgccgtcctgcccgccctccacagacagagctccttctgtcgcagccatcctgacgggggtggaaggacccccagagccagccagttcagtccctccatgaaaaactagaacctgaaaccccacaccacaccgtgtccacccccagggacgctgacagtgggctagtgtctcaggactactctgagtctagctgctcaccacccctccccccaaccccgagctctccagctcagcccctccccgccctccttagaggcttctaggccagctcgcctgccccatccctgtcacttggtggcctccctggggagggctgccatctgcccactgcccagggggtcctgggggagtctggccgggatggcagggccaactctggaggaacggatgcggcacctgaagcctgcccctgcccagcccaccatgtgtgtgcccgtgagtgtgacacacctgtggtactcctcggacaggcttggctggtggggccatctcttcctcccagaggcaggcttgttcccagccatgccagctggccctgtgggtctgtgtgagagtgtggcccgccctgtgggtctgcgagagcgtggcccgccctgtgggtctgtgcgagagcgtggcctgcaggtgctcaggtctccctggggaccatgggatgtgcacgctcacacacagacacgcatgggggtcatacaggcacacattcacaagcacatgtgtgcccacacagacccaggcatacgcaggcacacactcacaggcaggtgtgtgaacacaggcacatacagacaagcgggtatttgcacacatggacacacatggatgcactcaggcatgtacacacgtgtgcactcatacatgacatgcactctcacacatgcgggtgcacaccttccccgggttctctccccaccccacgtctcaccgagcaagggcttgtctctcccttgtggcttttgctgtgtggctccccgcacctgaggctgcgctggtcaggacaggttgggccatgctgcggaaacagccaggcctgaaccccaacgactcagaacagcacgggcgtttcttgcccctgttgcgtgtctgttggtgggggccctacccggaggcgtggctgagggctgcgccttccccagtgtgccggctgctgggcgaggaaacgagcacggtggagccacacggggcacctgcagctttgctgggcagagactcctcgcgctactgctgctcccacttccttggccagggccagcctgtggccacgcctgaggtcatggcaggtggggatggatgagcctccagaggcgctgggtgggcagcccccgcccctcaacgcctgtcacctcagggcctctcaggtgtggctgcagcatcctctccaggaagtcttcctgttcaccccagccaggtacatgtggtcaaggaccaggtggcggggcagggtgagcacatagcccaggtccctgctgtaaggaccaggtggcgggagcagggtgagtgtacagcccaggtttctgctgtaaggacccggtggcggggacagggtaagcgcacagcccacgtccccgctgtaaggaccaggtggcggggacagggtgagcacacagtccagtccccgctgtaaggaccaggtggcggggacagggtgagcgcacagtccgggtccccgctgtaaggaccaggtggcggggacagggtgagcgcacagtccgggtccccgctgtaaggaccaggtggcggggacagggtgagcgcacagtccgggtccccgctgtaaggaccaggtggcggggacagggtgagcgcacagtccgggtccccgctgtaaggaccaggtggcggggacagggtgagcgcacagtccgggtccccgctgtaaggacctggtggcggggacagggtgagcgcacagcccacgtccccgctgtaaggaccaggtggcggggacagggtgagcgcacagtctgggtccccgctgtaaggaccaggtggcggggacagggtgagcgcacagtccgggtccccgctgtaaggaccaggtggcggggacagggtgagcgtacagcccaggtttccgctgtaaggaccaggtggcggggacagggtgagcacacagtccgggtccccgctgtaaggaccaggtggcggggacagggtgagcgcatagcccaggtccccgctgtaaggaccaggtggtggggatggtggggacagggtgagcacacagtccgggtccccgctgtaaggacccggtggcggggacagggtgagcacacagtccaggtccccgctgtaaggacccggtggcggggacagggtaagcgcacagcccacgtccccgctgtaaggaccaggtggcggggacagggtgagcgcatagcccaggtccccgctgtaaggaccaggtggtggggatggtggggacagggtgagcatgcagcccaggtccctgttgtaagggaaggtcgcgcagctgggctggaattctgggctcagcccctcccttactcacaggccccccttcctggatggtggaggtgcccaggcaccacccttgttgtctgctcatggccttggggtgggtcctaccgagctagggaagcctgggggccgtagggagcccagagtcagcctggaggaggtggcgctttggtgagtttggaaggcaagcaggggtgagctgcagggggccaggaaagggtgactgtgactctgggagcagccgtgccaaggccctgggacaggaggggcttggccagcctcaaggccttactccagcccactgcactctcagattccagctccctggggcaggtgagatggccgagccaggtccttggatgatctctgttcctgttcccctcttcccaggaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcc

SEQ ID NO: 1976 - DNA, 17429 bp, Homo sapiens
aatcccctaatggaagaaaaaagatttgctctcaatttttacaaaacttcttttttttataattccttttttattattattattttactttaagttctggggtacatgtgcacagcgtgcaggtttgttacatatgtatacatctgccatgttggtgtgctgcccccattaactagtcatttacgttaggtgtatctcctaatgttatccttcccctctcccctaccccacgacaggacccagtttgtgatgttccccatcctgtgtccaggtgctctcattgttcaattcccacctatgagtgagaacatgcggtgtttggttttctgtccttgcgatagtttgctcagaatgatcgtttccagcttcatccatgtccctacaaaggacaggaactcatccttttttacggctgcatagtattccatggtgtatatgtgccacattttcttaatccagtgtatcattgatggacttttgggttggtcccaagtctttgctattgtgaatagtgccacaaaaaacatatgtgtgcatgtgtctttatagcagcatgatttataatcctttgggtatatactcagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcttgactttttaatgatcaccattctaactggtgtgagatgatatctcattgtggttttgatttgcatttctctgatgctcagtgatgatcagcattttttcatgtgtctgttggctgcataaatgtcttcttttgagaagtgtctgttcatgtcctttgcccactttttgatggggttgtttgtttttttcttgtacatttgtttaagttctttgtagattctggatatcagccctttgtcagatgggtagattgcaaaaattttctcccattctataggttgcctgttcactctgatggtagtttctattgctgtgcagaaactctttagtttaatgagatcccatttatcaattttggcttttgttaccattgcttttggtgttttagacatgaagtccttgcccatgtctatgtcctgaatggtattgcctaggttttcttctagggtttttatggttttaggtctgacatttaagtctttaatccatcttgaattaatttttgtataaggtgtaaggaagggatccagtttcagctttctacatatggctagccagttttcccaacaccatgtattaaatagggaatccttttcccgtttcttgtttttgtcaggtttgtcaaagatcagatggttgtagatgtgtggtattatttctgagggctctattctgttccattggtctatatctgtgttttggtaccagtaccatgctgttttggttactgtagccttgtagtatagtttgaagtcaggtagcatgatgcctccagctttgttcttttggcttaggattgtcttggcaatgtgggctcttttttggttccatatgaactttaaagtagttttttccaattctgtgaagaaagtcattggtagcttgatggggatggcattgaatctataaattaccttgggcagtatggccatttccatgatattgattcttcctatccataagcatagaatgttccttcatttgtttgtgtcctcttttatttcactgagaatggtttgtagttctccttgaagaggtccttcacatcccttgtaagttggattcctaggtattttattctctttgaagcaattgtgaatgggaattcactcatgatttggctctctgtttgtctgttattggtatataggaatgcttgtgatttttgcacattgattttgtatcctgagactttgctgaagttgcttatcagcttaaggagattttgggctgagacgatggggttttctaaatatacaatcatgtcatctgcaaacggggacaatttgacttcctcttttcctaattggataccctttatttctttctcctgcctgattgccctggccagaacttccaacactatgttgaataagagtggtgacagttttcaaagggaatgctcccagtttttgcccattcaggatgatattggctgtgggtttgtcataaatagctcttattattttgagatacgtcccattgatacctaatttattgagagtttttagcatgaagggctgttgaattttgtcaaaggccttttctgcgtctattgagataatcatgtggtttttgtctttggttctgtttatatgatggattacgcttattgatttgcgtatgttgaaccagccttgcatcccagggatgaaaccaacttgatcatggtggataaactttttgatgtgctgctggattgggtttgccagtatttcactgaagatttttgcatcgatgttcatcagggctattggtctaaaattctctttttttgttgtgtctctgccaggctttggtatcaggatgatgctggcctcataaaatgaattagggaggattccctctttttcttttgattggaaaagtttcagaaggaatggtaccagctcctccttgtacctctggtagaattcggctgtgaatcagtctggtcctggacttcttttggttggtagcctcttaattattgcctcaatttcagagcctgttattggactattcagggattcaacttcttcctggtttagtcttgggagggcgtatgtgtcaaggaatttatccatttcttctagattttctagttgatttgcatagaggtttttatagtattctctgatggtagtttgtatttctgagggattggtggtgatatcccctttatcattttttattgtgtctatttgattcttctctcttttttcgttattagtcttcctagtggtctatcaattttgttgatcttttcaaaaaaccagctcctggattcattgattttttgaagggttttttgtgtctccatctccttcagttctgctctgatcttagttatttcttgccttctgctagcttttgaatgtgtttgctctggcttctctagttcttttaattgtgatgttagggtgtcaattttagatctttcctgctttctcttgtgggcatttagtgctataaatttccctctacacacgctttaagtgtgtcccagagattctggtatgttgtgtctttgttctcattggtttcaaagaacatctttatttctgccttcatttctttatgtacccagtagtcattcaggagcaggttgttcagtttccatgtagttgagcggttttgagtgagtttcttaatcctgagttttagtttgattgcactgtggtctgagagacagtttgttataatttctgtccttttacatttgatggggagtgctttacttccaactatgtggtcaatattgaaataagtgcaatgtggtgctgagaggaatgtatattctgttgatttggggtggagagttctgtagatgtctattaggtctgcttggtgcagagctgagttcaattcctggaaatctttgttaactttctgtctcgtggatctgtctaatgttgacagtggggtgttaaagtctcccattattattgtgtgggagtctaagtgtctttgtaggtctctaaggacttgctttatgaatctgggtgctcctgtattgggtgcatatatatttaggatagttagctcttcttgttgactggatccctttaccattacgtaatggccttctttgtctcttctgatctttgttggtttaaagtctgttttatcagagactaggattgcaacccctgcctttttttgtgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagccttgatggtctttagaatttggcatgtttttgcagtggctggtaccagttgttcctttccatgtttagtgcttccttcaggatttcttgtaaggtaggcctggtggtgacaaaatctctcagcatttgcttgtctgtaaaggattttatttgtccttcacttatgaagcttagtttggctggatatgaaattctgggttgaaaattcttttctttaagaatgttgaatattggccccccctctcttctggcttgtggagtttctgccgagagatcagctgttagtctgatgggcttccctttgtgggtaacccgacctttctctctggctgcccttaacattttttccttcatttaaactttggtgaatctgacaattacgtgtcttggagttgctcttctcgaggtatgtctttgtggcattctctgtatttcctgaatttgagtgttggcctgccttgctaggttggggaagttctcccggataatatcctgcagagtgttttccaacttggttccattctccccgtcactttcaggtacaacaatcagacgtagatttggtcgtttcacatagtcccatatttcttggaggctttgttcatttctttttactcttttttctctaaactgctcttctcacttcatttcattcatttgatcttcaatcactgataccctttattccagttgatcgaaacggctattgacgcttgtgcatgcatcacgtagttctcatgccatggttttcagctccatcaggtcatttaaggtcttctctatgctggttattctagttagccattcatctaatcttttttcaagatttttagcttctttgcgatgggtttgaacatccccctttagcttggggaagtttgttattaccgatcgtctgaagccttcttctctcaactctcaaagtcactctccatccagctttgttctgttgctggtgaggagctgcgttcctttgaaggagaagaggtgctctgatttttagaattttcagcttttctgctctggtttctccccatctttgtgattttatctacctttggtctttgatgatggtgatgtacagatggggtcttggtgtagatgccctttctgtttgttagttttccttctaaccatcaggaccctcagctgcaggtctgttggagtttgctggaggtccactccagaccctgtttgcctgggtatcatcagtggagtctgcagaactgcaaatattgcagaacagcaaatgttacttcctgatcgttcctctggaagcttcgtctcagaggggcacctggccgtatccggtgtcagtcggcccctactgggaggtgtctcccagttaggctactcgggggtcagggacccacttgaggtagtctgtccattctcagatctcaaactctgtgctgggagatccactactctcttcaaagctcagttggaaatgcagaaatcacccgtcttctatgttgctcacgctgggagctgtagactggagctgttcctattcggccatcttggaacctccctcctctcccaaagcgctaggatttgaatgccacaatacatattgattcatgtttttgtccattagtggtccgtgggtatctataaatgaagtctattttagagtccatagatatcagcgttctgcaaaactgtcagggatccgaggctcccagcctacagagcttcttttacttatatgtagtatagatatttaggttcagcaaaacttggttttctgataaaattagatctgttaaggaatgtacccccaaaacttaacatgaaaaaccttttcaaacgacaagtaaacctggcacagtggctcgtgcctttaatcccagctatgggagattgaggcaagaagatcacttgaggccaagaattcaagactagcctgggcaacatagtgagatccttatatcttaaaagaaaaaaaaaataaatttagctgggcacagtggctcacttccaagtagctgtagtcgtagctatttggaaggctgaggtaggaggatcacttgagccaaaaaaaacttctctttttatgtagttagagtgagctataatcatgccactgcactccagcctgggcagcaaagcaagacccctgtctctaaaaaaaaaaaaatatgtaaaagataagtagacagtgacagttttcaaggtggtacttgaaaattcaaacatatagaaattatcatgtgataagatataataattataaaaccataattaacacccttctccatgcttaattgattatatcttccttgtcattttgttccttctttctgtttaattagcaaaatggtgtcttataattctggaacagcaaacaaaatttttcaagtcagcctacttctaacactaaataatttcatattttctctaagtaccttatacctgtgggtccaattttacttctattaataaaggcagaatagatagatttttccagaaggcacttaagtgtctgaattctgcccatggcagagacacaattttatctgaaaaaggttaaagagattaatacttcctcattaaatttccaaataatttatttaagtatatattgccaattttcacataaaattaaagaactttcttttattcccgagaaggcaagtcatgggttgtctcaaacaaaatatgaaaagaacctgggtcaggtatcagtgctcgttcaattaccttggctttcttctttacgtcaagcccaaataattctaaatgttgtgcttaggttttcaaagggcttacgaagaagcaattaaaagctcattcaaatgtagagagcaaacaaattaaaattatataattccatcaacctatctaatgctgagattcatctattcattaattacacaaacatctgttgagggcctataatgtaccacacagtatagcaatatggggatctgcaaatgaataaggcacaatccctaccctcaagaagctcatagtcttctaggggacactaaggagtaattagaaaacaattatgaaagtggattataggcacacaggaatgatagaaccatcaatccaggaacttaattcactctgggatgggagcatggatggggacagtttccttgaaaaagtgacacctccctgggtcttaaagaagcagcagtcaggtaggccaaaagcaaagaaggactgtctagaaccgagcattcagcattcagccagcttgcacggagacaaaaggctaggacacagcatggcacacccacaggaactaaaagcactgctgtgcccaagtggccacttcaaggcaagaatagcaaatgatagacataggaaaataagcactagtcacatcttggaagccactgtaaaccgtgttagggaattggaactttctcctggaattaatggagagctaccaaagaatcttagttagatcagcatcagtgtcagagagaatctaaggatccacagaactggaggcagggaggccaacccagagactactgctgacacccaaatgagagatgttggcagtgggagcagaaataaagagatgggtcagacatggtggctcacacctatcatcccagcacttggggggccaaggtgggtggatcacttcaggccaggagttggagaccagcctgggcaacatgggaaaaccccatctctacaaaaaaaaaaaaaaaaaaaaaaaatacaaaattagccaggtatggtgccatgcgcccgtagtcccagctactctggaggctgagaagtgggaggaccatttgagcccaggaggtcaaggctacagtgagccatgattgcaccactgcattccagcctgggcaacagagcaagaccctgtctcaaaaaaaaaaaaaatctgtccttgccaaaaaataaaaataaaagagagagaaatgaagagattaactttagaaatatttatgaggcaaattaggcaggagttggtgattcaatgtgggcagtgaaaaagaggaaggaatcaagaataacctccaagtttctagcgtgggtgcctaggggattgtgatagccttttcatgttaattgattatatctttcctgtcacttacagcaatctttcttcttcatctaataaaatactttcattatgaaatatgtttcacaaattcaacaagtaagagagcctccatctgcctatttccaatagtttaagactgattttgtattttctgccagtgcctcatagtgggttaaatgctatttctattaataaagataaaatatgtagactagcaaatatagaaggaaaatccagttcaggagggaagatgattattttcagttgggacaccttgagttcaaggcaacttgcagaggtccaaaggtagttgagtatacaagactcaagtgtgggcaaaaatctgggttgtaaacacagatttaagtctcatcaggccacagagggtcactaaagtcatgagaatggtgagactatcctgagagtgtccagaatgagaaaagctgctcagggcagggctctgagcaacaccaatactcaagggctgagtagaagaggaaaataaaatggaatgaccaaagcagctcaaaagagagccaggactgctgggagtcatggcagccaagggagtggtgtcaagaaggaggaatggtctccagagtcaagtgcaatctaaatgcccatccagtgtgagaaggaaggaaaagtgcccattggcaatcaggagttatctggtaactttagtgaatacagaggtggcatattttgtttgtggttaaaagatatctaatggagaatttttatatcattaaaaatgggagaattgcctcatgaaatgtatagtcatttaaaatgatatgcaatattgttttaaaatgactgctataaacttatctccagtctcttttcccaagcagttgcccttagtagttccaatcccctctgtaaagtattattattagcaaagggtcatccaccacacattgaatcgcaaaataaagctcagctttcttcccactctgtgagaggagtaagagaaaatagactcaaaactatatagcctaaagatgaacaacccatcatttatgcatttagtatctatctattaagaacctcctctctgcctgagagaatgtcaggccttcaggatgcaaattttgagacttgagcagcttttatgcaatcaagaaaggccaataggataaatatggcagagcaaaaaagtgagaaaaagctggataatatttctgagctgggaattaatcaaccctggaacaaccctatagttaggcttcttattatgtgagataataaatcccctttttgtttaacttttttgagttgtgttttctttccttgcagccaaaaacatccacaatgatacaagaatgattttaaattatacaaatatccttaatagagaaaggaatggaatgatacatgtgatagacaaattgctcataggtcgccatcttatatttacccaacattacttctcatctaaaattattttcaggccagtcatgggggggtcatgcctataatcccaacattttgggaggccaaggcaggaggatcactttagcccaggattccagaccagcctgggaaacgtaacaagatcgtgtctctacaaaaaatttaaaaattagctgggcatggtggtgcacacctatagtcccagctactcaggaggcttaagcaggaggattacctgagccccggtgtttgaggctgcagtgagctgtgatcgcaccactgcactccagcctgggtgagagagtgagaccctgactctaaaaataataataaaataaaaataaataaaataaaattattgttagacctattaaaacagtcttttccagtctgattccaaagaaattagaatttaaaggttttttccaggttactgaaccaaaccccctcaatgtccagggatgccgcagttgccaagatccgcttcatcgctactattttctttcttgttcaagctctccctatggtggctgtggcagcagtcactgaagtaaccaccaagaagccctccaacaaacctacctacttccactcagtcaaaaagaagagaatttaatattggggcagaaggagtggaaggtttgaatacaaagtatgccacagagccaaaggactcattcagctgtcaaccacacacatgaagacacccagctatacactccaataaatatttggttcctttcttgagcataacataatcaaaattaaagattgggaacctatctcacttccaaattgctggggtatattcataattcttcagtacatccgtactttcaatatcatccaacccctgaatgagattgctggcataggttcccttatgatttaaggccctgctccacatttataaagaatcatcccattgtgtgtaacttctttgcgacaggttgggttttaggtgtccacaaagccaaagcaagattcctctccaaacacttacagcaatcttgacgttcatctgagccatcatcacagtcttgatcttggtcacacacccaggagttggggatgcattgtccctcactctggcacttgaaatagccctgctggcaggtcacaacagctaaaacaaaccaaaagaggactcattatggcaatcatcctccccattatactagcaagcaatgcttgttccagaagagtgtatcatgtaaactcctgctcaatttatttgaaggcaaatagtaaacaacccttatactagagtctgtggacgccagtcagagttcactgtcaaataagctcagcaacagcatcacaacaaactcatgaaccaaagcaacttaaaaacacagagaataaaacaaacagcacacatacacacaaaaaaattatgataaaggtattagattaaaagcttcattcaagtaaacattaactgtgagttactgttaaactatttgtttcataataactaatagtaaagtatcatgatgaactggaaaattcatgagatttgggaaagaaaacccaaaatcaaataattattatttccatgatttacttcctttaagatctttggcaggttctctgaacctcaatgtatgcatcataaaatggggactatactcatctcactgtttgttgtgaaaaataagttaaataatgtatgtgaaagcgccatgtaatgttacttgctatcactatcgtcattgatattgttgttattgttattatttttacaggtcaataaaatataatacaggtaacaatctctgaagagttgttggcatagctgttcacttattcctttaccccagatacactgcccttgcctttttgcttttattgtttaatcaaaatgaactcagtaagcccagaggaggcaaatagttagcacatgattgtgtctctacaaatatagtttagtcccttgttcaaagtgcagtccacaaactagcagcatcaacatcatcaggaagtttatagaaacgcagaagctgaggtcccacctcaaaatatggaatctaaatttgcactttaatgagctcctgggtgatccatttgtgcatgagtatttgaggagcactgtacagaaccccatccttacccttcctcccattttcaaatgcgttgtcatctaaatgacacaccaaagtttgactgctatggtatgccataacatggccaacaattcaaaacaaaaatttttcacctgctttcctgatttttgaaagataaccctcattagttcacctgctgggatgaaggaaattgcagatgtatgattgatcacctatgggaagttgggaagagcaatgggatctgtgcatagacttaccaactgtaagaactttaataaatgacttaacttctccgagtctcaatttactaatctgaaaccgacctcagaagattagtgagaaaactaaatgacaaaatgaatgtgaaagtcattttataattaattagatttgaagtttactacattatcgtatttttcaaattttttaaaactagaatttttaaaaaacataaatcacactaaccaattctgtgatttctttatggtaattgacacaagttattctacatcctttacataaaaatggactcctctttgacttacaaatcacagtagttcagataacattattttttgtttgttcttgtgggtacacaaaatttacagagtgaatattagaaataatcacctacagactccagaaaactgcacccaaatatgtttccatatcaaagttgtggtcaagggataagggtgagatagaaactgatgctctatcatcaatgtgaattgaacccctacctcagaagggagtgaaattattgttaatgccatcagttctctattcaaccacacagatctcaaaagacttgggcccagacctggctctgtcactaaaaggcatagctcttctctttgttacagctgaaatcaccaggaagcacttaggttactcaaaatagaacttagcctggcccctcctcacttaccgcagccaatttcatccgcgtcatctgaacagtctttggtcccatcacacctccagtctgcagggatgcaatgcccacttccacagcgaaaatgcgcactgtcacattctgcaataatagacagaaattttaaaaacttatgccatgcagatatttaaccgaagaaatataaatttttgataaaatgaaaaattattcaactaattagataatcaaagaaatgcaaattagaaaattaggtaaacattctcccaatgataatataaaaatatttatttgaacatccgtgggaagaaagtgattttcatacacagttgattagtgtgtatcttgatggaactcattgggaaagcagtttgacaacacgtatcttgctttttaaaaatacttgatctttaatttagtacttttacttcaaggatttttttcctaaggaactaatcaaagaagtagacaaagatttatgtataaagattttcatcgcaacattatttataacaaaggaagttgcaaacctcctaaatgtccaacaataaaaggattaaatttgtttacatctttatattgacatattagtaacttaaaaaatggttatggagaaattctaagtacttagagaaatacttataatttaatgtaacaaaaacaaggacgtaaatttttactgataacagagttacatatgcaaaaaaaaaaaaagcgtaaaaaagaccagaatgttaacagtggttatctctgattgataacatcgtgagtaacttttcatttgcttgactatactttcttgagttcctcaccttattttttaagtgattttttattactaaatcatatatagcaagttatggcctttcattcttagattcagactaatattttgtcttaatttttaaaaattaaattataacttgccagatctataagctcatctctgcaaacaattttttttaaaccaaagagccaaaaacaaaacaaaacaaaatctctgcagccaacaagagtatacaaacttgacaccaaaagttgacaccccaagtggcagtgatagtccctagtgatactggaaggacaatataacttaaacaagctcacttcactgaactaatatatcctgtgattttcctaggtctccccaagggacaaagttccccaaatacctggccagtgaccttcccaagcattatgtgccacatagaaaaatttttcaaagaaagcagccactaccagccccacttagagaagactcaaaattattttattctttcacaaacccaagggataaaggagaaatttttgcagttggaagaataattatatcttccccatgtatttaagcaatcatgctaaattacccatttcaatttttggctaattaaccaaaattaggtaaatatacagatcaagtacctactcctaaaataaataagcaatgtgctatcctgatttgtgtaaatgcaggcatatcaacagcatgacataaacatagttaagtgatctatttctagggtatataggctactttgttcatggaatgttcaaatctgattgtctggtagtgacatcctgatttataatgtatgctgcaaatggtcagaaacttcgcttggctaaatggtggtaccgagtggtacaggagtacgtacacccaaataccttctatagactaatgcatgatggtggttggtggtgcaggtctggggttggtggtgcaggtctcttatcaactacctttaaaacacaacaacctcccttgcaaaaatgcccctaaggaatgtacaaattcactctggaatcccagaacttctcattggattttgttctacaaagcaatatttccatgggagattaggggctttggaggtttagctattaacacaacatatattaaatcacttttatcaattaggtctattgttagtaatccaacataatacatttgtaagttcagtacatttgtctcccttagtatctgaggttgtaaaggtagtatcttctggttgaaaaattataacaatcataaagaacagtcctcttacagacagtttcatattgctatggagaaaagaaaaatataaatttagagactgagtatttaggaggaaattatcagaacaatatatattgcctgttttgaaaatatatataattaatgctatttcttaagcaacttttattacaagtcccatttttgaggagtggggtggggggatttgtttgtttttgccaaactaaaataccaagttaaacacatcatgaaaagaacacaaaatagagactcaaaagtcattttataaaacacttcaaagtcaattatttaaaatcacacatatgaaaaatgaaactgatggggaaatgttgcaattaactaatttttataggtagtgattttcacacttgatctcctcactccattatctaatatatcaaatccaatttactcaatttatcaacagatctataattcatttgtcaaattcaccttttcagtagtaacttcgatgcctgtttataactcccaaacgactattgtttggaaatatctctccagaaaaaacaaactgatactttatcattgctgggtgacctctcagccatcagccaaaatgcttcactggcctcagaagctcattctctcataaagggaatatgtgttgtttaaaaataaaccaaaaataaaccactagtgaaaaggtctagattaggtctaataacaattgcaggtgccccttacttcaattagtctatatgcaatttattttgagtgttttgttttaaataagtagcctttactcacaagccctccaaaagttttatctagatattatctacattttgttatttatttgaagatttaaaaaaaaaaaaagctaaggggatgatttcatacattggagccacccacagggagaaaaaaaaaatctacatagaaccagctttaaaactttgttcagaaaatagtctcaaaactgccacattcaaccaatccagttttagccaagaagtaatcttgcaaataatcatttatgtaactttaaaacattctccaggagcctctctggtttgggggctgcctgattaaaaaaaaaaaaaaatccctctagtaaaaaccaaggaggaaaggaggaaaatacaatccacattgaaataaaaaccttttgttaagaaccaggcaatcatcacaaaggaaccatcggaaccaaatgaacaccctatctctccagcactagcccctgtctgtcccatcaatcagaatagatggtgcaaagatgaaaagaagtactcatatagcacttaaatggcacacaccattctaagtgctctgccaacattagctcatttaatcctcataataaccctatgaaatagatactgttattatgaatattttacaaataaataaattgaagcacagagcaattcggtaacttgcccaagatccaacagcaaatatgtgcaaagcaaggatttgaatctgacagctctgattccagcattcgtgctacttgaccactactctatgttccctttcaccaaaaaaaaaagtttattccactaaactcaagaatgaatgtaaaaatctgatttttttcccccaaagctgctctcaattaacattaattgagttcattattgggctggcatagaatccatagtgcttatatacttcagttggagaaaaagagtagtttacttggtgactaacatagcattaaaaaattattgggcttaggaaaaattgcagcaattgaaagcaatgcaaaaaaaatttaagcgttttgaaatcggtagtaaaattttattagacataggaataaacttgttttccaacctcataaagagcccaaagctaggggaaaaaaaaaaaaaaagagtaatcctttcttcataagtagccatatcccaagcttcctgggtaagtgttggactaagaatgtgttaagataagatattagagtaacagatagcgcccagagaagaggagtcatttgcctgtttgttttccacagcaaggaacaacactggattgagagcattcctctgtgtcatttacagcctctggcacagcaccgggtgcttatggaatagctaatgcatgttcgtcaggaagtgtagaattctctttgtaaaactcagcctgctgagaccattatatatcagagatatagaaagctatcagagcaaacaatgagactttaaatagaaatttaccatcttaaatccatagaaagaaaaatggaatctggaataatctgaaaaaaggggaatatctagaagtttttttcaaaaaaaaaaaaaaagaaagaaaaaaacattgagtcatattaatagcagtttcattcttttacccgttccttgtaagtttctttctccttccataaattctattcttataagacaaagacaagtggtagtcaatggaacattgtccaaagttaacagagtaaggtaatttctgtggcaaatcctatttccccgctagatcctcttaacacatgctggtccttccaaacacttggtctacctgaggaggtacagtcctctttttaaaaatttgtatgagtaaatcacattttaatagttccaccttcactgaactcaaagaaacaaacaaatttaagaggcaattccttaacttatccataatttttgcttcactttttctatacttaattttgattcctttggtatggatagacatccttctgatattcataagttggctgacagttcactacaattcccataccttgcccacataaacaaggccagtccccttttgaagatttagagtcacctgcttatttcca

SEQ ID NO: 1977 - DNA, 5216 bp, Homo sapiens
ttcagataactcacagggaaacaatgtttatttcctctcccactaacagtcacaaaaaatcataaaaaagagtagcgggggcagttttgatggctaacccctctttccatcctttgggggaaaattgctcatctccctataggtggaactctaaagacaatgtattcctaaaaggggccatctgggcggtgtcctcttttcccagcgccctgatttctattcttagatctggagataggcggctttcatttttcctgctcccagttcccagaccttccgtggggccgcaggatccccggctggcgggtcgcggagggtggccggccgggctgcgcactgcgcgcctccgctgcggggctccgggcctgtggactcagcggagtccgctgagtcagtttcttcccgcgcgactcccggccgcgccgccgctgcggtggaatctggtcccaggaggcggcgtccgcccggggtccggtctaggcgtgcgtgggggccacggtcacggtcatcccagccaggcccggctccagcagccccacggccgccgccagagttctgcgcggcccgtcgcctcggcggagcctctggcaggcccctgagctcgtttttggggcctgagtgggggaggaggaagccgagcaggagggctccggagagggagggcaacgcggggcggggagctgcctccttcctcataaacaggcgggcgtgggcgccgatggggcccgcggggagcgctggctgcgggcggtgagctgagctcgcccccggggagctgtggccggcgcccctgccggttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcctggaggatctgctggtgttcacgtactccgagcgcggtaatcacttgaaaataaactgtgcttttatttttgcaaactttctccccctccttacatttgcaaattttgtcctcctccccttgaccctgctcaaacccggactcttaaggagccgcaaactcccatatcctttccttagggcagaaagcagctgagaatttcaggaaggtcttcacctttttgacttttctccccgtttcagactaaaaaggagagggggtgctgtggattgtgactttgcttcttttccccacccacttgttttccagcctccaagttatttcaaggcaaaaatatccatgtgcctctgttgatcgtcttggactcctatatgagagtcgcgagtgtgcagcaggtaaaggcattgttttcacttcaactcattctcccttctgtttggaaggagacgttttactggcaatgttaatatagccgagagttcttggttattcccaaaatttggcttgaggaacctctgactgtgattttaagatgggaatattgttaaatcattacgcaatgtaaacgggatgaagagccccagtatgtgttccctgagtgtctttaagaagtaactttataaaaccaacagtatggatggtggtagaaggaggataaaaatgggttcggttttagtctcgttattggcaagatgaattcattagtgtttagacttgactattccaagtatcttcccaatacagagcatgtcctagatgagaagattatgaatagtttggaaaaggggaataattaatagtgataaaatgcaactttgtcactagcaaactcttgtagagttcagcactttttaaaattcaaagatttctagcctttagttgtagtataccttgtagtatctaaagaaagtgatgtcttatgagaccctcatagtttgcaactgttgtcatataaaatgcatgtagaagtgaaacttttacaatctgtaccataggaaacccagaaatttgctatgtatcttggatttttttttaaagggggccttaaaaatggtaattaagaatgatttacagtcaaaacaaaattataggccaaggtgataacttccttcggagcacttagagatttggggaactgaaatcagttttgtcatctgcatgttaactcatgcagagaaagagaattggactttgaactccttggaggtgcagtcagaaagccaatgtttcttaatggttgagaggcttgacagacatgaggcatctcaatctttaaagtggtgtgggtctatctttatcttgatgtttatctctgtatctagctgtatctagtctgggtgaaccatctagcttctttgatatgaggacatttacatctggaagaaatattttaatttgttttcaactgtgaaatattttccatctgactattatagattttcacgctgctatcaaaccaaaccaagaaaagatggaggcataataaagatgctgttcttttaagactcaaagtcggaattttgcctgtggaatatgagtcactttttgggcactggcctattgtgcttcctgctctgcacccacgtcatcccttcttacttgtctctgctttggtgttcagaagtgcctgattctggccaccttcattccctagactctgtacttgatagagtcactcctgcttgatactgctcaggacagtcagatcctgggtaggcgttttggtctgcagggtctagataaggcagtgctatacttgacaacccaggggagcctggaacatacttcctaattcttaattttagaaattgcccaagcctgagcatacttgtccggagtagttatgagtgtcacttagtatttctgcctagagagtaccagaggcaaagtatgctggaaaataaggaagagtttttttaaaagtaattaattacttttttggatatatcatagttgtatatattttggggatacatatgctatttgatacatgtatacaatgtgtaatgttcaaatcagggtaactggaatatccgtcacctcgaacatttttctttgtgttggcaacgttgcaatttctttcttctagctattttaaaatatgcaatgaattattaaccataatttccctgctatactattaaatattaacttaattgcttgtatctaattatatttttgtacacattaaccaccttctctttatccctccccatcctttcatttccagtctctggtaaccaccattctactctcttcctccatgagatccaccttttccgctcctacatatgagtgagattatgcaatattttatttctgtacctggcttatttaatttaacctaatgacctccagtcccacccatgctgttgcaaatgacaggatttcattttttatgactgaataatattccattgtgtatgtataccacattttcttttatttttagttaagtaattaatttagagacagggtctcactctgttgcccagactggagagcagtggtgtgatcaaagctcactgcaggcctgcaatcctgggctgaagtagtcctcctgcctcagcctcccaggtagctaggactataagcatgtgccaccatgctcagctaatttttttttctttttttactttttgtagagatggagtcttgctatgttgcccaggttagtttcaaactcctgacctcaagtaatcctcctgcctcggcctccatattttctttgttaatctgttgatagacatataaggtgattctgtattttaactattgtgaacagggctgcaataaacatgggagttcagatatatctttgatatactgatgttctttttttggatatatacccagcgatgagattactggatcatatgaaaattctctttttagttttttaagatacctccatactgtgtttcatcatggctgtgctactttatattcccatcagcagtgtaccaccattcccctttttctgcatccttaccagcatttgttattttttgtctttttgataatagccattctgcctgtggtgagataatatctcattatggttttgatttgcctctccctaatgattagtgaagtttaggatttttttttcatgtacctgttagccatttgtctgtcttcttttgagaaatgtctatttggatcttttgtccatttaaaaataagacttttttttttttttttttttttgctaattgagtttttttagttccttatgtattctggttgttaatcttttgttgaatggatattttgcaaatattttctccctttctttatgttgtctcttcactttgttaattattttctttgttgtgcagaagctttttagcttgatataatcccatttgcctatttttgttgtaattgcctgtgcttttgaggtcctaccccaaaaatcattgcacagaccaatgtcctgtagcatttccccagtgttttcttctagtagttgcatattttcaggtctgagatgtaagtctttaatccattttgaaatgatttgtgtatatggtgaaagctgtggatctagtttccttcttttgcacagccaatatttgattctcactgaaatctcactgccctcctggaaatattaccggatgttttactgtcatagcgaagtgagagtaagctgctcactgaggatcaaagagcttgtgacagacctaagactcaagtcttctcacaccttcaaaatctctttccatcatacaatctactagctgctgaattcgcaagctttttgtgcaagctagtaaaaagcaaaatggtttgatacaaatactgtggccatgctaggtacaatgacatcaatttaaattatcattggtcttaacaaggggatgtagaaaggggtctcctactgacattttaatactcacttaaaagtagtatttttccttcagatttctttatattattagtataattactgtaagtatcctttactgctttatatgttgaattagctggaagtgccaaaagaaaaactcttaatgataaatttaaggtattaaggtaaatttctccttcatttaatttaatagtaattcttaattactatttaaaataaagattaaggtttgtttctagatgccatttaacatgatattccagactgccagttttattttcaaagtttgtttcatattttattaatgtttcttcataaatgacagtctttagaaaattgacggttaagctaggtgctttatatttttctt

SEQ ID NO: 1978 - DNA, 178106 bp, Homo sapiens
agtcaataaggtcaccttaattaagatgagatttttctagagcgtgaaaaagtgcaaacaagctgcagaaagtagcgaggcgccacgaggggtctttgggacctgcagcaaccctattccacccgctttctcggccccgcttgcttctgctgagaaggggccctgcgagaaggctgggaccgccgggcccgggtgggcggcgtaaggagtccacagtcaagcccctcggtcactttcaaggtgacagcgacgagatccgcatccgtcccttccgcaggctctgcgctggcccacgtgagacccgcctccgctccgccggcgctgccgccccctttagccctcagcttcggcccccaggcccctggaacgccccctcccctccccgaggaccggtcccgtcaccctgggcggcgcgctcgcctgtcccctccccaccccggccgccgggcagcgggaacagattccagcgcgcacttacccgcagctccttcaagcgctccgggagcaaagacgcagaggcggggagggctggcgccctttgcaccactggcggggtcgccgagaacccgccccggaggtctcgggggcggcgtctgcacctgggggcgcgcggcgcggcaccaccccacgcctgcggcggctaccaggcgggacccggagccccggcctccccgcctccccgcctccggggccgccagggggtggagcagggcggggagttcgggaaacttgtaaatagccgaactcgggcctcccgccccaacccggggcggctccttccgaaggctccactccagcggctcgctgcgggagaccaaggccagccgccgtcccaggggacggccctcggggaacctgaatgacgtgcgaggccgtacctcggggcgctggactccgctcgggcgctcccgctctccgctcccgctctcgggtcccaatcccgacgctccgcgcgctcccggactaagtgcggacgcgccccacgccccccggcgccagcccgggacagcgctgcacctgttgccacgtgcgacgcggcgctcagcggctgccactgccgccggcgcacctggctgcaccgcgcgtcccgggaccacgctcgtccccgcaggagcccggggctccgccgcacccagcgctagggcccaggccgggccgcggtaggtgggggatctgactcctgcttgcctctggccacctgcaggccgaggggcctcgcaccgcggggcgtatagaaggtgggaaggttgcagaattatcagggcggaagcttgcaaggaaggagtcgtgattgtctcttagaagggctgattcgcagtctgtattatcttcatgcttctagcaagtttactagcaagtgtgtattaaaggttaaagaaagtagctttccagctattagagcttgagatacaacgtggaaaggagtctagaaccccagggagataaactaggctcgacctacttttctctaaacacaaacacagtccttgctgtttgctaaactgagcaaatttcatcgacagctgtcttctaggtccgtaaaatattttcttctataaagcatatttttaatagaaaacttgtccgaagatgctattctgcctgtgagagatgtcacattgctgaaccgtgaaatgtcagacaacctgagaacaaaattttaatatttcctttttaattacctggattgtggtttgctaaaagcttttaaagagaagtgaacttttttggagaatagacgtaaggactctgtatttcacagttttctataccatgaatattagaataactgacagatgtcttgccattgatagttgtaaagacttttcatatgtacaatgatccattatttcctgactacaaaacccaggggtatataggtcagattatctccattattcaaatgaggaattgaagctcagaaaggtcaagtgactagcgcaaggtcacacagccagtgagggcaagtgcaaacccagccagcctaactcctaatcttctcttttaattccattacataatgacacctctcatttgcttcagaaatccctgttgtaaagatagatgcaactagcatgatccgtgttgttaggaaaggcatgtgattaattttaaatagatatagtatttaacaccaccagatgagtctccctctgaaaaagcacacaaaaacaaaacaaaacgctgacatagtttccgcaagtcacgaggcaattatgctaattagcaacaagcctccatccctaagcagaatagttcttgtgtgaaacatatcatttaatctttataaccctgatgtgacctagatgatttggtctaaaccccacaatcctattgtgtggcttagttatatctataaatatagaacctgttttacttcatttttgtgtcaggtggtttgaaggggggaaacatacaatgctctgctaagtaattagagctacttacgcaggcattggggaatctgaaacttagcttctaattgtctccacataaaaacagaagttaacttctagggacatcttcagggactcctcaaggcaaatattcatgaaatggggcctattggcttttcttttcatcttggttctgggcatgttgccatgttcctgatctctgaactctgatgctgacctgctacagactccaggagcaatattaaggataaaataataactcacataactttgtggctctttattctaaaaaaaaaaaaaaaagttggctcaattttttttcctccataagaaaatgcaaattgcaactgtattgagaaaccattttttcacttatcagattgtcaaagattagaaagtttgataatcacagtgttggtaaaagtgtagactagcagtcacaatgaaaatgtaaatgtaaattataatgacctccctagggggaaggtcaggatacctaacaatattgcaactatacgtataagagtttatcttggccctgcgtggtggcacggtgactcatgcctgcaatcccagcacttggggaggccgaggcgggcagatcacctgaggtcaggagttggagaccagcctggccaacatggtgaaaccctgtctcaactaaaaatacaaaaattagccagacatgatagcaggcgcctgtaatcccagctacttgggaggctgaggcaggagaatcccttgaacctggaaagcgaagtttgcagtgagccgagattgtgacactgcactccagcctgggcaacgcaccgcgactctgtctcaaaaaaaaaaaaagagtttatcttacaacacacaggagaaatggtatgtatctacaaccttgtttatttcagcattgtttataataagatatatttcaaatacaaatattctttagtaaaggactgataaatcatgatataggcataaaatgaaatcttatgaaagcttttaaaaagactgagaaagctctttgtacttttatgagatgatcttcaatctatgtcatgtgcattttttaacacaaaacaattacctaatagtatgctacaatttctactaaaagggaggaaatgatacaaacttgtatagatacatatatagatatgtttgtataagcataaactaagcataagccaccaggcatggtggcttgcacctttaatcccagctatttgggaagtctaagggggaggataatttgaacccaagagtttgagacctgccagggcaacttagaccctgtctctataaaaaatacaaaaattagctgcgcatggtggcatgcgcttatagtcccagctactctggaggctgaggtgggaggatggcttgagtccaagaggttgaggccatcgtgagccatgattgtgccactgcattgcaagctggtgacagagcaagaccctgtgtcaaaagaaaacaaaacaaaaacccataaaatatctggagagatataccagaagcagataacattggttgtgtcttgagatgggagttggatagttaaatggcagcattagaagagaaatttgttactaaatacaattttgtactttttttggattttgagccatataaataacagaacccattctaatattttaaaatgttttaccgcatgaagttttgccatcaggaatgaccaaagtttctctgtgaacgaatttcacttatagataaaataaatgattggtcaggcatggtgccgtggtaggtgtatcacctgaggttcggagttcgacagcagcttgaccaacttggagaaaccccgtctctgctaaaaatacaaaaattagcgggggcatggtggtgcatgcctgtaatcccagctactagggaggctgaggcgggagaatcgcttgaacctgggaggcggaggttgcggtaagcagagacctcgccattgcactccagcctgggcaacaagagcgaaactccatctcaaaaaaaaaaaaaaatgttcaatagatgcttctgaccctatttcttctctagtttatctaaaaaagacaactttggtacataaaactctaacacaagtgtggtgaaaacgatgaattagcaaattgtaaattccttgcaatttgattagcagtgacatctcccttgggtagggcttccagataactttaccaaagttgcattcaatcagaaatgaaaaaagtattccaggccttaattctcaaggggaactccatggagtcattgcctttgttcccaatccgggtccctttttttttatttatgtttccttatggcaccatctcactgagaagggagttgaacatctttaaaagacagaaacagtacattttaaaaataaatatttcaaagtgtaagtatttttagtataaaatggtattcccggaaaagcatacaggtaatagtaaacatactattgagcaacgaattaaaacactgagcttcctgagacccaggtacgccaaccgcttacataattgtcattttcaaaagaggctgaaagtttctcaaaggaagaaaaacttttcctagcactgaattttaagaaaaatttttgtcactcattttcaattcaagactacaaaatggaaaatgacaatatactattaaaataccataaggaacttcatgtggctatttttcatagtgactgtgaataaaactagaagtttttttcttctttttttttaatagagacggggtctcgctatgttgcccatcctgggctcaagcaattctccagacttggcctcccaaagtgctgggattacaggcgtgagccactgtgcctggccaaaaaaacaaaagtattgtaataaaactcaacttgaggaagttactcacccagacagggaccggtcttataacagcataatgagatcaaggattggctgtaaatagaagtgtggaaagacggcagcttcttcagatatacttctgaaagtcaaatatgctcatggtaaaacgtgaacatctccacaaatcccttaccacagaggtaaacacagttgctttatacaacattccagaaattttctagtgagcactcattagacaggtgctgaagcattgtcagaagttgcggtaatctctggcaaagtcccagaatgctggaattttgtgatactgtcgatgaccttttctttgtttttgtgaagagaatgtgtatattacacatagtcatatgatttttttttttttttgagacagagtttcgctcttgttgcccagactggagggcaatggcgtgatctcggctcaccacaacctctacctcctaggttcaagcaattctcctgcctcagcctcccaaataactgggactacaggcatgcaccaccatgcccagctattttgtatttttagtagagatagagtttctccatgttggtcaggctggtctcaaactcccaccctcaggtaatctacccgccttggcctcccaaagtgctgggattacaggcgtgagccgccgtgcccggcctatgacttttaattcttgtgtccaaagatggtgagacatgtgtggtaagatacccaaactgaccagctgtagcaatggctgcataacaagaaagagagaacgtgagagcagtaaatggccctgatttatttaccaataactcccaggttcttgattatctattttttttctcagtggacttgaagacccaactggactctcctcttttttcttttcttttcttttctttctttttttttttttttttttttgagatggtgtctagctctgtcacccaggccagagtgcagtggcacgatctcggctcactgcaacctctcccatccaggttcaagcgattcttctacctcagcctcccaagtagctgggattacaggcgcctgccaccacacccagctaatttttgtatttttagtagagacagggtttcactgtgttggccaggctggtctcgaactcctgacctcatgatgcacctgcctcagcctcctaaagtgctgagattccaagtgtgagccaccacgcctggccttcttttttattttcttatttttgagaaaggatctcactctgtcaaccaagctggagtgcagaggtgccatgatggctcaaccgcagcctcgacctcctgggctcagttgatcttcccaagtagcagggaatggagtcatgtgccaccatgcccagctactttttgtattttttttatagagatgggatttcaccatgttgctcaggctggtggccaacttcttagctcaagttatctgcccacctcggccttccaaagtgctgggattacaggcatgagccactgcacctggccctggactgtcttcttaatgccccagaaggtgactagcagaatagaaatgttcttatgccggctgggcacagtggctcacaccttgtcatcccagcactttgggaggctgaggcaggcggatcatgaagtcaggagatcaagaccatcctggctaacatggtgaaaccccatttctactaaaaatccaaaaaattagctgggcatggtggagggcacctgtagtcccagctactagggaggctgagggaggagaatggcgtgaacctgggaggcggagcttgcagtgagctgagatcgtgccactgcactccagcctgggcgacagagcgagactccatctcaaaaaaaaaaaaaaaaaaaaggtccttatggcaaagtctgaagatttttaagtatctcaagaaaggagttttttgttgcaagttcaaagcagtagaaaaaatgaagaaatatagcttcctcttatcaaaatgacctgcagaagtttgaaaaactcttccatctccccatcccatggaaggcatcttcaacagtcctgttccatttatagactctgtagaaggaacagttcttataacatgatgccaaaattattctagttcacacacaaacaagttgtcctgtaattctgctgtgggcctcctcatattaggaagaaattaagaaaaatatagtaccaccagtttgttatgcaaccacttcgaaaatgtttactttgcttaaaatgtcatggctaaagaaactactcgtctgcataatccactcttgacagtgattcataactgtgtgacatttgggcttggtcaggctttactccagtcagattgagtctttccttaaaaaggggatatattttcaatttcagagtatttactgcttcatgacaaatattaataacaagtctgtggcttcgaggcctcatacctttgagactaccacagtctacttagcatttttttttttttttacttagaccttttgaatttgcttttaatttatacccctggccttgttctcttgaccaaataaaagccctaagagagcttccactgccagcagccttccaatttgctctgttcccccttgggccctgttgattgggcccagtgatcacctaaaaagagtgcaaagagtcaggaaggcttgtgggttcagtctttctgtgctaacaccaggccacatccaggcctgatgtactaactgatctccagttcattccttttgcaatttttggccttgattcatagttcctgattcttgattggctctgaaatcctccccattttcaaaagggatgcagtcaagcaggccaaagcgctccatgttagctaacaaatgtttgcaaatcataataatgtaggaagagaaccataaactaaatgaacaacaggcattagccctcatgctgtcacataagcattcctcaaaatataatcatgcttctaaacatgggctggcaattcaggaaagggccactgaaaatattagcctcgttcttttctctgtagagtgagcacagactattcctaaaccacattgcagtatgccaacattgtaaattaatgcctgattggttacctagaagtaagacaatcttacttttaggcatctagaacactgagaaatccaggatggacacttaacactaccaaagattgatctattttgggtaagtatacttctgatctctttttgaggactgtattagtccattttcacactgctataaagaactgcctgaggctgggtaaattataaaggaaagaggtttcattgactcagagttctgcatggctggggaggcctcaggaaacttaacagttatggcagaaggcaagggagaagcaggtaccttctttacaaggcggcagaagagacagagagggcaggggaaactgccatttttaagctatcagatcttgtcagaactccgtcactatcacgagaagagcatgagggaaactgcccccatgacccaatcacctcccaccatcccccgctcaacacgtggggatgacaattcaagatggaattgtgtggggacacagagccaaaccatatcaagtacctacaaaattatggtgactcttcactaatttgcaaactgattatctgcaaatcttaaatagggaataaaacacaaaaatatcattatccctccagaactgaggacgcaaattggatttagaagacttagctttgacacctagatatgttttcattgatttgacctaacttgatctcagtttctcttttatagagttagttctttagatcagaggtccccaaccccaggactgcggactgccactggtctttggcctgtcaggcacccggccacacagctggaggtgagtggcatcaagcaagcattaccacctgagctccaactctagtcagatcaatggtggcattacattctcataggagtgtgaaccctattgtgaactgcacatacaagggatctaggtaacatgctccttatgaaaatctaactaatgcctgatgatctgagctgaaacagtttaggccaaaaccatccctcctgcaccccattttgtcttccaagacaaaagattattcaaggttgctatgaacacctttatgtggacaaactagaaaacctagaggagatggataaattcctggaaatatacaaccctcctatattaaaccagaaataaaaataaatcagaaactgagcagaacaataacaagtagtgaggctgaaacagtaataagaaaaattgccaagaaaaaataatcgaggaccagatggattcacagctgaattctatcagacattcaaagaagaactggtaccaatgctattgaaactattccaaaagatagaataaaaccagtattaccctaataccaaacccaggaaaggacataacaaaaaaagaagactacagaccaatatccctgatgaagatagatgcaaaaatcctcaacaaaaggattctcaacaaaatactagctaaccaaatacaatagcatatcaaaaagataatacaccatgatcaagttggtttcataccaggaacgcagggatggtttaacacatacaggtcaataaatgtgatatacaccacatatggttgtcttatgaaagtttttgtcaagtagatgcctcaggaagtgctcatggaaacaatattccctgaatttttgcacagtgattacatttcgtatgctgcctttatcttggaaagctactgactcacattttctttcattgaatatcttaaatatgttactccatttttcttctacctaaatcattgctgttaaaaaaaatttgatggcaaatctgatttttttttcctttataagtggattttttttgcctagaagcccaaaataattttttcccctttaaaatgtgtaattttggtgggatgatcacttgagctcaggaggtcaaggctacagtgagctgtgatcacaccactgcacttcaggctgggggtcagagagagacactgtcttgaaaaatatatttttttagctactaatttcattataataagttatggtgttactagtcctgggtcagtttttccaggtatgtagtataacctttcactacgtagcttcaaatacatatattgttaatttgaagaaaatgttcttcattatagttttttggtagtccttctgtgccttgctttggtttttcttcttgagaaactcttgttaaacatatttttgtatatcttttttgcctgtctctaagtttgtttctttctctcaagccctttttattactttccttcaattaaaaaaaattttttctctttcatcttctcttcttaaggtattctctgtgtttatttattcttccattactttcagtttagttttttttttttttttttttaagagatggggtctcacttgttgcttaggctggtcttgaactattgggttcttgaactactgggttcaaaggatcctcccgcctcagcctctcaaagtgctggggttacaggcatgagccactgcacccagcctagtctctgtttttgactagtgtttctacgtctttttccttggcctagtgtctgtttttgactattgtttctacgtctttttccttggcctagtctctgtttttgactattgtttctacatctttttcctaagtatatctatcacctcatttctgatatttcccaattctcatttttcttgttttttccatatcttggatgatttctttaatgtcttctagcacacattgaaataataagtcatggtttgcatctgctctgtaggtatgtctttttagcatctttggcattgtctgtagggatgtttttcagtttcttctctttttttcctgacagtaattttgtatgagatttaatcttggtatttttttgctcatttaaaaaaatatgaaataattttcttaaactttcaggaggaggtaggatttgggaaagcatttccaatttcacaacctgatcgctctctttttttgttgtatttgtgtggtggttaaaactatcggggcttactttttttttttttttttttttgtttgacagatctcgctctgtcgcccaggctggaatgcagtggcgtgatctcggctcactgcaagctctgcctcccaggttcacgccattctgcctcagcctcctgagtagctgggactacaggtgcccaccaccacgcccggctaattttttgcgcccactaccacgcccggctaattttttgtatttttagtggaaacggggtttcacctgtgttagccaggatggtctcgatctcctgaccttgtgatccgcccgcctcagcctcccaaagtgctgggattacaggcgtgagccaccacgcccggcaatcgcggcttattttctgagatggtcagactctgttttctttccttgctttcatctggaccccgtctttccttgatctctatcgtcccagttccgtacaatgagcattcttttccaagaagtttcttctctgtgcagtgcttgtccaggagtggaaatttgggtggttagtttggaacattcattgtgcccgtcagacactttgcattcccctgactttggagtgtgcaaaactttttccagtttcagctgctgttcccaagtggaacctccaagctttccagcaattgcctgcttgctattttgagattatcagatttatcagagtctcatgaattccctccactttctattatacagttgctgataccacctagcccttgtatctgtctatggctttcctcaattccttatgttctagggttcgtggagacacttcatcacctaattttgttatagatgttgtccacgggttttttattttatcttttgtcctttgtctatatttgtggcagaattttaaggttaaaaaatgatgacccccggatacaggtgaccattgtaagggtacaaggaaaatatcccctttgtcctctgaagatttgcttaaaaatcaactcataaaagtcagattaattggagtaaatgtatataaattttattaacgtgtacatgagagcctttagaataaagacccaaagatatagagaaaattatctttttttgtttgtttttgtttgagacagggtctttctgtcacccaggctggagtgcagtggtgcaatcacaactcactgcagcctcgacctcctggactcaaggggttttcccacctcagcctcccaagtagctgggaccacaggaatgaacaacctactaattattttatttttagtagagacagggtctagctatgttgcccaggctggtcttgagttcctgggctcaaaggattcccccacctcagcctcctgaagtgctgggattataggcatgagtcctcgaacccagcctggaaattatttttatgtttaggttcaataaagtatggacaaccatgtagaaatgtaactggacaaaaagggtaccatctaatgttaatagacaaagtagggaaacccaggaaggcctgggttaaacggtaagcttagatagtaagacctgtgtattagtctgttctcatgctgctaataaaaacatacccgagactgagaaatttgtaaggaaagaggtttaatggactcacagtttcacatggctggggaggcctcacaatcatggcagaaggcaaaagagaagcaaaggcatgtcttacatggcagcaggcaagagaggttgtgcaggggaactcccatttataaaaccaagttttattcactactgcaaaaacagtatggggaaactgcccccatgattcaattatatcaacctggccccactcttgacacgtggggattgttacaattcaaggtgagatgtgggtgaggacacagccagcccgtatcagcccatgtgtctctctgagtatgtatgtttttcttttgcatgtagggcaggaccctttctagaatggggatcgtatggcctataattaaataaggtagctcagataatttttttatgaccaggttttacacagaaaggtgcaggaaaaattagagtaatatttttaggttttttatggctggctttggggcaaagaggttctcatttgtatgacccgccttggggaagagggattctagtttctatggcaagccttgaagcagaaagggaccttagtcttagaccagtcttagtcttagacaagaagacatgagaaaattagaaaaaaaagttttacttgtaagactattttggaggcctttattttgggggtgtgttttgagtccaaacaccatcagatagatcttggtagccaccagctatatatggtgagtactccttgacagcaccaagcatgaaatgctcaaacaggttggcagaagtccctgtgaatgctcagagggtgccatagagaggaaaaaagagcagaaggcaaccagcttttatctgagatctatgtgccagatattttgctagtagcttccacatatattatttgatttgatttaatctaataatcacccccatcttctgaagtagaatcttcaggtcttcctaagtcctatgctcattcaacatggaattgtgagaaacttaatctccctgatggaataggaatcagttaaagtgcgacagagtagaggcacctgagtcagcactaatgaaccttgtgaagtcctttagtgtttgtcaaaactactgtaaagatactacctgagactaggtaatttataaaggaaagaggtttaattgactcacagttctgcatggctgctgaggcctcaggaaacttacaatcactgtggaaggggaagcaggcatgtcttacatggcggcaggcaagagagaagtaagtgcaaccaggggaaatgccatcatatctcatgagagctcactcactctcatgagaacagcttggaggaaaccacctccatgagccgatcacctcccaccaggttcttcccttaacacctggggatgacaattcaagatgagatttaggtggggacacaaaagcctaaccacatcaatattcatcatggattcaaagatttcttgattaaaattacgagatattaagattaattatgatgattataaaaataataccaaaccttgattatgtaccatgcacgattttagtcattttacactttacatgtattaattgtttaaatattcataacaattctattaggtagatattattattgcattcttcttctttttcttttttaagagacaggtattgctatgttgcccaggctgctgctggcctcaaagccctggactcatgtgatcctcccaccttggccttctgagtagctgggactacagtcatgtgccatggtgcccagcaagtagatactattatattcattttataagtgatgaagttgaaacccagtctagttataaatatgcccagtgtcacgaagctaataaataacaggattaggattgaaatccaggtcagtctgaccttgaaccaccaaatacactgccttcttataactcagctctttggagttctacatttgatttacttttgtgtttcaaccccagatgtatagttcaaaaataatacataactttaaaaataaagataatttttaatgaaaagaaccagaattaattgtataatctgttgttagaaaaatcttttggccaggtgcgatggctcacagcggtaatcccaacactttgggaggccaaggcgggcagatcacgaggtcaggaaattgagaccatcctggccaacatggtgaaaccccatctctactaaaatacaaaaaattagccgggcatggtggtgcacacctgtagtcccagctactcaggaggctgagacaggggaatcacttaaacccgggaggcagaggttgcagtaagccaagatggcaccactgcactccagcctggtgacagagcaagactccgtcaaaaaaaaaaaaaaaaaagaaaaaaaaactcttaatgaagaaatacaagtcagaaacacttgagccaatttacttaaaaaacagaaacatacagagggtacccctacgaccactatcactaaacagagaatgtagaaagatttaagtgtgttttacatgttacatggttgcatacttaaaatgtcagcagaatcaaacaaaaaatagttatacacaactagaagacagaatttaccgtatcaataatacattaaataacccagcaataaaattaacttgaaacagatgtgtttcttaaaaaaattgattgaagggacagaaagatttcctgacaaagatgccaaaagcaattgcaacaaaagcaaaaattgacaaacggtatctaattaaactaaagcacttctacacagaaaaagaaactatcatcagagtgaacagacaacctacggaatgggagaaaaattttgcaatctattcatctgacaaggtctaatatccagagtctacaaggattttaaacaatttacaagaaaaaaatgaacaatcacattaaaaagtgtgcaaaggacatgaacagacacttctcagaagacatacatgtggccaacaaacataagaaagaactgattattagagaaatgcaaattaaaaccacaatgagacaccatctcacaccagtcagaatggctattattaaaaagtcaaaaaacaacagatgctggagaggatatggagaaataggaaggcttttacactgttagttggagtgtaaattagttcaaccactgtggaagacagtgtggtgattcctcaaagacttaaaggcagaaataccatttgattcagcaatcctattattgggtatatacccagaggaatagaaattattcttttacaaagatacgtgcacgtgtaaaaataaaaagatacgtgtacacgtatgttcattgtggcactattcacgatagcaaagacatagaatcaacctggacgcccatcaacaacagactggataaagggaatgtggtatatatacaccatggagtgctatgcaaccataaaaaggaatgagaacatgtcctttgcagggacatgaatggaggtggaagcaattatcctcagcaaactaacacaggaacagaaagccagtcaccgcatgttctcacttataagggggagctgaaccacgagaacacatagacacatagacggtaacaacacacacgggcctctccaagaaggtgggatggtgggagggagaacatcaggaagaatagctaatggatgctgggcttaatacctaagggatgggttgatctgtgcaggtctgtgtagcaaactaccacggcacacatttacttatataacaaacgtgcacatcctgcaaaggtattcagaacttaaaagttgaagaaaaataagttgattaaattctaataaaaaaaggtaaacatacctaaataactatgctacattcttttttagagagattaaataagacatcaattaaaaatgtttaatatataaatttattgcagttataaattcctgtgagaaccaatagtgaaaaataaatggatgacattatcaaaacattttcattgggaataaggatgaactcagcaaacttggaaaactgaacacactgcaacaatgatcaaaatcttatggccttgggttattacagtcggaaaaaagaatccaacctatagggcaagggaaaaccacataataagttgtcttccaaatagttggctaacaggctggaaaaaacatcatgttagatacgtaaatacacggaaacaaacagtataataaattccagctgtatcaaaaagtaaaagccctttttaaaaaatggaagagtggtttatctatttcctatgagaaaaagaacatgcatttttattttcttttttgagacagtgtctcactctgttgcccacgttggattgcagtggtgtgatcatggctcactgcaacctcagtctcccggggtcaagcaatcctcccatctcatcctcccaagtagctgtgactacaggcatgcgtcaccatgccttgctaattttttaattgtttgtggagacacagtctcactatgttgcccaacctggagaacatgcatttctaatcactgcagaaaacaaaggttgttaccggaagcaggggtgattaattgagcagatttaaattttttaactttcatgcaacaaaatgtaaaataaaaatgctataaagaaaactttccagtatagaatagatatattacaaatataacgtgataatagctttctcccaaaatatatgaaaaaataaatgattatgtaagtcaataaccactttccacttgatgaatggacagtttgcagttaggaacatttagactacatcattgtgtttttaaaaatcagttttattaaaaaatgaaaataaaggttaattaaactcacatgaagactctcttacagatgcattaaactggaagacattttttattttttattttatttattttttttttgagacggagcctcactctgtcacccatgctggagtgctatgatgcgatcttggctcactgcaacctctacctcccgggttcaagcgattttcttgcctcagcctcccaagtagctgggtttacaggcacgtgccaccacacccggcctgtttttgtatttttagtagagatggggtttcaccatgttgtccaggctggtctcaaactcctgacctcaggtgatccacccgcctcagcctctgaaagtgctaggattacaggcttgagtcactgcgcccagcctggaagacattttttagcttgtaaaactgaacctggacaagtctttgggaggaaggcagacgtacattttgtatgttaatggtagaaatgtaaaatggttacatatttctggggggtaatctataacatgctctttgacctattacccgttccttcccctgagaaaggaaaactaacttataaagcaattttcattgcagccttacctataatggggaaaattagcttcagttcaaatgcccaatagtattaacatgtttaagtaaaccatggtgtattaccatatacaaattaaaatgacaagtaaatggaggatgtaatacatagatatgtttatgtgaaacaaggtgaagtaaacaacttgaacccatgataactttatacaattatatagacatatataaatgtaggccaggtgcagtggctcacacctgtaatcccagcactttgggaggccaaggcaggtgaattgcttgagtccagtagttccagaccagcctgggcaacatggtgaaaccctgtctctgcaaaaaatacaaacaaaattagccaggtgtggtggcacaagcctgtagtctcagctacgtgggaggctgaggcaggaggatcgactgaggttgaggctgcagtgagccatgatcacaccactgcactctagtctgggctactgagtaagacccagacatttatattgctttttccaggtatgttttttatatacacatatatatattacatatgttatataatgtacataatgtatattacatatgttatataatgtacataatgtatattacatatgttatataatgtacataatgtatattacatatgttatataatgtacataatgtatattacatatgttacataatgtacataatgtatattacatatgttatataatgtacataatgtatattacatatgttatataatgtacataatgtatattacatatgttatataatgtacataatgtatattacatatgttatataatgtacataatgtatattacatatgttatataatgtacataatgtatattatatgttatatacgtatattaatatgtatatacatattaatatacatattaatatatgtatattatatatgtatatgtatatagacataatgtatattatatatgtatatacatatgtatacatgtttattatatacgtatgttatataacatatataatatacgtatgttatataacatatataatatacgtatgttatataacatatataatatacgtatgttatataacatatataatatacgtatgttatataacatatacgtatgttatataacatatataatatacgtatgttatataacatataatatacgtatgttatataacatatataatatatgtatattatataacatataatatacatatgttatataacatatataatatacgtatgttatataacatatataatatacgtatgttatataacataatatacgtgttatataacatatataatatacgtatgttatatatgtatatatgtacacatatgtttatatgtatacatatatgtatatgtacacatatgtttatatgtatacatatatgtatatgtacacatatgtttatatgtatacatatatgtatatgtatagatctacacacatatacatatatatgtgtatatatatatgacagcatcagtcttaatagcttagatgatttctatttgctaattgctttaattgacctccaaattctggtccttacatctcatgtctacatctccattcatttctctagtgtgaaaaaaaaggaaaaaactgaaaatctcaagaggattccaggaaatcaaaacaatgaattattgaatcaagaatttgaaagagaaaatagatgcatactgaaaaaagaattttgtttagtgagatagatgtaataatgaaggcatgttgataacgggggagctatgtatatatgaggggagggatatattggaaatctctgtatcttcctctcaatcttgctgtgatcctaaaactgctctaaaaaatattttgagaaggaataatgatgtggtaaacatgttctgttatttaaaaagagagacttttcatagccgcctccctccccctctacacacacacagagtcctgtccgtcttcattcccttactcaataatttgtacagacacagccactgggctccagtaatcctaaagtttctagaaaatcaagcacagaaaaaggttaaaaccctgagggaataaaagaattcctttgcatccattgcatttctcaggaagtgaactaacaaattcactgcttttaaatgaggaaattttctcagtgaaattgattccaaaccttcgttaggtcaactgttcccagatttcttagctgatgcctgatctgactattccttatctttagtacagaaaccaaggtgaatgacctttaaaaaacatattagactgttgacgtgtcttctatgttgtactctaggtaaaaacgataaaccaggaaaaagaaagtaaaattcaaccttaggctcatggatccagagtggataattatgagtctgtagtatctacatgcatgtgatgaggttcaaggacaataaccataaagcaaagacttaaaaggttttatcattagaataattgtaattcacttgatctctcaatgtaacaatacttcggtctactgtctcaagccattattatgtcttacactcagcatattggtttgtctaccattaaatatttattttctacagtgctttctggaaggcaaacaaagcagccactctgctactttatattgattcctgagttgtccttcggaaacgctttcaggaagtttaataggtttgaaagatatttagacctgtgactggcaaatatacttccttctttttatttcaataagagagtactagaacttagatctttattgtttaatctagtcagtgctgtcattgtcaatcaagttctcaaatgacacttgtcctgagctgtaactgatctattcagaagaatatgaaaatagtaaagacggcaactatgcatgtttttaccggacacgattttaattgctttaaaatgaagttatgcaaccaatgaggaatggagcttttggagtggcctgaagctaaaggtttcaggtgtatttttgctttctttgaagaaagaaccaaatcattttatttaataaaaaggccatttatcaagaatttcttaaagctgttttaaacctgagtttgcaatttatagaatatgttcaagcagcctcagtgcccttttaattggatggttttcacagatttatccaatttgagatttatccagtgagaattccctttgttcaagtatatatgtcttctcttccataaagcagattcaaatgaaagagtgcaatctgatatatcagacatgtcagttatacatttgatgtggtaaatttataagagaggccaattattgttatgaaaaaatacaatgaaatacatgatagtcatttactgtttttataactaatctaaaagtatttactaaaaagaaactatttcttttcatatgtactttactttttactttaacccttcatatgtcctttaaataaagagaagaaaaaaagtcatttatatttatccacatattttctatttcaggtggtcctcattcattcttgtagatccaagttaccatctgttattattttctttgtcacctgaagaattttcagaactatttcttcctatatgtagcatgtatagatactctaaaaagtccattatatgatgtataaaacaaagcatacaatgtagtctctgccctaattatttgtaatttatataaaaccttttattttttatttttaattgtttattttattttgttttgttttatgtttttgagatagagtcttgctcttttgcccagactggagtgcaatagcgtggtcttggctcactgcaacctctgcctcccaggttcaagtgattctcctgcctcagcttctccattagctgggattacaggcagcaccaccatgcctggctaatttttgtattcttagtagaaatggagtttcaccctgttggccaggctggtcttgaactcctgacctcaggtaatctgtccgccttggcctcccaaactgttgggattacagatgtgagccactgcacccagcctaattggttattttattatttagactccacatatcaattttcttactatggcgatatgaaatagcaattaaccttgaaatatcatttatttttccctattattacatttcccttaagaactacaataagttattttactgaaaaacattgtccttaacgtaccatgagctaatcattcaagaattgtgactaaattatctaaattatttcagtgtaatcacctgaggttctaggtaagccctccttctcattctctgcttcacacatgccaatgattaaaagatcagattatcagccaggcacggtggctcatgcctgtaatcccagcactttgggaggccgaggtgggtggatcaggaggtcaggagttcgagaccagcctggccaacacagtgaaacgcccccccgccccccagtctctactgaaaatacaaaaaaaattagctgagtatggtggcaggcacctgtactcccagctactcaggaggctgaggcaggagaatcacttgaacttgcagtgagctgagactgcgccattgcactccagtctgagcaacagtgcgagactctgtctcaaaaaaaaaaaaaaaaaaagatcacattatctttaagtaaaaaaaagtagtcaactggagttccacttttggtaatggtagggtagctggcatcaaactagatctcctgcagatcaaaattatatactgtgaaaaaaatgtaaataatgtctatctgaaggcactggagggtgtctagaagcaggcagaaataagaagggaatcctttaaagaagggaactaaatatggtttttcagttgaggatactccccagaccttgtggtagaaagaagctagaactgaagctaaaaccacaattttaattgcttgaagggttaaaggacagaatttgggactgccaatatggctggattatgaggggagaaatttcagaaagatggtagccacagatatgggagcctctaaatccatgtgtaaactctctgcacacattcctgcagatctctgaactgtgtattgtgtaggagactccaaggaacccaaacaggaggctgaaaaactgagtagagatttcagctaatgccttgacaagggagaaaaaatttggggtttgagtccagctaggtaactgcctgctaaaacaaaactcaacactcagccaaaaaaataagaaaatcaagagtatgtaaaatgtctcatcaaatgcaccagacgcaatcaaaacttactagacatgcatgcaaagaaacagcatatctcttgacccagagtcaagaaaaattcaatcaatagaaatctattccaatatgtctcagatgttggaattaacagaaaagatctttttaaaactgttttaaatatatttaagatcttaaaagataatatcagtggaaaaatagaaagaaccaaagtaaattctagaatgaaaaaaatataataactaagtctttaaaatgggcttaacagcagattggaaacagtgaaagaaaagattagtgaattaaaaaaaaaagatcaacagaaatatctaatctgaaaaacagagaagaaaaagaaattgagaaaagtgagtaaaggatctatgaagaaacaacaaacatatgaacacagatatacttagagtcccagaaagagaggaggtagaaaacggggcagaaaaatatttgaaaaatcagccaggtgtggtggctcatgcctgtaatcccagcactttgggaggccgaggtgggtggatcacctgaggtcaggagttcaagaccagcctggccaagatggtgaaaccccatgtctactaaaaatagaaaaattaaccaggcatggtggcacacacctgtaatcccagctactcaggaggctgaggcaggagaatcagttgaacccaggagacagaggttgcagtgaaccaagatcatgccactgccctccagccagggtgataaagaaagactgtgtctcaaaaaaaataataataaaagaaaaatatttgaaacattgtggccaaaaatttcccaaaatttggtgaaaatataattgtacagatctaagaagttcaacaaacataagcagaaagaaaaataccgaaaattatgcctagatacatcatagtaaaataattttttaaaaaagataaacagaaaatcttgaaaatgtccataggtaaactacacatgagaaaaaggggactgattaatcaaattttgacaagtcaagagaaataatagattccaggagacaatggaattacatctctcaggtgctgaaagaaaagactgtccacccaattccacatccaatgaaaatgtccctcaaaaatgaaagagaagggccggtcgcagtggatcatgcttgtaatcccagcactttgggagtccaaggccagcggatcacgaggacaggagattgagaccacggtgaaaccccgtctctactaaaaatacaaaaaaaaattagccgggcgtggtggcgggcgcccacagtccctgctactcgggaggcggaggcaggagaatggcatgaacccaggaggtggagcttgcagtgagccgagatcatgccactgcactccagcctgggcgacagagccagactccatctcagaaaagaaagaaaaaaaaaaaacgaaagagaagtaaacacattctcaaataatgaaagtgagagaatgaatcaccaaccaacacacactacaagaaatgctatagaagattcttaaggtgacaaacgaaataatagcagatggtaacttggatctgcaagaatgaataaagaccaccagaaatggtaaatatatggatatatatatataaatgggtacattttttcttctcttatttaaaggacatatgaagggttaaagtaaaaattatcacactgtattgtaaagtttacaaaataagcagaagtaatatatatgataaaatagcacaaaaattgggcaaataaaattatgcagttgcaagacatattttacatgtaatgatgtaatattaactaagcagattgtactaaaattaaggatgtatactgcaatctctagaatcaccactaaaaaatgatgtaaagtagtagaactaaaaattcaggggccaggtatggtggcttatacctattatctcagtactttgggaggccgaggtggaaggatcactggaggtcaagagttcaacaccagcctaggcaatgaagaaagactccatctctacaaaaattaaaaattaaaaaaaaatagttgggtgcagtggcgtgtacctgtagtcttagttgcttaggaggctgagacaggaggatcacttgagcccatgacttcaaggctacagtgagctatctttcattgcaccactacactccagcctgggctgggtgacagagttagactctaaagaaaaaaaaaccaatagagaattgaaatgaaatactaaaatattgtattaacacaaaagaagccacaaaaagaggagcagagaaacaaatatcagactggacaaataagaaacaaataacaaaatgatagccctatatccaaaagtatttataattatattatatgtaagttaaaatgtagagattgtcagaatgaatttaaaaaagcaagaatcaaagatatgctgtctacaagagatgcactttaattgtaaaacacaaatagtttgaaagtaaatgaatagaaagtatataccatgtaaacagaaaccataaaaaagctggaaaggctttttttaacaattaaaaaaaatacactttaagagaaagagttttaccagaaataaagatgttgtataataatataaaagggtcattaatcaggaagatactatcatgaaagtatttgtacctagtaatagaccatcaaaatataataagcccaaattgacagaactaaagggagaaatagacaagttcacaattttgagtgagactttaacatagccgtctcagtaaacaataaggtaacaaaaaatcagtaaggatttagaatatctgaaaaacattatcaaacagcttggcctaattgacgtgtatagagcactatacctaacaacttcaggacatatttgcgtgtagaacattcatcaagatagaacataagttaggacatgaaataagtctcagtaaatttcaaaaggttgaagtcttacagaatatattctcggattataattagattataagtaaatatcgaaaagaacttccagatagttagaaattaaacagtatgcttttaaatgtgttgaagaagaaatcctaagaaaaattaggaaaaaatggaactgaatgatcacaaaagtacattccttccaaaaatctaaattcccaaatagaagtttgtgagactcatctaaagcatggtttagaagacaatttagagttttaaatggctatatcaaataagataaaactttcaaatcaatgatctttctacttaaaaagctagaaaaaagaggagaaatgaaaactatagtaagtaaaagagaggaaaataaataagactaaaaaccaacaacacagaaagcagacacaatagagaaacttaacaaagtcaaagttgattctttgcaaagataaataaaatgggtttgcaaagataaataaaatgggtatattctggtgagactgaaaaaatggaggagtgggacaggagaccataagagaaagaacacacattacctatgtgaggaataagaggtaataggagaatattataatcgactttatgtcaataaatgtgacaacttaggtgaaatgaaaaattactcagaaggccacttatcacacttgatacaagataaaatagaaaatttgaataactacatctattacataagctctttcagaaaacgggaaaaataaatacgtgtcaactcattttacaaggccatcaaaatactgttatctgactttggcagcataactctaacaaagacatgaacaaaggaaattagagaccaatgttcctaatacaagcacaataatcattaacaaaatattaaccaacttattcaataatatattaaaaagatattatatcatgaccaagtggggtttcttccaggaatgcaaagttggtcaacatttgaaaattagtgtaattcaccatattaacagaataaagaaaaaaaaacacatgataatttcaatagatgcacttgtgataaaaactctcaacaaactaggaataaaaagaaacttccaggtcaggggtggtggctcatgcctgtaatcccagcactctgggaggctgaggcgggcagatcacctgaggtcgggagttcgagaccagcctgaccaacatggagaaaccctgtctctactaaaaataaaaaattagccaggcatggtggcacatgcctgtaatcccagctacaagggaggctgaggcaggggaattgcttgaacccaggaggcggaggttgcagtgagcagagatcacaccattgcactccagcctgggcaacaagagcgaaactctgtctcaaaaaaaaaaaaaaagaaaaaaaaagaaacttcctcaacctgatatacagcatcagtcaatatcacacttgacagttaaagaggcaactcctcttacgtgattggaaaccaggcaaagatgcctcttctcctttaagttctattctattctataaacttctgaaccagtttgataagtcaaaaaatggaaataaaaaccagaacaattggatagaagaaggaactgattcctatttgcagataatataattctttatatagaaaatcttaaggaatctacaaaaagttactggaactaatgtgaatttagcaacacttcaagattcaagttcaatataaaatcaattgcatttctaaatactaacagtaaacacatttttaaatcaaattaaggttattactttaacaatagctttaagacataaaatacttagaaacaaattcagcaaaagatctgtaaaacctcaatgttcaaagctacaaatactaatcagtgcaattaaataacacatatagagataccccacgtccaaatgttgctagactcaatattattaagatgtcaattttccccacaatgattttaactataatcctagcaggcattttagtacaggtgacaatctgagtctaagacttattggaaatgtaaagggcctggaatagccaaaacaatcttgaaataaaggaacaaagctggaggatttatattatttaacttcaaaacttaacataaattatgataagatgtgtaatactggcaacaggatagacacatagatcaatgaaacaaagtacgaggcataaacagaccaacacctatctggttatttcattctgaagaaaggtggcaagacaattcagtgaggaaaggaaagtgtttaataaattatgtgggaaaacgagatatctatgtggaaacaaaacaaccataacttctacctcattcatccagggacctaaatataaaagctaaaactatagatggtctttaaaaaaaaaacctaagtctacagtgaaaacctcaggtaagtgaagatttcttaaaacagaaaacaaccacagaattgttttaaaagataaattaaactttatcaaaagttaagccttctcattaaaagacactttaaaaatgaacagaaagccacagactgggagaaaatgtaatgtacatatctgacaaaagacttgtattgagaatatataaataactgcagcaattcattagtaatgacaccaatgcaagaaataaagtaaataaaatctgtaatagacacacaacaaaggaaatattatgcatgtccaataagcacatgatcaagttctttcttagtcattggaaaaatgcaaattaaatcttcagtgaaatactagcttacacccaactaaaatggctaaaattaaaagtactgaagacaccaaatattgaccaagatgtgaagcaagtggaactattatacattgctaatgggaatcaaaaacaaaaaagattcgtaatttcttataaagttaagcatatacctgctctatgacccagaaattctacttctaaatgtttaccaaagagggattaaaacacaggtccaaaaagtcatgaatgaggacattcatggtcaccgaaaactgaaaacaaccgaattgctcattaataggtgaacggataaacagattgtgatattgtacactcaaacaatgacaaactatccacaggaaagaactcttgatatatccaaaatatggatgaatctctcagatgtgctgagtaaaggaagctggatacaaagagtatgttccatgattccacttacataaatttctcaaagaggttagaaaatatgtgttgaaaatctatggtggaaaaataatctggaatggaaaaaaaagaagagtttgcctctgccaggggtgttaattaggaagaggcattagggaacgtttagggtgaaaaaaaaagccctaaattttgatagagtgttatacagaatacacatgtgtcaaaagtcatcaaattgcacacttaagatttgtgaatttcatgatatttaaatgttacctcgaagacaaagaaccgaaaacaagtatcagctctagtagatttgcttttctcagtggattagcaattccaacaggagtttttgtgtattctaggttggaacaaatgtatgaatttattgaggataatgaaagccaggtttttaattgttcacggagaaagttagaaacattgaaaagggaaaccaagctgtagattggaatcagaggtacaaatatgaaataatgctttttagtatctagatatagatttgtagatagaggtagcaatagttatggaaatacatagatgtgtatatacatgtatttagatgtgtctatgtaagtgtatgtgattcctaaatctatccactcattggacctagaagggccttcagcaaagaacacagctgctacccagatcattgtctgtaaatatctttactctaataaatggaaccttgaagaaatgctgatcccaaaactagagcaggaaaagtggaagatgaatcaggaacatcttattgtatctgtaaggataggctcaaaatatgatagccacatatcaaaaggacacgggttggcttgaagtggttcccactaatccaaactggcaaaattgcacattaatataaataatagtaatactgggttaaaatctattgagtaaagttagaatgtatgagtccatactgatatgaataaaaagaaagaaaggagggagggaagtgggttagaccgtttttgcattgctgtaaaggaatacctgaaactggataatttataaagaaaagaggtttaattggctcatggttctgcagacagtacaagaagtgtggtgctgggcggggcacggtggctcatgcctgtaatcccagcactttgggaggctgaggcgggcagatcacctgaggtcaggagttcaagaccagcctgaccaacatagtgaaatcgtgtctctaacaaaaatacgaaaattagccaggtttggtggcacatgcctgtagtctcagctacttgggaggctgaggcaagataattgcttcaacccaggaggaggaggttgcagtgacccaagatcatgccactgcactccagcctgtgcaacagagtgagactccatctcaaaaaaaaaaataaaaaaagaagtgtgatgctcgaatctgcttatgatgagggccccaggaagcttccagtcataacagaaggcaaagggggaacaggtgtctcacatggcgagaggggaagcaagagagagatgggggaggtgccacatactctcattttaattttttaaaatttatttttaaatgtttaaatgtttgatgtttgtgggtacatagtaggtgtatatatttatagggtacatgagatgttttgatacaggcatgcaatacgtaataatcacatcatggagaatgaggtatccatcccctcaagcatttatcctttgttacacaaaatctaaatactcccttttagttatttagttatatgtacaattaagttattattgactgtagtcaccctgttgtgctatcaaatagtaggtcttactcattttttctattttttttgtacccattaaccatccccaccttccctccaccgctgccctcctcccagccctaccctttccagcctctggtaaccatccttctactctctacgtccatgagttcaattgttttgagttttagatcccacacataagtaagaacacgtgatgtttgtctttctgtgcctggcttatttcacttaacataaggatctccagttccacacacttttaaacaaccaaatctcgagtgaactcagagcaagaactcattcatcaccaaggagatggcgctgagccattcatgagggatccactcctgtaatccagttgcctctcaccaggtttcacctccaacgctggagattacatttcaacacgagcgtcggaagggactaacatccaaactatatcaggagggatggcgggaggaagggaggagggagggagggaaggacagaaggaacggaaggaggaaggttgtttactacactaccagcctcaaaaggaaaaatgttaacatagattgcatagggttttgcaatcatatacactcattttaatacctataatctttattcagcattttaaattaactgtatctatttcctatttatgccagctgaagaacatgtggctttgaattatttcaaatgcaaatttttttccccattttatcattttgttggctgtattggttttctatggctgttgtaacaaaataccacagatttagtgtcttaaaacaacgcaaatttattctgtcaccatgctggaggtcagaggctaacatgagtcttaaagggctggaatcaagctattagcaggactggttccatcgagaggttccaggagagaattctttctttccctttcccattccctctctccaatatgtctttggctttgccttctgctctaacagagtccaatttgtccctctgtttctttctttgaagaaaacctgtgattatatttaggacccatggggctaattcagtataatcttctcatccccaagtctttaacttcgtcacacctgtgacattcctttgccgtataagggcacactcatgggttctgggcattagaacatggacattttaagaggccattattaagcccaccacattgattattctaactatttagtctctgtccaccagaccactgaaatgaaatatttgtcattataataatttatatttttattattttactcttaaggtgaatttacaatactttatttcagatgaattagaatatttaaaaatatgaagactaaacttatacttaataagtaattagacatactttttttttttgagacagggtcttgctctgtctcccaggctagagtgcagtggttcaatcactactcactgcagcctctaccttttgggcttgaacaattctcctacctcagcctcctgagaaactgggacgacaggtgcatgccaccatgaccagctaatttttttttatttttcctgcagatgcagtctcgctatattgcacaggttggtcttgaactcctgggctcaagcgatcctcccgcatcagcctcccaaagtgctgggattacaggcatgagccactgaatatactatttatatatcatttataaataaatatataatatattaataataaatctgaacttcataagactattcaatctgaagttttttccgttagtttagttctctttatacttaagattctagccaaagagtaactatgaaaagtaataaacaagaatcagagttggaagatagtgtatcctattctagttgcttagtcattcattgaacaaatacttacttggtcccaagtgctattatagatactgtccagcaaagaagagtgtacttccatttgctcttctctgttatggcagattgtttttgccaagatggttataacaacacctcccgttctacctgctcatcttatcatgcaagttgtcactcttcactttgagagatggggactatattccctttcttcgaatccagacaggcctgtgatatagcagtttagccatgcgacttctaaggttaggtcctacaagttaacacagattctgcctggctctcttaggacgatcagtcttggaacccaactcccacactgtgaggagactgaggccacatggagaggtgactgtgttccatcacgtgggtgtcccaggcaaaagttcagtagcatcaactcaccagccagatatgtgactatggaagctttagagaataactccattatttcagttgaaccccaaaatcatgagaaatagtaatacaataatatagtttttcctaagctgctacgttttggagtgatttgttatatggtgacagataccctgaatatctcttacctactcattttatgaacatacacgaaacttacatttcataatataatatataaaattgagaatgagctcacttcctacctattttattaaactaaatgataccatgtatatgtcattctttcaatgtcaatgaaaaaataacaaattaaattcaaagtgctttctatgtgccttttagattgttattgaggagataaatggatataaaaaatcattcaagccggtcacggtggctcacgcctgtaatcccagcactttgggaggccgaggcgggcagatcatgaggtcaggagttcgagaccagcctgaccaacatggtgaaaccctgtctctactaaaaatacaaaaaattagctgggcgtggtggcgggcacctgtagtcccagctactcgggaggctgaggcagaatggcgtgaacccgggaggcagagcttgcagtgagccgagatcgtgctactgcactccagcctgggcaacagagtgagactctgtcgcaaataaataaataaataaataaataaataaataaataaataaatcattcaagcaagaatttcaagaaaaaatggaagcttcatgacttgctggggcaaaatcactattgcctttgtttttttcctttctgtctcatttttaagccatctgactttcaaaattaccctgcaaactctggtgctcttctaactttcctctcttcatgtgtgtcaccatcatccatgcagttactgaagccagaggttttagaagttgtccttgacctctctgtctttcacatccatatccaatctatcactaagtcctgaccagttcttcccaaagaacttcggaagttttctgctttccatctcccctgacatgatctcaattcaacagaaacctatcaattgttctccccaaatttctagtccccaccaatcctttgcatcagaatgcaaatctggtcatgtcactgccctgctttcctttttttgagacagagtctcactctatcacccaggctagagtgcagtggcatgatctcggctcaccgcaatctctctctcccaggttcaagcgattcttgggcctcccaagtagctgggactacaggcgtgtgccaccatgcccagctactttttgcatttctagtagagatggggtttgccatgttgggtaggctggtctcgaactcctgacctcaagtgatccgcctgcctttgcctcccaaaatgctgggattacagtcaagagccactgcgcccggccctgcttcatttcgatggcttctcaacgctctcagagaaggagatcaaatcctaaatgtggtccacgaggctttggatcgttggactcctttctccctctccaggttcttcgtggcagcttcttgccttgtattctagccataatggccttttgtcatttccctgtgtcttcctaccttggagtctccttgactaagatccctatgcctgaaatcttcttacgtcattttctttgttaatatggttctcatttaactgtccaagcctcccttaaaagattatttcatcaaaggattcttccctaaccccagcctaagtcaaattctctgcatttttacatctactgtactgtgtcactaaaaaatataacaggaacaaaaaaccaattcataagatttcatatttttttccaccaccacaatcactaaagaaaactctcgccaggaggtagcttcatttgcattgaggatagaacagatggaagaagaggaaaagataggagtaagaggtcaaagagctaagaacttctcgggccaacggtcaggaagaacttaggaaaattcatttttatcagtgagtaactggaaagagaaacactgagaatgtaagacacaggaaaagatgttaaagcttttctgttttgcaataagatggactctcttgggtattttctgaagagttgcaataaagtttttttctgctggactgaccaagagaggggctgctttatatagtttatgcatattgaatattaatttaacaacgctgtcctcctctcacctccacttacatacaaactttatgtggtcaatgtcttgttttgcttgtcattgcaaccttggtgtttacacaattagtagtgggggctgaatcaatattgattgaattaatgtgtgatttagggcaatttgcttaacctctccagacttcaatatttaccccctcctcccacctccagaagcctgggatagcctgaaacagctaattacagttctgatatttctctggagtttctttgaagtttcatgttttgtctaaaaaacttgttttatgattcattttacaactttaatgttaatattccataccattatatgtcagtatttatttaaaattaaaataattttatctcatgtcttctaacaaaaggaatggcattgtacctattacctccagtgctatacagacttcaaaccagtttgacaaactcaaggattcattaaataatcacaaaggctctctttgagccaaaagttttatgactcttggcttctaacaagtcgaacagctaatatttactgaattccttttatgttcaagtcacaggggagaatacaaggaacaatgagatgaactgccttggagatgcagttatgatgacaagtcatgcatatgtacaaaggtaatattgtgaggcagtacagactgccaagtgagtagagcagcttgttaatgcagaagaatccaggatgactgagccctctaggcctcaatttcctcacctgaaacatgggtaaccatgcttatgcttttatatcacaggatggctatagaggtcaataagatgaaatgtacctacatacaaattagaaagcatcttattctcggagggtttcgatcacatggcaaaaccttgagatggagtaggaaacaagttgatagacgagcatagcagaacggccttcatgaagacacagaaaaagaaatataccacaaagatacaggaaactaaaaatgacaatctttatggggtggaaagctcaatcaagtgagatagctctgaaaaagcaggatattgtgggccttgaattctaagttaggaaatttagaatcactactgtagatgtcattttcaaaagataaatcccttggtacataatttggttcatattttgagacagctgggaacatttggcacagacaaaagggctattttaaatgctttgactcctttaaagaatattaaagggacacgtgaagaaatcagataattgcttgcagggatcaagtgtcaggatggtaatattgctaaaagaggaaagaagagaacatggttgtttttttgagttaaaaatgaactggcattatgccagatgtgggcaaacagaatagaagtaaatttgaaaggagtttcaatataactcttgatgcttggaggcaaaaagcaaatggccttcagcgtaatttggaataaattctagcattattggatgaacaacacatggcttaaattttaatccaaaagctcaaccagctctctaagatgaaagtgtggcattggtagaagaatgagtttttggaaaataatatagaggaaatagtacctggtgttggtgataactctatatattcaattgtttaaatgagatttttgaaagtcaactaaaaagaaaatacattgttagtatacagtattagcatttgtttaatggaagaacgtaagtgcaaaacaaatctttattttaagaagtttccagaaagcacatctcttttgcaaaatgtggaaaagcccaccagtgttgaaaccatatacctttgagtgctcttaaagatggctgcatttgaacactgcatattgtgctataatttgtgtagaaaagaaagaatacatctacttgttactatgttaataaaataaccctggaaatatacaaaactaacctatcatcttggtttgccactaggacataggagtgaaagggagaaatttcttaggttttttttttttcgtttttgagacagagtcttgctctgtcacccaggctgaagggcagtggtgcgatgctggctcactgcaacctcttcctcccgggttcaagcgattctcatgtctcaacctcccgagtagctgggattataggcgcctgccaccacgcccagctaatttctatatttttgtagagacagggtttcaccgtgttggccaggctgatcttgaactcctgaccacaagtgatctgcccgcctcggcctctcaaagtgctgggattacaggagtgagccgccccgcctggccgagaaatttctttgtatatcattttggatttttaaagtttgaatcgtatattttgtagtccaataaacagataaacaaatcaaatgacctcaaataaaatgattatctttgatatggtttctagagtttgaagttcactttattaataaataagtcaacttaccctacgtactcagatgggtaagatgataatcctttttctccagcacattctttccaagcttctttagtgtgcatcagaatcacctggggactgttcaaaacagattgcttggcctcatcccccagattctctgactcagactggctggggcaagtcccaggaattctcatttcaacaagttcccaggtgctgctgctgctggttgtctggggaccaaaatttgagaaccacgtttttgtgttgttgttgttgtttgtttttttgagagagtcttcttgctctgttgaccaggctggagtgcagtggcatgacctcggctcactgcaacctctgcctcccaggttcaagcaatcctcctgcctcagcgcccctcgtaggtgggattacaggcatgtgccactatgcgcagctaatttttgtatttttggtagagaaggggatttgccgtgttggccaggctggtcttgaactcaagacctcaggtgatccactcacctcagcctcccaaagtgctgggattacatgcatgagccaccgtgcccggccaagaaccactgttctagcagtaacatcagcaatgagtcactggtgctgtaaaacgcttcacattccatagcagaaataaaaatgtatatgaattagaagtctgctgggtgcggtggctcatgcctgtaatcccagcactttgggaggccgaggtgggcggatcacctgagatcaggagtttgagaccagcctggccaacatggtgaaaccccgtctttactaaaaatacaaaaattagccaggcgtggtggtgggcgcctgtaatcccagcttctcgggaagctgaggcacaagaatcgcttgaaccagggaggcggaggttgcagtgagccaagatcacgccactgcactccagcctggacaacaagagtgaaactccacctaaaaaaataaaaaaagtcaccaggctctagagaacgtaagcaaaacttcaaaactttataaatctaaaatgtaacccgttttgaaggtagcatctctagataaattgctttaaaaagtcttctctgtgatcggtaaatcaatgccatgcccagcactctactgttatgattactctaatgacatagaagatacccctctgccatcaaggagctttgaatctagtttaaaccaatgagtccccttttgagacatgatccatttaaatgtttgttttaatactgaattacatagaaggtgtaactcaagaagtttcgtgaaaagttttagtatctcttgtatttatttctcattaacttttacccaaattcagacctgtcaatgctggtgaagagtaaataatttgcaatttgcacatggtgaattgaaagcccatgaaaatacagatgtgggccgggcgcagtggctcacacctgcaatcccagcactttgggagaccaaggcgggtggatcgcttgaacccaggagtttgagaccagcccgggcaacatggcaaaaccctatctctactaaaaatacaaaaattagccaggtgggtgcgcctgtagttccagctacttgggaggctgaggtggagggatcacttgagcccaggaggtcaaggctgcagtcagctgtgattgtgccactacactccagcctgggtgacttgtctcaaaaataacaaaacaaaacaaaaaatagatgtgggttgaaggacaagttctactgctaatgttatgtaagcttaacttttcttatactgtttcttcatctaaaactgagtataattttaactataccaaatgtgatactctatgacaataataataaaatctaacatttattgaacatttactaataatttacatgcattaattcattcactcttcccaacaaccctataagataggtactattattatcattttccagataagaaaacagaagctcagagaggtttaagaaacatgtccaaggttagttggccagtaagtaatagagccaggattcgaatactggtcccttccgtaatcaccatgcttgctgcttttcttaaaagttggagatgaaggtagaccttttttcacctcaaacaccttagctatctttagtgggtcatataaaggggcctttgtacttttaaaaacatattgccctggtaagtttctataaatgtggagaaaacacatgtacttacctgattgtatgatatggttttttgtgtgcgcacaaggtagtgctctgtgagaccattgcatataagtctgttaagttcaggtaatatcttggctgggcgcggtggctcaagcctgtaatcccagcactttgggaggctgaagtgggtggatcatctgaggtcaggagtttgagaccagcctggccaacatagtgaaaccccttctctactaaaaatacaaaaagtagctgggcatggtggtgggcacctgtaatcccagctacttgggaggctgaggcagaagaatcggttgagactgtgtctcaaaaaaataaataaataaataaataaaaccaaaaatcaataccaaaatgcctatcaatcccaacactttgggagtccaaggcaggagaatcacttgaaccctggagttcacaatcagcctgggcaatatagtgagaacccatctctacaaaaaacaaaaaagttagctgggtgtgagtgtgatggcacatacctgtagtcccagttactaggaaggctgaggtgggaggattgcttgagcccaaaaattcaacgctgcaatgaaccgtgatcgcatcactgcagtccagtctgggcaacagagtgaaactccgattcaacgaaacaaaacaccaagaggaactctggaaaatatgtaaatatatggaaattaaccaacatgctcctgaatgaccactgggtcaacaaagaaattaaggtgggaataaaaaaaatttctagaaacaaataatggaaagaacatatcaaaacctataggattcagcaaaaatagtgctaagaggaaagtttatatcaataaatgcctatgtcaaaaaagtggaaatgttacaaattagcaatccagcaatgcacctagaagagctgaaaaagcaagaacaaaccaaacccaaaattagtagaagaaaatagataaataaagatcagagcagaactaaatgaaatagagaaaaaaatcaacaaaaaggactggtgaaaggaaaaattggttctttgaaacgataaacaaaatcgataaaagtagactttattttttagggcagttttaagtttacaacaaaattaagcagaaagtacagagagttacgatatgtctcccaccttcacgcgtacataatctctcccataatcaacattccaccctcaagtggtacatttgttaacaatcaatgaatctatgttgacacatcattatcacccaaagcccatatttaggattcactctcgatatggtatattgtataagttttgacaaatgcatagtgacatatatcctccattgtagtatacagaataatttcactgccctaaaaatccttgggctctgcctattcaccccctctccccacataacccagtaatattttttctttttcttttttttttttttttagagaaagtctcactctgtcattcagggtggcgtgcagtggcacaatctcagctcactgcaacctccgcatccagagcaagagattctcatgcctcagcctcctgagcagctggaattactggtgcccgccatgacacctggctaatttttgtattttttagtacagacagatggggtttcaccatgttggtcaagttggtctcgaactcctgacctcaggtgatctgcccaccttggcctctcaaagtggtgggattacaggcatgagccattgctcttggccataaccaagtaatttttaatatgtttttcttatacaaataatatatagggaggaagaaatattttcatctaaataatatagtatggttaagaatgtttgcttagtatagacatgaaactaattatcaagaatgtcagacaagtctatcaagcagtataacttcagaatgataggataagccttcatgtgtcttgtacttaattcgtcctcttctatgcttaggtaaagatttcttaaactgctgtttaaaaacactaaccacaaaaacaaaactaataaatacgcaagaactacccatcaaaagagaatgagaaggcaagccacagccacggagaatatatttgcagagcttatatccgtatataaaggaaacctacaaacccttagaaaaagacaaacaactgaattttaagatgggccaaaagactcgaatagatccttcccaaaagaagttacccaatgggcgtaatggaatgagtatatgaaaaagtgctcagtctcttagttatcagggaaatgcctattattgagatgccatgatgtacccatcaagatgatgagttaaaaacaaaacaaaacaaaacaaaaagcctgaaaatacacactgttggaaacaatgtggagcgactagaagtctcatacgttgctggtgggggtataagttggaaagataactttgaaaaatagttttgcaggattaaactaaagctaaacatctgtatacctcacacaaggtacatatagaagagaagcaaatgctttcgtccaccaaaaggaatatgcaagaatgttccaagaatgttcatcgcaactatattcatcataaaccaaacctgaaaacagcccaaaagctcaacaatagtagaattggtaaatgagttcgggtatattcatacaatggattctactacaagcaacaggaagaaacaaacaattgttgcatgttagaaaatgtgtgaatctcactgaaaaatgtttagcaaaagaggccaggcacaaaagtacctactcgtgtgtgtgcgtgcgtgtgtgtgtgggtgtgtgtgtgtgtgtgtgtgtaaagttcaaatacaggcaaaatgatggtgatgaaatttagaatagtataacagtaattgcttcaaagttcaaggacagggaacagtaacggggaagagatgtgacagagcctttgggatgctggaatgttctatatcttgatttaagtagttctgcaccaatgaatacacatgaaaattcatcgggttaagattcacgcactttacacctgaataaaaaagaaaacaaagtcattctgtttaatataataaaatacgtatttccacgctaaatattacgtttacagctttgaaagattaaaagactgaaaaagtactgagtattaatctaggcagaagggtctgactgcctttgctaaatatggaattggcttggtaaaattacactttacccatgcagtggtgtgcaatgattccatcagtgggacacttggaggaaaatattattgaataactttcacccagtgaatatgctttttgttaagagacgcttgcttctaattgctttaaatttgtgagtcagaaattggaggaagagggggtggaaccattccccacccttctccccttggcacccctactgaccacagatctttcgctttgattcttattagaggttttctgtccaattttatggttttccgcgttctaaaacacacattgtataaataaatgacacatgcttagggcttgcagatgcctttagatgtttctcaaacttccctgtgggccagttctccaccttcctggtgtttgggcttgaattcacagtcaatagttggaattttactttggactttcatttgtctattgtcccagtggctctaggtaggatttgattaggattagcccataggatttcagtaaacgaattttagaaattgttggaaatgtcacatccaccaaaataaattttgtatgatgtccctaatgcatgttaataatccgttggtatatcatatgctgcattctgtaaaacttaactggaacatatcaaatataattggtaaaggtagaattcagtcagctcctaccttcaagttcaaggatacatcctgctggctaggcagaaaagagaggctgaaatttctgcatagcagcttgacttaaggtttctgcaaagacagcacactagaaatgataacgaatgtttgcaagctctttcttcacttaccactgactacaccagattaggaggagtaaaatatctaggatctggagaagatggagccttatgttatcttgatgtacagtatcagatgcagattagggctaagggcttacgtggtgaaacgtcattctgagattgtaaatattctcccactgctcacccagccatgtgcaggacgtaatagtttctaattgctctgagtctgtgggctcctgagtcctcattcatccatccgagctggggttttggtacagagacaatgatgataagaagtactttcttctctttgtccctgcagacggttgcaaaatgaatcttttcaggattttatcatcggggtgtcaggtcagatccatgaggcaggaatgtcaagttggctaaaggacattctaaagtgaatttattaaaatgattctaagagagaattaaaattgtgctaagaaatttttttttactgggtttacacaaaaccttcatgttggtagtcatttacctgtctttgaaaagtagaatttcgagaattgaaattgctagtgtgtgattccttagtcaattttctttacaattgccttgatttctttcctccatgactcatttctttctcttcagcttagagatactttgtaaagtgtgattaggtgttaagtgtgcggattctagagccaaggtaaccgaattcaaatcccagcctactagctgcatgatcttaggcattattacttaacctctatctgactgtttcttcatccgtcacaaggtgggggtgattattataaaacctagtcacggggtcactggtaggatgaatgagtaagtagagataaagctcctagcacagtgtctggcacgcagtaaacactgcattaaggatcaactttatctctgttcttgttgagggactcccctgtatctttcactgcatggcttggctcttcctgatgctctttctttcccagtcttaactccatggtttgctctacatcagcgtgccaactttgtttatttcttggtatagtttattcaaaagttttgaatcctaaaatctgggtggtggagaaggaggagattattattgaccttcattacatgcctccaaagaccttggtgtagtacgttaagactgtcacttgccaagtgactcattcattacccaatactgtcacgcactagtcataagacaattggaagggacagatgaaaagaacagccatctactttaattgctatgttttggaaataatgtataatattaaaaccacaactccaaatcataaagcctaaggtttggaagagaccgaaaatcactcagcctaaccacccaagtgatgcttgtgtgtatttgcaatattctgtatggaaggttcagcctcagttaagtatggtgatactcttatcaactcaagaagcagtttatcttttagatggctcggattctttggaggatctttctaactttagtcaaaattaatatactcacagtttccatctattatgtattttcttttattaatttactcttgaagtcttatggaataaatgttatgcatctttccattaaaagccctccagatatttgctgactgctagcatgtttcttctggagtcctctctggatattccagtcgagctaaatattactcatcttctccaatgtggatggtctgttctgaatgagctatgatttcttaatatccttttaatgctggtcccaaattgaacccaatactccatatatagttgggtaagctcaaagtagttactacctgtgtctactattctagcttctagatggttatacttctattagtgaactccaagatcatattagcttatttttggtagctacgtcatatttgtgaaaaatattgtattaattttgtccaaatgactttttccgtgccctaagacagacctaaccagcagcttattctttggagtttccacagcattttgtatggattgctattgtaaaacaaaaccaaaaaatttatctacagttatacactgcatcagaacatcttggtcaatggtggaccgcatagacaatggtggtcccataagattataatactatatttttactgtactctttctatgtttggatatatttagattcacaaatacttatcattgtgttacaatttcctgcagtattccgtacagtaaatgttatacaggtttgtagccatctagatttgtgtaagtatactctacgatgttcacacaacagcaaaatcacctaaagatgcatttcctagaatgtatccctgttgttaagtgatacatgactgtatattataatattgtgtttctattctaactattttattgtgttcttgcatttgactatgaactctgcataggtaaatttttcattattttgttgtagtggctaataacccatctgttactcaaaatatgtttgtcaaataaatgttgaactaatcccttgatagagcattttaaggtaactagttaacaaagaccactgcaccataatgtcatatgaaaattttgatatcagaggcccacagagattgatagccccatctccttttctagagtcctacttatacctaaaccatccagctaaaggtttgtagaactgaggtctaatggacttcaggaaaggggattattaaacccagtagcttagtcaagtgcatgccctatgtacgcctctaactatacaaccattggaagtattatgcaagagtgtggctagatcactttgcagtcagcactcaccatggcaaagcaatcagctttagaagacagaggccatgtgcgagcctgttccaaggaaacctgatcctggaaacttgcagtgaattcggctgccttggcagtgacatctcatctggcagcctggaacaggaaaacttatttagagaacaaacatgccttttaggagctcgcagtgagtccgatcttaaactgaaaactaggggcctaggagattatggttctgtttatgttgtttgtgttttacatatgctgcgtatcctcccttaagtggtctttggttaatacatattcctggctaacagttgctgtattgaacacagaggaacagacacacctctagaccttcattcttctggattttgcaaacccgatagtcaatttccagctcagctttgatagtaatatttccaaatgataaggaacaggaaatgtcgcaacaagttctcctgacaatgaggtcctgtgtgcctaggttttgtagaacatactgaaaaagtaggtggccatgtctttgatatgctttccaaggtgcatccaactacagtctccttcctttctgcccagtaattcccatcagtgaacttaggcccaaaatcaataaagctgttttttataaactattattaaagggcatttccactacctgagaaggaagggaagacgttctagctcacccttattagcaccgtaggaggcactcgtgaatcaatacctgaaaatgtacaagtcccagacaatcagtgctcagagcgagagcgggcagtggctgaacttggccccaggcccacctatgaagcctcccgaagacactgaacagcctgatgcagagaatgccaagtactggaggggcggatgcaaaggttccagaccaagctcaagggtgttccagtgcgctggccagcatcttagggaggaaggggtaaaggaaggaaaagaagcctagattcacctacaatttgatctgtgaggagtgttgtttatgagcggcatcctttgcaaatatagctttggagggaaaacaaatgcatgctataaatttccagtaacatcctgcctgaggtagactcagtcactctgtaagaccccactgtgcagacagggaaaagagacataactgcagctgattctgcaaacagtggccacagtgtcctaccaagatgacagaacagaggtcacagccaccctctaaagggcctcgggtctggcacccaccccctcgccaccgccttcttgccaaactcataaacacccaagctggaaaaagctgacaatgtatcttcctctcccacccctgttggaactttcttggatgaaccacttcataaactttccccctcatgcagaggaagacttcttatattttttttctcttactttaggaaatttgaacaaaatatttttttcaggtaaaatatacaaatatttatttttaaatatttgcatgtcaaaatacactcaggcccagaaagtactcttaatgggagactcatcagatcttggtattgaaggctctgtgttttggcaggttttatttatggttatagaaaaaaaaaaggagtaactgaaaatgaaaatggttgaatagactgccccacaatttaccaatttctttcttttattttctttttgctctgggcctgagaccagcatggaaaagttttagcttctaaatagactctttcaggaagatttgtatgctgatgaagatggtgtaaagaaaagtagtgtaccaccctaacttgagcttttttttttgagacagagtctcactctgttgctcaggctggagtgcagttgtgctttcttggctcactgcaacctccacctcttgggttcaagcgattcttttgcctcagactcctgagtaactgggattacaggcacccaccaccatgcccggctaatttttgtagttttagttgagatggggtttcatcatgttggccaggctggtctcgaactcctgacctcaagtgatccgcccacctgggcctctcaaagtgctgggattacaggcatgagccgctgcgcccaggcacttgtgctttgattaacattattttcctgtgaaacaaattaaagtgatcaatgagctccagggattcatttttaattaaatcatgaagcagctggcattcatggcctcttggcaggtagtccagcctgggcttgctgactggaggaatgagagtggggaacttaccagctgtctaagcgtcttggttccaggtaaatgatacttatcaggctgttgaagaatttagggagcacacctgatagataaatctgcacacagctttattgaattactcttttcttgctctgtttcagaaaactgtatgagaatataaatccaaacttttcacataaacttttatcgcttttaggtttgttcagaaagattgtccttgaactgaaatgaacacatcaaaactgctcagcttctctgaatgggaagtattgagaaatgatctttaaactttgcggtgaatcagatttatttatggaactttttaaaaatgaagcagcccaggcttaaaacttggtatgaaaaccagccttgagagtaaaatacccagttcctccaaactcctagttcctctgcgttacttatcctaccgcgtggtgactcacatacaaacaatatacagatgttctttgaacctggatttcaaaagatccgtattcagaaagaattctcaatcacattcaccatattcctaatagactccaaaagttctcagagttttctttttcccaatcctgctgatctctgagtcaacatggagcgcccttgttaaaattttattttaatttggcattgctttattttgcgtaatcattgtctaagtaaaagtctatctgcttctgacttttcagaaagagataattttatagaaagtgttatttatttcctatctgttcaacatgagtaaatgtatgaggacattaagattctttcgaacacaattattagcatattacacaagttgaaagggattggtgattttccaccccaaagcgacttcctgtagtttcaaatgtaactttcctgtaactagggaagcatgagctatttttaagctttctttttttttttaaatagtgattaaaaagctagtattctctataaaggattttctttgaagagcatgtgattcctaagaatctcaattagttggtcaccagaaaggacagggaaggctttatagctagcagacttttctaaggtttcattttacaattcaggagctctgtgttctaataccactcaactgtcaagagatgctgtaggtggaataaagcagggaaataaaagagatgaaacagctggcatatgttagccagctttaagagctccaaaattacccggtattctagaaaattatgacgtgcgtgatcattctctctgggagagaagctgctgcagaaagcaaacagtgacgtagtatgcaacaaaggggcatctgtgtggcaccctgaagaaaaatatcaaattacccccacatctagacagtctgggtaaggttatcatcttctaataaacgtaaaattctagttcttctaagatatgctcctggccccattccaattactgtatgaccttggagaaatgtcttttgaagtgtttctgtgtctgtaaaacctggataataatactgtctgtcccagatggttggaattgtatgaattaattagttcaagctggaaaggtctttgataatgttaagtgctgaatattgttattattatagatacaggtggaggcagtgctgcacagcacatctataattagaaaggcctagaaactgaaagtcgtgccaacaccgcgggagttaaggagacaataccttgtgtcattttctcccgagactcagtcagcttgctatgatggaatacttaattcgctcttatcctcttcgaaaggttgaagcttgtcttggacttgccaaccaagcaacatagtttttaccgggtgtatgtgctttttcaggcagtgttttgaatgaagtgctgacatttattagaacacaggatacagtcttgggtttacaacgcttgttaattgttctgagtcaagagaccaagaaattccattaccagaaacacctgtcatctgaaaaaaatgcagattttttttttttttttttttttttttttttttttttttggagacagggtctcactctcttgcccaggctgacatgtggtggaacaatcatagctcgctgcagcctcaaactcctgggctcaagtgatcctccttcttcggcctctcaagtactctcaggactacagatgcacaccaccatatccagctaattttttttttattgtttttgtagaaatggggttcttgctttgttggccaggctggcatcaaactccttgcctcaagctgtcctccttccctggcctcacaaaagcactgggcttacaggtgtgagccaccacacctggccagaaatgttcttgagctataaaatgaagaagagatctaaccttcttttagagattaaaaggctttcttttttcataaacaaactgcaaagtgttatgtggaatcaaaatacataaaacaggctgggcgcggtggctcacacctgtaattgcagcactttgggtggatcacctgaggtcaggagttcgagaccaggctgaccaatacggtgaaaccctgtctctcctaaaattacaaaaattacacaggcgtggtggcgtgcgcctgtagccccatctacttgggagactgagacaggagaattgcttgaacccgggagctggaggttgcagtgagctgagatcacggcactgcactccagcttggggaacagagcaagactctatctcaaataaacaacaacaacaaaacaagaacaacgtaacataggttaaaaactgagctgtgctgaataaaaggaaaaagggaaagattttccttgagtttgtaataaccctgaggaatgttgtcagaatctaaggctcccctgagcccactggaccataccatgtctaaaccaatttttaatacctcattttttgagtattctaaataccagcaacattaaaaacctgcactgctgggctcttctggaagatatagtttatgcagactgacaatttatttcatatgctatctcctctggaaaaccttctctgaccatctcgtctcgtcttacaagttcaactattggtgaaagtcacacagcactccaatttaccatttcaaattcctttgttatcttcttctctatcatcatcatagcaaatatttatgaaatacttatgtgccaagcatggtattatctcatttaatcctctcaacactaccatgggatagttataatattattcatattttagagatgagaatattcaacacagagatgtaaaagaattgaccacctaggaaatggtgaagacaaaaggtaaaccccaaagagcttgactcaaatcttcttgggcaatagcaaaacccaagatcatcttgtttatcactcagtatagagtaactgcctatgtgtttacttgtctttctccaaaaccagacctgtcggtttcttgagaggaggaactctgttatgctcacggctacatcactgtgacctcacacagcacctaacacacagtagttcttctttttttccccatagggtttgggggaacaggtggtgtttggttacatgagtaagctctttagttgtgatttgtgagattttggtgcacccatcacccaagcaatatacactatatccgatgtgtagtcttttatccctcattcccccttctaccctttttctcaagtccccaaagtccattgtatcattcttaacgcctttgcatcctcataccttagctcccagttatgagtgagaacatactatgtttggttttccattcctgagttatttcacttagactaatggtctccatttccatccaggttgctgcaaatgccgttatttcattccttttttttttttttttttttttttgagacggagtcttgctctgtcacccacgctggagtgcagtggcatgatctcggctcactgcaagctccgcttcccgggttcacaccattctcctgcctcagcctcccgagtagctgggactacaggggcccgccaccacgcccgggtaatttttttatttttagtagagacagggtttcactgttagccaggatggcctcgatctcctgacctcatgatccgcctgcctcggcctcccaaagtgctgggattacaggcgtgagccaccacgcccggcctatttcattcctttttatggctgaatagtattccatggtatatgtatatatatatatatatatatatatatatatatataccacaatttctttatccactcattgatagcaatcacactcctgggattgatagtagctgtgtggattaatactgggtatctgcccagaggaaaagaagtcatcatatgaaaacaatacttgcacacagagtagttcttaataattgttaaattatcaaactggcagcatgtttccttcaaaggataaaacaatttgcctatggttattcaaaagagtaaaatattaaataaattagagttatggttgaatacagtttaaaatgatgaaaaaatttgaaaagtaatttctaaaagaaaacactaatctttgaacatttgggatgaggctactttggtggccaagcctaaattcttattccgcccaagaaagtcaaattgacacaacatttgggaaaggtattcagcaattccacttctgcaagtttatcttataaataattcagaaaacaaaataaataaaattattgtgtagaaatatatttattacaacattgttataacaaataattggaaatagcctaaatatttaaaaaataattaaaagatttttgaatggtcaacaatcagaagaagaaccttatgataattttttttttttttttttgagacagagtctcgctttgtcgcccaggctggagtgcagtggcgcgatctcagctcactgtaagctccgcctcccgggttcacaccctttatgataatattttatagaaacttcaaaattatgtatgaaaatatattttaataacttgtagatatagttaaatcacagtactgcattaagtaaaagaaggaaaatacaatcctacattacataggattaaatgtatttaatgtacgtattaaatgcatttccctaactattgttagcaaagcaaaagaaaaaaaccgaagaataatctccaaagggtaacatgggttagctctggttgatgagtagtttttgctttcccccccttaaacatttctgcattttaaatttttctacaagaacatgtcgtgatcagatgaaaaataaactgtggttttttttaagtgttattaaagagcagccatctggtatcacaagatcagttaggttagatttaggaaactcatatgaaattaaaaaaaacctttagaggagcaaacttggttgtttaattcctagaggcaaattgcatgccactgtgtgtcacatagtgtatcacgtacacacagtcagttccccaagtatcaggagttaagaagatgcatttattgaaataagaattgatatgatgtccatgttactcttattttattctacaattgtttctgctaatattggaagtttttggctgggcgtggtggctcacacctgttatcccagcactttgggagtccaaggtgggcagatcacttgaggtcaagagttcaagaccagcctggccaacatggtgaaaccccatctctactaaaaatacaaaaaattagccaggcggggtggcatgtgcctgtagtcccagctactcaggaggctgagacaggagaattgcctgaacccaggaggcggaggttgcaatgagctgagatcataccactgcactgcagcctggacaacagagcaagactctgtctcaaaaaacaaacaaaaaatttttgaatttgggtggtgaggtaaatatctgggctcgtgaacatattaaatgcataattgttgcttataatttcatttatctctcttcagtcagattaaatatgacctactatgttgccagacacagtgctagatgctttttcactgtatctcataattcaactcacataacaactttttccagccagttttaatgtccacacttgacagatgaggaaactaactttcagagaagtgatcattccaaattcaagttgtttgttgggctatgaatgctgatcttcagcacctgagaaactttcgatagtatcagaagtagaccatttatcctattagaaaactaaaaagcaacaaacatatttatttaaaaaatttacaaatgataaaaaattaataataaaaacaattctcatttttaaagttggaatagtctctagggcttagtaactggaaaaacaataactgaatctccatccaaaattatgttctcatagccagatgtgatgccacacacctgtagtcccagctactcaggaggctgaggtgggaggatcactgaaccccaggactttgaggctgcggtgagctatgattgtaccactggcgctccaacctgggcaacaaaacaagaccctgtctctaaataaataaataaataagtaaataaaattattgtttcctatctgttttttatttctatcatatcagttccttctatagagtttgatgattggcacatactgtaatgtgtgagcaaatcgcatagtcttatggcacaaggcgtgcccaacatagaattcttctagactgtattcaaacctacataaaaagaaatgaatacaaacaagccatgcatgcacaaccagaaacatataatttcactaatccatagccactaggacttgtcaaaaccaagctggtctatgtgtgaatgtgtgtgtgtgtctgcaaattttaaggaacatgtgtatgatgaggttagaagccaccattcaaaaatctcttttgaaagacatacgcagctgggcgtggtgactcacgcttgtagtcccagcactttggcaggctggggtgggtggatcacgaggtcaggagatcgagaccatggtgaaaccctgtctctactaaaaatattttttaaaaaaattagccgggcttggtggtgggcgcctgtagtcccagctactgggagaggctgaggcggaagaatggcataaacccgggaggcggagcttgcagtgagctgagagcacgccactgcactccagcctgggtgacagagcgagactccgtcttaaaaaaaaaaaaaaaaaagaaagaaagacatacatgcagccaacaaatatatgaacaaatcctcaacatcactaatcatcagagaaatgcaaatcaaaaccacaatgagatatcatctgacattagtcaggatgactattgttaaaaagatttaaaaaaacagatgttcattatatcgaaaagataattacatacgtatggttatcacagcacaatgcatagttgcaaagatatggaaccaagctaagtgcccatcaattgatgagtagataaagaaaatgtggcatatatacactgtggaatactactcacactacctggccataaaaaagaaagaagtaatatcttttatggcaacttggatggagctggaggctagtattccaagtgaagtaactcgggaatggaaaaccaaataccatatactcttggttataagtaggagctaagctataggtaggcaaagggacatagggtggtataatggcccttggagactcagaagtggggagagtgaaaggggattgagggatattggacacaacgtacactactcaggtgatggccgcactaaaactcagaattcagcactatgcaattcatccgtgcaaccaaaaaccacttgtaccccaaaagctattgcattgtgtatatatatatacgtatatatatgtacatatatatacgtatatatatacgtatatatatatatatacgtatatatatatacgtatatatatacatatatatacgtgtatatatatacgtatatatatgtatatatatacgtatatatatatacgtatatatatatagtgtgtgtgtgtgtgtgtgtatgtatatatctaaaacacaacggatgttgatgaggctgtggagaaaagggagcacttatacaattttggtaggaatataaattagttaatccactgtggataacagtaagaagtttggatatttatttcttttccctttttttttttttgagacagagtcttactctgttgcccaggctggagtgcagtggcatgatctcggttcactgcaatctccgcctcctgggttcaagcaattatcttgcctcagcctcctgagtaactgagattaccacacttggctaatttttgtattttagtggaaatggggtttcatcatgttggccaggctagtcttgaattcctgatctcaggtgattcactcgcctcagccttccaaagtgctgagattacaggtgtgagtcactcactgtgcctagcctacagtttggagatttcttaaagaacttgaaatataactaccattcaacccagtaatcccactgctgggtatatatccaaaggaaaataaatcattctacaaaaaagacacaggcactcatatattcatcacagcaccattcacaatagcaaagatatggaaccaacctggatgcccatcaacgatagactatgtaaagaaaattggtacatgtacactatggaatactacacagccataaaaaggaatgaaattatgtcatttgcagcaatgtggatgcagctggaggccattgtcctaagcaaattaaagcaggaacagaaaaccaaataccacgtatcctcatttataagtgggagctgcacacattgaatatacatggacataaagatggcaaagttagacagtggtggctactagaggagggagggttggaaaactacatattaggtactcttctcactacctgggtaatgggaccattcatacaccaaccctcagtgacatgcaatttacccatgtaacaaacctgcatgtgtacccccagaagctaaaataaaagttgaaaaaaatctctttggaaccccttacaagagaatgaatgaaagacgaaagaatatctagcctttttctaataagccgggtaaatctattttgacatgattttacaatagctgtccctctttgtagcgacatctggggcttacaatagcctcagtattgttctataaatggcattttaaaaaggaaacatctcccctgtagggtgtaagttcttcaaaggcaaaccatgtttatgtatgctgtatttgcaacacttagcactgtgtttgataaatggtttacttttttaactgttggagcggatttttttttttttttttttttttttgagatggagtttcactcctctcgcctaggctggagtgcaatggcggctcggctcaccgcaacctccgcctcccagatgcaagagattctcctgccttagcctcccaagaagctgggattacaggcacccgccaccacgcctagctaatttttgtatttttagtggagacggggttttgccatgttggccaggctggtttagaactcctgacctcaggtgatccagctgtgtcagcctcccaaaatgctgggattacaggcgtgagccactgcacccagcctggatatattttttaaaaagaaaagtatatctagttttttaaaaacattaattcactcaatagtcacatctaaacagacatatactatctatgcagattgtaggcacgctgtatacaggttagatgaaaattctttggcattactgttcaaataaaaatataagacaagctggtaatgagagcaatatatgtaattttaaaatttctgtctttcttttttttcttttcttttttttttgaggctgtcttgctctgtcattcaggctggtgtgcaatggcatggtctcagcccactgcaacctccacctcccaggttcaagcgattctcatgcctcagggtctcagagttataggtgtgccccaccacaccctgctaatttttgtgtttttagtacagacgggtttttgctatgttgaccaggctggtctcaaactcctgacctcaagtggtccggctacctcggcctcccaaagtgttgagtttacaggcatgagccaccgcgtctggccaatatatataattgtaaagtgtctaataatggcatttaaaaagtacaaatacagagatctaattagttttagtaatatattttatttagcctcatccatccaaagtattatttaacaatgtaatcaacataaaaattattcttatttgtggaggtattttctctttttctgggatactatgtcttcaaaatccattgtgtattttatacttatagctcatctgaataaggactagccttatttcaagtaagcaggagtcacatgtgattggtggctgctgtattcacagcgcagcttgatagcaatttagcttcaggacttttgtttttgtttttgaaatgaactaaattgccaaacctacatgtaatataccagatacactcatgtccttaatgttatttgatttgtttctttaggacgaacaacctattttattcactttgtttatataaaaagtattattcttaaatatgtactatgcacatatgataaaacatttcacaacattaaatggtaggaaatataaaaaggagtgtcctttcattgcgtctccaagcccagtcccctgaggtaaccactatcacataaaatgcagattttttccacatatatatgagatatgtatatcttttttaagtatcaatgaggatataacttacttttcatagtcctgataaaataccaacaaaaactttgctatgtgcataagattatataggatatcttcatgtatcaattctttttttctttttttttttttttttgaggtagagtcttacgctgtcacccaagctggagtgcaatggcacaatctcggctcactgcaacctccacctcccgggttcaagtgattctcctgcctcagccccccgagcagctgggattacaagcgtgtgccaccacaccgggctaatttttgtatttttagtagagacggggtttcaccatgttgaccaggctggtctcgaactcctgacctcaggtgatccgaccgccttggcctcccaaagtactgggattacaggcgtgagccactgcgcctggcccttgtaaattctttactagcaatgaggaaagaaaaagcaaaagtaagtatctgggatcttaaatttgatactatttttagacactgattttgtaggatccaatattttgatattcatagaaataaccagtggccataagttctgtaatatcaaatgaagtagcactcttctatgaactatacactttacattcattatatggtttctttttttacttatttcctcaatcagtcagtcaacgaacattcgagatcctgtcatgtgtcagacactgtgcggagagctggagataaaactgtcaacaagatgaatgcagcctctaaaataaagagtttctaatccagtggattctctgttcatgcttcttgcactttctctacactttgctctatcaaaaaaaaaaaaattcaaaacactcacgagtttgttgaccttaaagtggaatcagctgatacaaattaaaagcattttgcatttcaaaaagtgataaagtctaataaatagctcactaatggtgaaatttcagagacatttattttaggctggggtcttcctaattcagaaaaaatcagtccagtttccctattttacatccaaactcctcaaatgaccaatctctattctctctcttttttattttttggatgagtctctcactctgtcgcccaggctggagtgtagtggcacagtctcggctccctgcaacctccacctccccagttcaagcgattcttctgcctcagcctcccgagtagctgggactacaggtatgcatcatgatgcccagctaatttttgtatttttagtagagattgggtttcaccatgttgaccaggctggtctcaaactcctgacctcaagtgatccacccacctaggcttcccaaagtgttgggattacaagcgtgagccactgctccaggccccaatctattctctctaactgcttttatttcctggcctagagctccctaccattccactgaaacggatttaataacacaaatagcattatcactaagtccgaagatatttcattagaacttctcttccattattttatggcattttaaatttttaaaatcactccttctgcattgaaaaactatcatactgaggtttgacgccataatttgtttagctcccctcccacttctctgtggaatcattttttttctcctttaaaagcttttcttcttttgatctcctaattgtgtgagttcttcaggctactacttgagcaattaagcccatatttaaaattgtcactgatgatccattatttatagcttaccaacgtgtgttttatggaacactgttcccacaagaccacattgaaaaacaatcaagaaccctggcaaacatttctcctttgcctgcacattctacagagatcataaaaataaatattctttctcctgatcatacttccagacagagtgaacatatgatacaattctgaccaacaaggcataactgaagtctgttgacccttcgcttttcttactgctttcaacacgaactcaaagcaggaaccgtggtagataatttgcaattttgaaggatgggctaaatgaattgcagggtcatcagcctccacgctgcactgaacataggtcagcaaccacttacctcctgagttctcactacgtaagatgaagaaatctttatttgtttggacttccgtagtcaggcaatttatacctcgcaccagaacatactcttaattagatataaaaatgctacatactatatgtccttcttggagcttcagaacgcacattagaaaaattagagaactgagaaattcccaagagaagaaacctgtggaattctgctgaatttgtcatctcctaaatttatttgatcaggcagcccttttcttctttctgtactgaactaccaatgtctcacagaactatggctctctagctttttgcttttcaaagtgtaatttctagaccagcagtatctgcattgtctggaaacttcttagaaaacccaaatattaggccccatcctggaagcagagttacattttaacaggatcttcagttggtttgtatgacactaaagactgagaagtgccgcttgggaaacactgatttagagaataaagtacaactaaccttaatatccttatgtggcctatgatttcaagggcctctatatcattactgtcccttaatgcctacttcacaagtcaacacacctagttcttattgaatgcttactttgtgcgaggcactatgccaagtgctatagttttataattctcaaagcacccctatgaggcaggtactattgtaatcgttaccttgtagatgagatagctagggctcagagaagttaagttgcctacccaacgtcacatagccattaagtggcagaatccttggcttaaggatttaaggatcactcaactatattggctttctaagcttttgttcccaagcactttcctgctctgtgtacttaacacacatgattccctctgcctgcaatatctccccacgtacaccttcttaaaaggtctcagctcaaaaagtcagttgttctgggaagcttttctgatctcctaccccaaagccaggtcagatcctcctggtaaacattccccaggcacatatctttacttcatacatatcagcttttataattatgtatattttgtgattctatgattagtgtatgtgtttaccaaaaaactaagctccgtgtgggctttaactgtatcctctgtgcctgacacacagttgacacacaaatattttttagagtatctttttttttttttttcttgagatggcttctcgctttgttggccaggtcggagtgcaggttggcacgatctcagctcactacaacctctgcttcctgggtttaagcaattctcctgcctcagcctcccgagtagctgggattacaggctcacaccaccacgcccagctaatttttgtatttttagtagagatgggttttcatcatgttggccaggctggtctcagactcctggcctcaagtggtccacctgcctcagcctcccagagtgctgggattacaggcgtgagccaccgtgcccagccttttggagtatcttttactctcatttgaaacgttctctccctattctgcaccaatccaagttctacccagaagaagctataggatggtggcaagatatttgatttagcatcagaagacttggatttgaggccttgttcccctactttgtaacttggagcagtcacaaaaactcagacccactgattctcagctctgttaaatggacataataataacctcacaggattggcataagaattaaaatgagccctgtgagagaagtgtataacctacataaacttcctaaaaatacgagtagcgttttgtagtgattaagatcctgggttgtgcttaaaagtttccactctgtaatccaaaacctgagttcaaatcccaactcataatatttattgtctctgcggttgattcggcaatccattatttgctggattttgtcatgtgttttgccaattgcattcataatttattatgcatttatgcttgtatctcctaagtcatggtatataatccatgctttttatgttttgtctgacataagctcttatcagagccctttgcacacagggattcaataaatattaacacagtctacatttatttggtgaatattgcatatctgctgtactgaaagcacattaagtaacaaaggcaagtgagaagaatgaaaagcactactcacaacagttatcatgattgcgcatggatatgttcagaatgagtatttttcaaatcactttaaacaaagctgaattgcagaaacgaaagcccaacagcagcaattaaattacatttggaataaaatcatttggcctaattttcataaccacagatttcagagaataccaccacccatgccaggtgtaccagacaatcccattgtctgttttagccgtgtaggggccgctgtagtatacaccattcaggtttgcagagtgacacctagtggaagggagaaaaaaaaagaaaacaacaatcagactggaaaaatattgttcagaatcccttttattttgctacaaatgctcaaaatttttgaactatgaattctgccatttttcagacaagtaaatatttactagtttccaaaagctgagaaatttctacaacagatggctattgtattttattttttattttttaatttttttttaataatagagacagtgtctcactgtgttgccctggctggtctccaactcctgagctcaagcaatcctcctgcctcagccttccaaactgctgggataacaggtgtgagccactgcgcctggcctcagagatgggtattttaaaatggtgagttttactgccattacaaatctgaaaatacaacccaggccactcacagtgcattgaaaaataagcatttcaatttttgattttctttaaacaaaaaattaaaacaagcaaacaaaaacgcatccttgtaacctccagccttacaacctcctgactcagaacagtgttaatttcatacttaacaagagctaaggtgagtgtcagcaaagcaagtcgtgggcaaggtgctctactactggctttcctggataatttgcactcacacgttcattcctctgctgctaagacttagctttcataattcaaactccgtatgtccccttctttaaattgctagcctatcagttatttcaatctcaagggtaagcaaacaaacctaaatcaccatttaaagttttgccacccatcaaccaataatcattttttcctagttgctgagttaattttttacatatattgcaccaatctagataagctggttaggttatcgacaatataaaaatgtttctttcctcctttggagtctgtaaattttgtccttgatatgtataatttacatgtaacagtatgcaataagtttatgtgtgttgttatgaaattaattgccatatacttctttattgataaaattaatgaaaagatgtcagaattaggatagaaggagaacattcacaagaggtagttctgaacatctatggaaaaacccaaattattgaatcaaaaaagcatataatctacccgtaaaggctgagtggctggcttgaatcacttatcagcttaatgattcactcctactgagcgttctcgaagtcctcctaacttaaatggacgtaattaattgaaaatatgtatgtcaagtctgcaaatgtcaaagcctactgtgtttttaaaacagcatggaaagtaatgttaaaaaaagaaaatactgtaaattgagtctccagaatatatattttggcatatatttgtctatctagagacatctgctaactatatttttatatttggtctatcatttgaatcccattaggaaactgactctgtgatgaacataagaaaccttcactattctgagaccagttttctagcatcgtttagtttttagaacagcctggatttgaaactaggttaggggatgattgggtcttccttggtgaagaagtggctgtgaacactcacgtgaaatgctacactaacaaagaaaagacatcaactcgcagtgattggtttgctatgtggaaaaaaacattttataggtgggtaatatttatgaagtgccaacatttcatgtaaattagaagaactatgggacagaaaaaaagcaacagtaagaaggaagaaaagatgatagtcgaactcactgatagtaggcatggtagaagtagcaccaagtttctaaaacaatctactttctctcccttaatgcctactgattttccaattgcacagccttatcaacccctttgattccaaggataatgtgggctctgtggcaggctccacctaatgaatggcctttctttgtgctccctgaacccatttctttaaagtcaggtaaatcgttcctttgcccacattaatatacatggtagttttcattcagatgccttagaagccagtcagctggataaagtacatggttttgatctcaggatactattagtaattatttctgtatatggaattgttttcaaaatcaaacattggtgatgcttgcagatgacttcatgaattacacgttaagttttatgtcatgctgacttagaagaacaagggggaaagaaaggagtaggaacaggtgaagaagacggtttttaaaataacaggaaaaccactaaggaaaacaccatcatcaccttcaatttgcaaagcaggagagtgaaatttgtttctctccttcacactgctggaaatactccagttcctttataaatgatcaaatcttaaatggactcaaatgtttttttaaaaaagcaaaatatagaaaagatgactatttttacaacagcagtagtactcccttatctgcaggggatacgttctaagacccctagtggatgcctgaaactacagataataccaaattctatatattgatactatgctttttcagtctgataaccgaaacagctacgaagtgagtaacgagcagataaagaaaataaaatttaccaaactgaaagacatgatatagattcaaaagaaccactgagtacccactgcagtaaaccaaaagaagaccacgacagtgtatgtcactgtaaaatttcagaacgctagggggaaaaatcttttgggtgtaggaaggaaaaaaaccatctatagtagttctctgttttttcctataatatacatacctatgacaaagttaatttataaattagacacagtaagagattaacaacaactaataataaaagattatgattatataacaatatgtcagcattacagctcttgtgctttgggaccattattaaatcaaataagcatgattcgaacacgagcactatgaaactccaacactggatctgataactcagacttctactaagtgtcttggggcagggagggctttcagcgtggatacgctagacagaggggtgacccacctcctgggcagaaagaatccaatggtgcgaatctctgctcagaatgacatgcaatttaaaacttatgaattcggcagggtgcggtggctcacgcccaacactttgggaggccggggtaggtggatcacatgaggccaggagttcgagacctgcctgggcaacatggcaaaaccccatctctaccaaaaatgcaaaaattagcccatgtaccccagaaatatataaaatattttgtatcagtaaaaaaagaagcaactatatacaatcaaaaacggaatgaatttgctgataaagtaacatgaatgtattcagtcagagggtagaattaggtttctggattattgtaaaggaaatttctgtattgggagaggcttagactcaatgaattaatgaaagccatagtgattgaaaagtagtactatacagaagcattacagcaataacggtggctcttttgtgtgatatggtcaggtgaagaactagttggttattaggatgccaaatagtctccatatatatacatgctctctctttctttgtgtgaatttgtggccttctatttataactcatccataattcagtttgcaaatgatctttgtaaaagtaataatttatttctatgacatttacactttactaatgtacacaatgaacaaatcctcaaaacgacttcattgctgaagaattctaatgagaatgattacttaataatactaatattataaataaagactaacattaccatacatattatattgataattaatgtctatcagtgagatatcatcaactccattacaactatgctcataagacatcaaacctgttaaaccaccagccagactgatcttcttctgcgcagttcccttcatagttgtcatgatctctgtcccacgtgctgaatttcattctttggtgactagcccaccactgcacctcaggatgaaaattccccgcaagggaatctccagctgttccagaatattccccaatattcaactcgtagaaattctaaagaaaaagggcatttctgctgtcagtggagttcctctatgaccattttaaaattaagtttatttcataaacaaaagaacaggttctattgtatatttttatttccactgactccagggttatattgcacattttaagcatttattcacggttttacttcttagaaaattgtagtaccttttcatctccaactttgaaattcttatattgtgcataacggctatttttttcaaaatctgcaaggtcgatttttaaagtgtagtcttctaaaaaagaaacaagcaattataatttttaaaaatgtgtgacatgacacggactactgcggtttaaaaataattcacagctctattttaattttaccatttcccttggccaagaatcagttttcaaagattaaacagtgactcctttgtatatataacatgaacattttatcgtgtaatttatttgaaaaaaaatgatggatacaatattaaatttaaaaaatgtctactagatctcttagaggtaaaacctagtgcaattcactgaataatgaacaacagaaaaaataagtgattacttaaagcaatctaacaatgaaagggtcgacgttttacctttaatagtttgacctctttttcttgatttcagtaagaatgttgatcttgaatataaatggtggctattaatgacattgtgtaatctctagtagctgagccactaggtttgtaaaatgtagttgccattgcctgcatatgcctgaacttggttattttcctgatagcataaaagatcagccaggaaaccctttaagaataatttgaggaagaaatatgaatcctaattgttatccgaaaaccttcgtttgatactggctcataagatcaagagactcttagcatcaaagtatgtagagtggatgtcattggaagagaatttcagaggcaataaggaaacattctggagaaatgctgtaccaccaacattctcaatggcagagatgatgataattactggaaaatatactaacatcaatgactctgagtaaaaaggtatttctgaagaactgatatctacatgtgaaagcattttaagaatgcaatggggccggggcggtggctcacgcctgtaatcccagcactttgggaggccgaggcgggcggatcacgaggtcaggagatagagaccatcctggctaacactgtgaaaccccgtctctactaaaaaatacaaaaaattagccgggcatggtggcgggcacctgtagtcccagctacttgggaggctgaggcaggagaatggcgtgaacccagaaggcagagcttgcagtgagccgagattgctccactgcactccagcctgggcgacagagcgagactccgtcgcaaaaaacaacaaaaaaacaaaaaaaagaatacaatgtattgggtacatattatcttttatatatgctaaagaatgatatatgatgacaaaaaatctctaaacattaaagatatactttaatgactgtaaaaattctaggcgatataagagcattatgtttttaaaatgattaaaataattgctaccttcaagtaatcttttttttcccattgtttggaaataacaaagactattcctttttcagaaacagaactcttgtcaggggcaccaaatgttataaatcaaattattagatcacatgtgttctatcctcctactttgataaataagatataacaatgacctgtaaggtcgggttagaatttagagcctcactttccttggagtttcaagccagaccatggaggcactgggaaagagagtccctgaatagtcctatcacctaggccccatctctggttggcctcttctctctttccatccccatctccatcacttatagcaaggggctttggatccacttgtggacatcccaggctgcatatccaagttctattcacacccaagttgggtggattacaaggtcaggagatcgagaccatcctggccaacatggtgaaaccctgtctctattaaaaatacaaaaattagctgggcatggtggcacgtgcctgtaatcccagctactcaggaggctgaggcaggagaattgcttgaatccgggaggcagaggttgcagtgagccgagatcgcgccactgcactccagcctggctacagagtgagactctgtctcaaaaaaaaaaagccattttttagcctcccctcaagcttaagggtgcacacaccaggacgagaacatcctgaaggagtcctataaacaaactcaaggctgttggggcagggaatgctggattcctcaagactggagtccctttaagaggtgatgcgggcctctcttgggcttgttgatttagcaccacaatttccttgccccagggagctctctcaaggtagtaaaggtcacaggagaaaagactgtagagtgtataagagcagcaaggcaggctaagtcaactgtctttaaaaatattctattacagacgagatgcggtggttcatacctgtaattcaagcactttgggaggctaaggcacgcagatgacttgaagccaggagtttgagaccatcctggtcagcatggtgagaccaccgtctctactaaaaatacaaaaattagctgggtgtggtggtgtgcgcctataatcccagctactcaggaggctgaggcatgagaattgcttgagccaagagtcagcggttttagtgagccaaggctgtgccactgcactccagcttgggcaacaggcaaaaatctgtctcaaaaaaaaaaacaaaaaaaaaaaacttctattataacagagacataaagactcaattttttggctaacattgaaatgtctctttgttcaataagtaaacaaattatatttaccatttctaaatcaattttattgccactacttctagttgagatttatgtagtggggataaagctattctcagaggtaattcattaattcattagccgtaatgctctcataattaaagaatgcagagacaaaaacactggctattgtctggattgatgggatacgtgggtgggggcccaggaactgaaaaacacgttttttctccaacgagattagccagcctgagtaccaagttgatatatgaaaaggaacaggtttgttggcaaagttcctctgggaaaatatgtacatcataataacttaaaaaataatacgtttgaatttcatatatttagaaagagccaagggttactgctctggggttttcatagtttcaataagaaaccagataaatatcaatgtgcaaatgaaacagaagttggtatggcaaattttatatatctggcataaaacacttaaaactagaataatagatatgttgaaggaaaggaagcgttatgtaaatttagagagcactgatcataagaaggacatacaaagaaagtataaggtttctaggattactcatcctgtctaatgtttatcattctagtgtctcaaagaactttataaccataagcctactactataaatatagaaacaccaatagctttccagaacttggatggaacaaaggaacttttgttttatcttaattactttattattattattatttgagacagagtcttgctctgtcacccaggctggagtggattggcgcaatcttggctcactgcaacctccgcctcttgggttcaagcaattctcctgcctcagcctcccaagtggctgggattacagtgctgtgccaccatgcctggctaatttttgtatttttagtagagatggggtttcaccatgttggccaggctggtctcgaaatcctggccccaaggggtccacccacctcagcatcccaaagtgctgggattacaggcatgagccaccatgcccagctgtttatttttaatgcaattgcagtgtaacttagcatgcttttttgggcattacagttgccttttatgaaggattcaggatcagacttgagtgggactgatgataatctcagactacaacagaggtagggaagacaatggattggagcaaaagaacatgggagatagaagctgggaaaagtcgttatcaaaacaatgatattttagacaaatattaaactctaaagataagaatttaaaagtatatagggagacatccagatgtctgctatttactttgaaatatatatacagaaaagatggattgatggacggattgagtaatgggcaaacggatagatacgtaacaaaaacaagcaaagtaaaatgttaatgtaggatacaggtggtaggttgaaacttctttcaaattggttgcagctttgaaaaaatttcagcattaaagatgagatgtatgtggaaacatggacatttcatatattatagtgttttattggaaaaatagcaccaattgcccaattgttcacctctctctcataatatgtcttcatagctcctcctattgtttacttccttttaaaaaaaagtctgagctgctcctgtgatttgctttcaccaatagaagaaaaatgactccatgccaattctgggcctagatctcaagagacttatatacatccactcttttttgtggaaccctgcctgtgctacaaaaacaagtccaggctagctagctggaagatgagagaccctatggagccaggttgaatccttccatcccagagcagcaacttcagtgaggaagttgatggcagactcataagcaagcccagccatgatcagcagagcccagccctgatcagcaaaatcacccagccaacctgcagatttgtgagaagtaataaatggttgttgattttaagccactaagctttggaagaggattgttacacgttattattgtgacattaggtaactgatacagcatatataatctccaggaactcaaggcatcaaaaaggaataattatgacattatatatccttttcagaagtagaatatatatatattctatatatatctatagatacatatagcgacttatattctatatatctatatatagctacatatatactatgtatagaatgtatatatatctataaatatatttagatatttctcataaatatatatgtgaaaacaattccccgcaacccaattctagcttttttttctgtttctaattttaggcagccacattttacatttgggattattgcccaaaagttatcactgccatctgcaaatcatagcaattattgaattagttccattgcctataatttggttaaaaaaaaattttagtgttgtttttattatatttcaaataaatctgacatcattcaaaccttaccttgagtggtcaagaagtgaagatttttattgcccagccaatattcaccatgtttttggacaaaatttccaaagccattttcatagtctttccatcctctaaaaaaggtaaagtggaagccgattagagcaaactccatttgtggtaccaaagcgaccaccacccaccccctgctaccaccacctccaatattttcttgattagttaattcattttcagtattcttctttagagagattgaaattctgtctaattaataggcttcaggatatgatcaaaatatttgacttataaatctcacatttgctgctacatataaagtcttacatcataattagcacacctgttaaagttttcactgccatcagatcgtctctgaattacagtccatcctcctccatcggacatgtcacaataaacagaaaattctgctgggctctggagaggtttgattttgtaaaatccactgagcttatacccatcattgaaaatctctgaacaatctgtttttaaaacaaggtaatgtaacattcattatgtgtctttttctccccccgccttagggagcctctgaatgagactactcagtatcactggagacagataacacatggtatagaaatcagcgttttaaaattgcatcttgtacatcttccagtggatattaggaaagttttatttcctttgctaaaatttgccacctgaatccttgatataatcatcgaggaaaaaaggggagtgaaataagaatctagttttttgtttctttcttcttttttcttttacattttttttaagaaatgggggcgtgtcactatattgcccaggctggtctcgaactcctggcttcaaacaatcctatcctcccaccacagactcccaaagggctgggattacaggtgtgagcttagtttctaatttctgagttttgtagaaaacaatcttaaaaaaaacaagttatgagtagtctgttaataacagtatatttaggtggaacttacagttttatcagacggaatagtaaaatttatctcacccatgaagctaaaatgaaagcagaaatgttaacaccaaagttactacaggttatcctgacttagagcatgataaatcattctggacatctgaaaatgaacccaaaatagtaatcttgtaaaaatctttattattatactttaagttctagggtacatgtgcacaacatgcaggtttgttacatatgtatatgtgtgccatgttggtgtgctgcacccataatcttgtcaaaatcttataatctcttagccttattagattttttactaacccactgaagtttctaaaagtccatacattcttagatgtttttgctaaaaactgcaagcttctgctattcttttcatcccttaattcttttttgctgtggtatttctttgaacactgaagcaaatgtagctacccctttgtcaccaaaaagtgatatctctttctttctttctttctttctttctttctttctttctttctttctttctttctctttctttctttctttctttctttctttctttctttctttctttctttctttctttctttctttctttctttctttcttttcctttgagacagagtcttgctctttcgcccaggctggagtgcaatggtgctatttcggctcactacaacctccgcctcccgggttcaagcgattctcctgcctcagcctcctgagtagctgggatcacagccacgcacctacacacctggctaatttttttgtatttttagtacagactggattttgccatgttggccagactggtctcaaactcctgaggtcaggccatccgcccgcctcggcctccaaagtgaaaggatgacaggtgtgagccaccacaccctgccaaatggtgatgtctgttccttaagccacttgagggtgatgtaaattaatacccattgggtctcacctaggttgatctgtacagacttagagaacgtggcaaatggggacctctctattgttcagatgcatagaaagctaggttttaggatgattgaagtagtggtcactataaacaatctcaagaagagccgtctacaaacatttgaataaaaatactataacatcatcaactttcacttttacccttatcgctttgttaatttccttaacaaaaaatttttttcttattggataattccattcttgtagcatattttaaagatgtttaaagatttaaaaacaaatgttcattgttttgatactagattgccaaatttacaactctcttgttttgttacagataaaatatattgcacattaagtaggtgaataggccatagacatcagaagagaaaagaaaagaaagaaccttagtcattttataaagccttcacatggttgggaccaaccatatactcctgctttggtgagatgtttacctttgtaatgatttaggctttattcatatatttattttcaagattcagaagcacatgcgttcatatacatgctaaattataaaaaggatcctgttttggcaattaaacaagaagcaaaacaatgagaaaatgattatctaaaattagttcaatgttgttataaagtttacatcttgtagtcaagtatatagtacaacacttttattaaagtaagcagattttagccctatttggaaagaagctttttgcttacattaaatttcctaccaaagagctgaatactaaagactcacaaggatcaaactattttccaggcaaatatggaagtgattagctataacatttgcctctggaaaacttagtgaatatagaggtttcagccaaaattttctacttgttattattttatgctaactgcgagtttgttatttctttggtcttgtttttgaaattttccttctccccagaagaaaatgccaaacacaacttaagaaaagcttttaactgaaataaacagtaacacaacaacaaaacccccaacaaataaataaacattaaaaaagcaaaaaagcaccagtagttcaatttgcttatagctaacaagttaagaagcctgctttgggaaatgagacttaaatcgtaacagcagaaagtatgaaaaatgtagaatttaaaatatgaacttgatatttaaaacgatgattttcaaaatgttctgacccactcaactccctggagaataggtagaagaaaggcaaggttaaagagctttgtgttcatgggagttttttttttaaaaaagaaaaagaattttgaatatttacataatactagacagaggccaaggcatcctgccttctgttttgacaaacactgtattaaactgggttatgtgtgtcctttctctgatcatgcagaaagtaagccatgttggaaggctgaatgtttaagctcataaagtgacatgacagcctgccaaatgggctttttcctcttgtctcaggatggtggctgaggcacaaagctgagaaccaaaggcacaaagtaccccacattctaaacacaaaaagaggtaagcaacagaggtcagctgccactccccagagcatgttgggatatgcgagaactggccctgctaccgccatcttcacccccaggcaacataaggaaaaaaaaaaaaggataaaggaaggtgggtacatagtaggtgtatgtatttgttggggtacatgtgatattttgataaaggcatgcaatgcataataatcacatcatggaaaatgaggtgtccatcccttcaagcatttatcctttgtgttacaaacaatccaattttgctctctttgttatttttaaatgtgcaattaaattaatattgagagaatgcgatactcttgtagggtagagtgagtaggctttcttccttgaaaacaaggctataataatgtccatagatagctggcattcactgagtacttcttttgctctacgatgttaaatatattaactcattttattttgtttatttatttatttgagacgggtctcactctgttacccaggcaggttgtagtgcagtggcacagtcagctcactgcagccccaaacttctgcaatcctcctgcctcagcctcctgagtagctgggcctgcatgcatgcaccaccaagcctggcaattttttttttatagtgttagagtctcactatgttgcccaggctgttcttgaaatcctggcctcaagtgttcctcccacctcggcctctcaaagtgcagggattacaggcatgattcatggcacctggccaaaatattttcactcatttgaatatattttaatccttacaacaaatacacagcattcttattctcattcttcagatggggaatatgggacacacagaggttatgtaatgtccccaaaggccacagctagcaagatgggcagctggactttgaaatcaaactccagagtcaacaccttaggccactttgtaacctgcctcaagacactcacatgcagactgggggctcctgaagaaggggagatgctggagccagtggtgttgtcaagtgaacggcggtggtgacgccagatttttgttcttgccaccagttaatgtgaatttgacacagtaaccttttaattcataatccgctagcacccaaattctttaaaaaaagatacagcttaatagtatgctgtagaaaatcatgtgcctagtgcattgtttgcacaaattgctaggttgtatgtaattgggtgttttctaccatcagataaattagaattcagaaaataactaatttagtaataataaagtaacttgtaaataagaagaaaagatttatatttctacagattatatgtatgaatatttaattgttttcaatttaaggacaccaaaaacataaactttgaggtgaacaagttcttatatattttataccatattatatatatataaaacactatactttattggaatttttatgttatatattttatttattgagtatctgttcttagtagcctctccagtactatctccctatatgctaaaatataaagaacaattgaactgtgtttatattttatttcccctttttcttcttcatgcttgtaattaatatatgaaaaatattgttttaatctactgaattctgatttttttggcttttatatcaaaaaacagtcatctagaattcctatcatctgtcttattattataacagtattatatttataataattataatgttttttctgaagcatctctatatgactcttctaactcctgcttgtacagttaatcctgctctgaccttggcatcgtaatttccaagtaactgatttcttgccttattccttggtgaccccttacttcccaaagtctgctccccagcagtgtcaacacaaggactggatcttcagctcttgatatgatttggatgtgtgtccccaccaaatctcatgttgagttgtagttcccagtgtgggagggaaggcctagtgggaggcgattggctcatgggggtggagttgtcatgaatgttttagcaccatctctcttggtactctacagtgagtggtgagttctcatgagatctggtttttgaaacagtgtcgcacctcctccctctctttctcctgttcccaccatgtgagatgtgcctgcttctgctttgccgtctgccatgattgtaagttccctgaggcctccccagaagcagatgctgctatgcttcctttacagcctgcagaaccatgagccaattaaacctcttttctttataaacgacccagcctcattcatttcgttatagcggtatgagaacggactaatacagcacttaagcctcagtcttcccatgactggttgtagaggcctgggaacaaacatctgattagctgccccctgccatgattgacccttgagtctgtgccaataacctgctcagaatgtgttcaaatagaaaccccaagtcttgggcttggtttgaaatttggagtaatgatgatccactggcatctacgagttcctcgcccttgagatcagctttgtatgttcttttgggatcacttatctgtatgctcatcccttaaacgatagtccgtttgcttcccaagcccatttttacccgaactgtccctggttcctcttggctccagaggcactggccatcttcaggctatagccatccccactactgcagaccactggctctggcctctttctgatctctaagggccagagggagggcagttggatcaagatgctggccataagagaagcaggagcccagggcgaggagtctgagcagagggagataaggatcttggtagaaaaaaagggagcattttaagagtctcatgcgctacagtgtgagccagccaggtgccctgaagcattttatggaagcatagactctcacaactcctatatcctacacttgtatgattagaagcagaaaataaacatgtttctattcccataagattggcaactctttgacctctacagtctttcaattctagtcaaataggtgtccgaatttatatttgcttatcttgctattcctctccctatgaactaccttcctttcattcctgaatatgaggatctactatgtttcaggcactctaatagccaacagggagataaaagtacattaaatatcattctagacctcacagagtgcccagttaattgacctcaatagactcataaacagaaattacaatgtagcatggtagtgctagaatagacatatggacaaagtgctttcgctagcattctttttgtttctgacaatcgtcgtttactctaaaagataccttttacttctggaggaattcaagtgaacagttttccatagagaataatgatttgtgcagcaatgtgtgtaatgtgttgccagtttaaaatcatttagtttctggggagaaatacctcattgaaaggaacattatgaaatcagaaaatatacatataaaaaactactcttttattttccttagtaattctggttctttttcctttttctgctcctttattttttaccttatttgccaccctaatgcacattaggatttcagaagggaaaactgcatacatgcaacaaggaaagatacacaaacacaaagctcaaatgcaaaaattcccaattgtaatctgccatgtgtacacggattttttttttttttttgagacagagtcttattgtgttgcccaggctggagtgcagtggcacgatcttggctcactgcaacctgcgactcctgggttcaagtgattctcctgcctcagcctcccaggtagctgggactacaggcacctgccaccacgcccagctaatttttgtatttttagtagagatggggtttcaccatattggccaggctggtctagatctcctgaccttgtaatccgcccacctaggcctcccaacgtgctgggattacaggcgtgagccaccgcacttggctgtgtccatcagtatttaaacaatctattgtcctgatttcttattaaatgatataaattctcagatatttagcattcacattaaatgccctggcagagatagaaaaaagtaaagtgtcggctgggcacggtggctcacgcctgtaatcccagcactttgggaggccgaggcaggcgaatcacaaggtcaggtgatcgagaccatcctggctaacatggtgaaaccctgcctctactaaaaatacaaaaaaagtagccgggcctggtggtgggcacctgtagtcccagctactcgggagactgaggcaggagaatggtgtgaacctggtagacggagcttgcagtgagccaaaattgcaccactgcactcctgcctgggcgacagagcaagactccgcctcaaaaaaaaaaaaaaaagtaaagtgtgaaagaagacatttacaatagatataatgcttcatattgcttgttactgaaataggaaaagcctgaaataactagcaccatcactgtacatgggtgcataatgtaagttatagaaacacttaagaaaagtccattctgacctgcatactgcctcttgcttccaagatcaatgacagtattctcatctcctttatcaaggaactggacttcattctcctgcaaaagctgcttgatcttgacctgttgctgtttgacccgggtctcaagcaggcgcacctgggctctgagccgcatctgctcctgggcacagtcctcgagcgcctgcaaaacaggtgagatgagatgagtatgcacctcattttcatggaaaacaagtgctttttaaacatttggataaatcagtgattccattttgtctccagttcccatttcagaatattattccaaagagaaagtggcttgaaaagttctaatactgcctactatttgaagaattggaaattatggcttatgcgaaaactcctggactcaaaagatcaaataatataaaataattggaatcgctatgctaggagctttatagttgtctcctttgatcctcataacaattccatgcggtaggaaagggctcagtcttgatgcccagtgggtaagcggaggtgggattcaaattcagttcaaggactgtgctctcaatctctatatgacattgcttatgtgttttctaaacagtaatgtggtttatagaagttaattgtactgttggcatgtaaatctccataataaatgaggtttttgaatggctgtctggtataaatacttttaaatatgtatatttaatgtatattatatattatatatattatatatgcatataaataatatataatatatataatatataatatattaaacaatatataatatatagtatataatatattaaacaatatataatatatcatatataatatattaaataatatataatatatatcatatataatatattaaataatatataatatatctcatatataatatattaaataatatataatatatctcatatataatatattaaataatatataatatatatcatatataatatattaaatatataatatatatcatatgtaatatattaaatatataatatatatcatatgtaatatattaaatatataatatatatcatatgtaatatattaaatatataatatatatcatatgtaatatattaaataatatatatcatatataatatattaaataatatataatatatatcatatataatatattaaataatatataatatatatcatatataatatattaaataatatataatatatatcatatataatatattaaataatatataatatatatcatatataatatattaaataatatatcatatatatcatatataatatattaaataacatataataatatataatatattaaataatatataatataataataatatataatatataaaataatatacaatataataataatatataatatatattacaaaatatataatatgaatatatatgaatataaatgaatagatattatataatatataaatataaataatatataatatattaaatatatttatatataatataatgtaatataattgtatttattatattatagtctactttatataatatattatatttatacataatatacgtatatataaaattacataatggatttatatagtatatattatatcaaatacatatgcatatataatacatttatatttatatagtctataatatatatatattttttatatatatatatatgtagtacatctcccctccctcccatctctaggtccaagtcatggaacctctcccagccatttttctaggatggtttctcccttttccttccccttcccctttcccttcctcttcccttacgtttcctttctcagaacctctcccagatatcttttctaggatgatttctttctcctcttttctttttcttttcttttgttcttttcctctctttctccttccctccttccctcccttccttccttcctttcttttctttcctttcttcccatccctaggtccaagtcacagaacctctcccagccatttttctaaaatgatttctttctcctcttctttttcttttcttttgttcttttcctttctttctccttccctccctccctcccttccttcttttcttttctttctttcctttcttcccatccctaggtccaagtcacagaacctctcccagccatttttctaggatgattccttctctctctctctctctttctttcaacagagtcttgctctgttgcccaggctggagtgcagtggtgcgatctcggctccctgcaacctctgcctctctggttcaagcgattcttgtgcttcatcctggcaagtagctgggactatacaggttgtgtgccataacacccagctaatttttgtatttttagtagagatggggttttgccatgttgcccagtctggtctcaaacttctggcttcaagcgatccacccacctcggcccctcaaagtgctgggattacaggcgtgagccactgcaccaggcctctctaggattacttcttatttgttcttgttactctatccctaacactcagatttatcccttctgagatagttatttgcttagcaccttgagtcacataggctaaaaaatgaacagcaagaacattttatggtgtctgggtcctgagttgttttacaacagtgggggatcggttgtgatattgttaaacatagtgcactatgcaattttaaaataattgaagacatcacaggtcaagtatgcccaatctttatgagattgcatacgcatatttagtaagcttatttaaaacctaggagttttctttctccaagaactttgaatgaatgttttgtcttttttattcacaaatgaaggacaacacaagttcgatgtaattactttcaaataatctggttagttttacacttttcaatattgaaaagctcaaggttaattttaattactatggacagtttcaaatttctaatattccaaccaaataactccagtgaatttttaaaaattacttatttattatgaatactttttatttaaaaaaatgtaaagcactttttttttttttgagatggagtctcactctgtcgcccaggctggagtgaagtggcatgatctcagttcactgcaatctccgcctcctgggttcaagggattctcctgcctcagcctcacgagtagctaggactacagatgcgtgccatcacgcccggctaattttttgtattttttttagtaaagatggggtttcaccatattggccaggctggttgcgaactcctgaccttgtgatccacccatctcggcctcccctgcaaaaatgtaaagcgctttaaagtgctgctttactatgtgtccagtatttctaccagcctctttgcttttcccacatagttaagttttttcaatgacaagtcactataggtttaatgcaaaatgaaagaaaattcagataaaagcaggcattataaatatgacaatagttttcccaagaagcttaccgaaatttccctgcccattgtcagagcggtggtaacaaggatgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttcccagcctctcaccacacagaatgacactgagtgttaactagaattgaatctgtttcatcacaaaaacagaggaaggactctggttcttttcgctatcctaatgtgctgtttgtgttatgctgtggaaaggcacaggagcattttaatcagttatttaatgttacacatcaaggaagtggcgtagtcaaaatctgcacgctggtctctgcttatggagcttgtgtctttttctccctatgttgtgaggctggtctcaaactcctgggcttgagtgatcctcccgccttggcctcccaaagtgctgggattacaggcgtgagccactgcctagagtaagatttttgaaagcaaaggtcacaccttgctaattttggtatccctagcatttaattcttgtggtgaccccaataactgttgttgcttctacggaattattcctcaggaggcaaaatcgttctcagagggaaaaatgtaatttccttgctttaaactacagtctgtttatactgacatactttcctcttttactggaaaacaatgggctaagtatagttttgaaggtaagagttaagaaggagttggggacttttggtttgattgaacacatgaatttaattttttccttctcacaaagcccactagaaaatgagtgaagaaaaagtttaaaagatgcgaactgacaaagtcaaagagaaagggaaagaacagctagtgtgcaatgtcagcaagttggtagatgataaaaaggcatgtggggggcctggtgcggtggctcacgcctgtaatcccagcactttgggaggtcgaggtgggcagatcactcgaggtcaggagctcgagaccagcctggtcaacatggcgaaaccctgtctctactaaaaatacaaaaattagccaggcgtggtggtgggcgcctgtactcccagccactcgggaggctgaggcaggagaattgcttgaacccgggagatggaggttgcagtgagccgagatcgtgccaatgcactccagcctgggtgacagagtgagtccctgtctagaaagaaacgaaatgagaggagaagagaggagaggagaggagaggagaggagagaagagaagtaggggaattggcaaagcagcagtagagaggagcaccatgagaagcgagagaagtcacagtgtagcaccctaggggattctggattggaggcactgctagcttggaagtgaaggtagaggcaaatgggctaacagtcagatcctcatctaaatcctgtgcagccaggtgaatgctgcttctcgtaccctttcagaatatggaagatttactttctattaagattgcccagagatgctccaggtgacatgacagcagaagtgctggaggggaggagagagaccctgttcaaaaagggtgaggctttcccaggcttcttctcttgcagccaggcaaccggctctacactcttcctaccactttccaggccaaagaacataggattcctcgctggaggaacagcagagcttcaccgaaaagatcttcagagactgacattggaggattctccatcaaaggaggcttttccttgactgatcgctctccaaagaatcccaccagttgggaagcctccttcatgcacctgggagaggtataaaaggtataggcacactattctgcttatttctttcaacgtaagtcttctttctgaagagaggcatattttacatttcattctctgtccacatcaaatggtctaaagagaaacaccaaatttctgtattacaacactgggcagaaattcatatgatagcaattagtcatgacttaaccctttcacccaacactgtgaacaaaataaccaagatgggccgggcgtgttggctcacacctgtaatcccagcacttcgagaggccgaggcgggcggatcactgaggccagcatggccaacatagtgaaaccctgtctctataaaaatacaaaaaattagctaggtgtggtggtgggtgcctgtaatcccagcaaattgggaggctgaggcaggagaattgcttgaacctgggaggtggaggttgcagtgagccgagatcacgccactgcactccagcccaggtgacagtgcgagactccatctcaaaaaaaaaaaaaagtatctctagacccatttttccattaaagttatccttttaaacatatgatataatttgtagcaacaatttataagaactctggcatttcactctttattttatcttagtaaatattttttctttaaaattcaattgtatattgagtatgtacctatcttaggcccagtgatagaaatagtagtcttaggcccagtgatagaaatagtaatcttaggcccagtaatagaaatagtagatgtttttatatgtaatgtattaaatataattgattatattaaaatatttgcttatgttaaaaatagagaaaattaactttctgatatttaaaacatttaccaatgtgaaaaagagacaccctctgtgtatttttataaaagataaaatggggtgagaataggattgcaaaggaacagaagtcgtgaccaaattagaagaaaagatgattaggtttgctatcaattaatattcgctaattaatataataagcttggaattatttaaggaacacttttctaggtcacatttattattgtcatgaaaggtaaaatcattttctttaagataaaaacattgactgcactaaagagtcatcatttgcaatgcagtagtgtcctaaatctcttattcccagatgtcaagattatgtctacaaattaagaaaatttcaagttgaaataagtattctaaaccgaagacatctgatgttaggagcaaatacattttcattccgatcctgggggtagtttcatgttttcttttgtttttctttttttgtctgagggtccttgggaacactccttattcattgtggctgaattttttcaacatcagcattgaatactacaaaggattgtatcagatataaatcaatagtcaataattttattaagaagtaaaaaccatccatttaaactgaattacagtgggaaaatatatttgtaaagaaggcttagaaaataaacaataacaataaactagaatgagattatttcaagcatatattttctaactattcgtaggtaaagttttaaaaattgaatggattctagtcctctaatccctgtcactagaaaatgactgacctacagcatgctttagtatcttttcttcacaataagagaataatattttaataatgacacacaataattgctaaacaggcttgatgggacagtaagcgtagttccacaaagatgccaagcagcctgcgtggcctggggcattatataaaaatgagctagccattcaagtagaatgtacctctgcaaggctgcaatattacttacattaaagggcccatcatcaaggggacaagggctatttccccaagtctaacgtggattggaaaaataaggaatactcatctgaaaccatattgtgtttgtgtttgggcatcactaaacactctgccgaactttggctgggcgtggtggcttacgcctgtaatctcagcactttgggaggacgaagtgggaggatcgccagaggccaggagttcaagaccagcctggccaacatgataaaactccatcgctactaaaaatacaaaaattagccaggtgtggtggtgcacacctgtaatcccagctactcgggaggctgaagcatgagaatcacttgaacctgggaggcggaggttgcagtgagctgagattgtctcactgtagttaagcctgggtgacagagcgacactccacctcaaacaacaacaacactatcaaaacactatcaaattttaattggccattttattttatttcattagcctcacagtgaaaataagaaaacaagcacaaggatgcttatgatttctccaggaccattcagcctctggggatatcccctgggaatatctcccaaatctcctgaacctctttctttattgcctggttaatcctttcttactgtattatgttgaactataagaaatggcagatgtttgaacatttctgacttagaaaaatggcaatttcattgtttcaaattaatgcatattgtttagataggaagaacacacttgaaaatcattataaccatttatactacaatgaataccaaaaaaataggttcaaaatatactgtttgcagcttacttgatcagagagagaacaaattggcaagaacctgtttttatatcaatgctgcctcccatgttaatacattaatgtgtgccatttaaaatatgtttacaaaattgctaatacatcatcaacacatgaaatctcacgatgtctttagaagacacattatgtttactttttactaaaggaagctcaaatagtgaagcaaagtaactttcctaaggaaagactctacgttcaaaatttatacaacatccaatcatttctcaccacctctattgctaatgtctggcccaagctaccaatggaagattccaaacaattttttagaattacaatgagacaacattctatactgagcctttcctgggcaaaccgggatatttggtcattcaccgacaaagctttacataatctgtgagcatccacctcctcaacacatctcttttcccatcatttttgcctgttctggctacattggcctctttggcatttttggaaaaccctgaaatacacagacttctcagggcgattgcacttgctgttctctctacctggaatgctcttctgaaaatctctgtggtttgctccatgacatccttcaggtctttgctcaggtattcccttcccagagataccttccctgactaccacatataaaataacagctgtcccctactgtcttagtccattctcattttataaatttacccagtaaagatctgcctgagactgggtaatttataaaggaaaaaggtttaattgactcacagtttgccatgactggggaggccccaggaaacttacagtcgtggtggaaggggaagcaaacatgtccttcttcacatgatggcaggaaggggaagagccaagcaaaagccccttataaaaccatcagatctcaggagaactcactatcacgaaaacagcagcatgggggtagctgcccccatgattcaattaccttccactgggtccatcccataacatgtgggattacgagaactacaattcaagatgagatttgggtggagacacacgcaaacaacatcacccacacacttcatatctctatcacaatggattcagtttctccttagcacttatcaccaaatataatgaaatattataatatatgtgtttattgtctacctactccaaccgccctgtacaatgtaagcacgaagaggtgagtggctacatctattatgtatactgccctaatgctaggtggatagttaggtactgtactagtttcttgaggccaccataacaaattaccataaactgagtggcctaaaacaacaggagtttattatctcacagttctggaggatacaagtccaaaatcaagaagaacagggccatacttccttcaaaggctctaagagaaaatcctttctggactcttctagcatttggtggttgccagcaattcttgacatcctttgacttgtggcagtatcactctattctctgataccatcttcacatagctgtctttcctctgtgtgtctctgtgtctaatttccctcttcatataaggacatcggtcattggattagggtctgccctaatccagtatgacctcatcttaactcagttacatgtacaaagaccctatttgcaaatgagatcacattcacaggtaataaaagttaggaatgtacatgttttgggggcacagctgaacctagcacaggtactcgacaaaatatctactgaatagatgagaagaaaacttgtaaacctgaattagaattgtagaacttcccaggatctgttattgtaatttcacagttgcttatgggagatcaaattcttttgtgtctgttgaatttataagatgtctttatcagattccctccatcttcacccttccagcaacaacaaaaataactactcttaatgaattatgcttttcataaacttttttgtgatttgcaaatatgtcatgtcaatatgtaacagcttattttggttttaaaagagacatttggatttataaaatcccaaaagaaaatatatacctgaaaacataatacctaagatatttgaaagttggctctctcactgggccaaggtcattaccatagctatctcataataagtttttagtttgactcgtgttttcagttggcaataaatatgttttttgagcaaaattataatagctatgttgctttttaaatttgtacccttgtgtctttaactatctaattttaaaatttatcacaaaactcaagtagcataaaggaaaaaaataaatgcccttatgcaaatggcaatttcttaaacataaacaattgcatagtcacagacatacagtcataaagtatttttcatgttacagaaaataagaaacaaaaacattttattataaggaagcaaaagaaaataaagatggaaaacaaaatatttaaaaaatataaagagattttagaaatagccttgttccccgagactagaacatgcagagaaaatataattagaggaagtgacatcattcagtcaaatatcatcaacactagaggctcagagagggaaaattgtttgcctaaagaaataaaagagactttcactaagtatatttacactagtctgggaaatcagcataacgacatgacataaataccatttatttgtgactccaactcaaattgttcttctgactgaaaataaccaatgtatttaatagattactgattaggatttttccttgataaatgaaactgctaaggattagtagtaaaaataatgtcctctttttttatgtgacaggaaacaaattttcattattttaatccgctcccagataatattcaggagtcaaaaattaaaaatcatgaaatgtctgtatcttctagactttgctttaatgttatttgttgaaaaatttttttatttgattaaagttttcttatgcatttgtgggatcaagtactttatttcagaagtgaataaattagcttaaaaagttagagcttagccaggcgtggtggctcatgcctgtaatcccagcacgttgagaggctgaggcaggcagatcacttgggtcaggagtttgagaccagcatggccaacatggcaaaaccccgtccctactaaaaatacaaagaaattagccaggtgtggtggcacacaccttttatcccagctactgtgttggttgaggcatgagaattgcttgaacctgggagacagaggttgcagtgagccaagatcacaccactgcactccagcctgggtgacagagtgagactccatctcaaaaaacaaacaaacaaacaacaacaacaaaaaacacctagagcttaaaaaagaaattttctcattccaatgtttgattctggctcttgcataaatggaagtatgttttgaaaatgctctgaatgatgcacctatatatcatataattttacctacgcacactgtatatatacgtatatgtatgaacataacattattatacataatatgtatatattatagattatattatatatacattatataaggtatataaatattgcttagcattagatttagtaaaaaataaagggctaatgaaatttttttgacaggcctctgtctcttgatgtcctgaaatgtttatctcactaccattaagataatccaataatcaaaaaggcaccccctagtctggtagcatataaacaataaagcatttcaaaatgtaattatttacatttagaaagtcattatattactttgattagctttagaataattcctgagaatatcttaagttctctaaaattttccattttcctcctttgcaattctaaccaacattctctgtaatattgaagaaatgctaagcattaagaaacttgctttgaaattctggtctccatcattcattatagtaaaccattatttcttctgcacatctggcttacagtaaagttgtatcaaattattctgttcatttattgcacaattagttgtatttcttttataatatttttgccttaggcagtatcaaaacttttaattattataaaattaaaattgttatcaaatggctgttctttggtggactatattattttacataattttaatgctataaattctaattccttccccactatatttaaaaaaaatttaattaattacgctgcattaaatttaaagatgaagacattaaatttgtaaatgaaaagttctaaaaataatatataatttttaaaaacaattacaaaacagaagtacattagtagcatgcaaacatttcaaaactggtatgttttaagcaagcattgtaaaaggatatataaaagaaataaaaaggaaggaaaaagttattgaacgaagtatgtttaataagttagcattcacaaacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttgacttctgaagtgaaaattgtcatatagtccattttatttttaattttttatactgaaactgtaaacctatcatttacgtcaaactcccatgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcacactgtatatatatgtatatgtatgtacgtaacattattatacataattatgtatatattatagattatatatacattatataaggtatataaatattgcttagcattagatttagtaaaaaataaagggctaatgaaatttttttgacaggcctctgtctcttgatgtcctgaaatgttcatctcattaccattaagataatccaataatcaaaaaggcaccccctagtctggtagcatataaacaataaagcatttcaaaatgtaattatacatatttagaaagtcattatattactttgattagctttagaataattcctgagaatatcttaagttctctaaaattttccattttcctcatttgtaattctaacataccttatttgtatatctgtatatttgtatatctgtatatctgtaacaaaagatacataattctaaatctcttctccaagtagcagaagcagactccttgctagtcaacctgacttcttgcaaaagctaatggttgttacctgagttttggttactatcatacctgtgaaataaattagcattattacaagcatgtcaaaaatgcagagacattaaataacttgcctaaagtcagaagtgagtcagagacccagctcaggttccatccagacactctgcttcccaggatcctgtaactgcattgggaatttgtaattatttctccattatttgattagaaatagggacaatgttgattctggcttcaatccagaaacaaacatgtggacacaggtttaactgaaagaaagctaaaagagaagattcaaggacaaatcccaatactctgatatttttcttttttccccacttgtatgactttttgtgaaagatccaataatatatctttataaagatatatatattttacaacttattattatgttcattcagagaatttttgtactgtaacttcaataatgttccattgaagattaagtaaaaacgaagtccagctgaaactttgctttgtattaagggtaataacattttacccacaaaaatatgaattaatatgtcatctcaactaaaatatggagataagccaaatttttcctagttataaaaaacaaggcaggttaataattgccaaggtgaaatggtcagtttatttgctctctaagaaaaacaaaagtattccctgaggtgcaaaattgtgaaatttaactggaagcatcgattatactctggacaagttgttccttttgttttaaaatcctctagaagattttctaatgtgtaataggcacttgttagctccattaatcgtattgtgtaacagtttcttactggaaatctgggttcatcatttcttctttccttctgatgtaactcaagcagttgtttgccatttgtcctgtggtccctatttattcactcagattccagtaaaataccaaagttttgttttctttctgttctttgttatctactggacttgagcactgacgatgtttggtcttcccattaaacatcttcctgtccttcacgtggacattttgaagattattaagggaaaggtaatcctgttgatttactggaaaaaagaaggaaaaaaaaagccagttagactgaagtgatttgcacacacacagaagaagtggaaattatacattcataattgtagagaattcaagctgctaatgttaaatttcaaaagcaaaaatatgggattattcggctaattcaataatgatctctgtggtaaaatgacatattttgaaatacaaacttatctttccttcttgtatgcctttagctttgtccccattcaagcaataatttagccttgtgttcatttcctcactggagggacataacattaacagcagctaacatgtggtatacttatcatgtgctaaacatggtaattttatcaactcactcagccacacagccctataagtaggtactgttaatgatctccatttcacaaatgacgaaactgagacacagaggtttaagtgacttgcacgaggtcacacagctaacaagaggtatagctgggctcaaaggcaatcctgctcagaatctgtcctcttttctactaaaggtagactatgctgtctttcggaaacttggctagcatcattacctcaggagaaacttgcaaaagttaatcaggcagtaaggactactctagggccaatactttgtggaggaattccaaaagccaaattttcttggagtaacattattccatggatgtactgccataacatggtggaagaactatcatcaggaaaggtcaaaattatggccaggtgcggtggctcacgcctgtaatcccaacgctttgggaggctgaggcaggtggatcacctgaggtcaggagttcgagaccagcctggccaaaatggcaaaaccccatgtatttttagtttctactaaaactacaaaaattatccaggtgtggtggtgggcgtctgtggtaccagctacacaggaggctgaggaggagaattacttgaacccaggaggcagagattgcagtgagccgagatcgcgccactgcactgcagcctgggtgacagagcaagaccctgtcaaaaaaaaagaaaaagaaaaaaagcaagaaagaagagttgtgaccttgcacaactgcaccaaagctatgaaatgagaatgagacctgagatcactggctgaaaaaagtacaagaaaagcatgatataataggacaacaagtacagtcccaccaagatcaggctgattaggctctcaaacacattaaacggacactgtcaattcttttttccttttccttttggaagacctttttcagagaactcttcaattaatacatcagttacagcacaattttcatccaaaccctctggaccctgtattgtgcctgccagattgaacacctgtccattatttgatacttgacccagtcaccgtgggaaggtttaattccagatcttgccgcctccagtccactcaagcttgcagcgaggaacatgtctacttaaggctgcatgaggaactagactcagacaaatgatcttatatccttgactgtattctaccagcataaatttctgatggttatattttccaaacttgactcccagttcaggaggcacccttttatgggacttataaaactccatgctctgattacaatgataacattttaaacttcaaatgtgccctttattaaaatatttagaacggagcgtattgtagatatcaaggaaaggggttgttaagaacagtcttcgttccacacaactagcagagcttcctcaggtggaggtaatcaaattccttcctgaaatgctggtttcaatgtcatctcaggcagagtcctgaaaaactagaaagtttatttgcacataacgtaggtctcagaaatttcaatggagaagcattttaaaattaataaaactaaaacagttttactagtgagttatcctaagtattcccattattgatgtaactagcagaaagtttacattaatagatgatcaataaatagttccaccttcacacacactttctgggaaagattctgacaatatgaactagaaaaataagggtaaaggtggataaagaaaaagaggaagaaaagaaaaattgaggtgctttgtaatgtgtcaacttgggtaggccgaactacagttcccagaattccttttgccttatgttttccattaggagcagttggcaggcagaaaggaagtggcagccatctttgcagctctcccatgctgtaacgtatctcgttggccttaagatagtggctaagcctccagctgtttcacttccctttggatataatttggagcctcgtttagcacattacaaatgggtctggcttctgtaggacacccacatcaaccaaggtcagaggcaacaagaactgacacaggtttcagtccgtcctcatagattccagctcctgcttctattacgctcatctactctctcgcttaactgcagttcgtacttcaagctccaacatcatccctggagacagctgcctttcaaagagtacttaaccagctcccacagttgcattaagtcaaatcccttatatatcctagaagctctgcttctatgattgaactctgcctgtaactctgaggctcctggacaggaaagtcgaatgcctcagaaggaattttgtcactgcaccattatttcttcctcccagagctctctgttcttttgctcacatctggattgctctccctctaggcctgctacatgaggcatgtaaaaagtaatactgatagacatttggcagatactcccaaatgtgtagcttcaggttccacacaacctatgtcctcccctgcatactagttaagataaaatgaaacgcttattcactactcatcttttcagagctttctcacctatgtgtttggatttttttcccctctgattctcaaactaattttagattggttccctagcaggaagagtacaaagatgttttctttttttttttctgccacaaaaaataaaaagtgttcttgctgaggaatatgtttgtttttctttctgtgtgtttgcaaggactgtggactggcatttattttatgcttctgaataataacatctttcttattaaagaagaatctccccagaaggtcacatgtcattaaaaaaacaattttaaccaaatacacgtaaattctaatagaaaacagattttttacccgtaacacatgaagaagaaatttagctatattgtataaaaatatgtagggaaaaaagaacacaagagctcgtgttaagtaaaaccacattttaaaatacgcctttaggaacacggaagatggaaggtatcagaagatacttgctttcattctactcctcggtgatgatgtatctgcttttttttttttttttttggatgaatttgcagtgtatcttttcatcctgatgcctaaatccagtctctatatgtacctcttttctccagtttttagacttttaaaatattatcttttcatgaagaattcaactaattggaaaatgcgtgattcctaccactatgacaatatctgaaagtagaatcctcagggttgcaagctattctgacaaaatttctgaactctagcagaaaatgtaaaaatatacatttgacaaaaatatatttgcccatttgaatttaaattttgtcttttttttactcagtttttatttcttagaaaaaggaagacaatctaaatataattccctgagatatagtttcctttcacttcaaaataactgtacattaggttgagagacaaaaaaattcattgtctacaattacacatactttctgattaatctgttggttagcccacatttagttcatcaggcacaacttatttttctgcatgtgcatttgggacaataaccgggcatatgaaacctttaaaatttacatttaaaaatttatatttgcacttggataactttgccaataactagaactccctcaaaaacaaaggctaggtccctgactcctataggcatgaccaagagtatactacaaaatgattcctctgagactgaaatgtttttttcctgcttccccctcagagacacattgtggaaaaattctagaacttttagaatagacattgtgtgcttgactccagcgatcaaagattctgaaatattgaggccctatttgagagtcatacacttatactagttttatttgttgttgttgtttataatctgaagaaatgaacttcagccatctagaacaaaaataattggatttgttggagggttacggactgaggtaagtagtacaatcagtgacagactgatacaagccaagggaaggcagaataaggaaagctccaaaaatctctcaaagatgtgttcttggatttattctgtagtatgcagcccttaaaatgttttaatttcagtggaattctggcctctgtgtctgtccatacaaatctcacatccctaagagggagaatccaattagcccagtcatcggtatttctttctgtttttttctttttctttctttcttccttccttccttccttcctttcctttcctttctttctttctttttctttctttctttcttctttctttctttcttttttttttttttgagacagagtctcactctgttgcctggctggaggatagtggtgcaatctcagctcactgcaacctccacctcccgggttccagcaattctcctgcgtcagcatcccacgtagctgggacttgggcatgcaccaccatgcccagctaatttttgtatttttagtagagatggggttttaccatgttggccaggaggtctcgatctcttgacctcatgatccgcccacctcggcctaccaaagtgctgggattacaggcgtgagctaccacacccagccatctgtgtatttcagtgtacacctagatatatggcacccacacactgaggccacacctttactccctggccccaaaatttttgtcaaatgtggctgctgggtgatctgttgtgagcaagaaaagctccatagtatgtgccattctcctactacaaaattaggaaatttcaagagaaatgaaaggtggggatctgtccagtttaatggaagattgcctggctcaataaagatgctcggcaagcctaagactgcatctccaatgactctttcaccaatgaattaaccataatacatgtacccttttctattgctgtgatgtatatagttgttacctttttatttgcctattctaatttctatgtaccctctctgaatgaaataagtcttaattagccaccagcccttctcctagcccatccaccaaggctagatgttctcctatgtatttacttctcttatatcacacatcactatattgtgtactggagcttctcttttcattccagggagatcaggggcttgttttttcttatttcaatatccacagcacccagcatatgcacaccacacaatagaagctcagaaatatttattatgcatggaatagtaatatcacctatttgtattagcatataatgtaaatattcaaaattggtaacgattaaacttgataacttacatgaagtgcttatgacaatgcctgatagaaaatatgcgataaattttcgtttccttctgtcttgaaacaatgtcatgattgtttaattcgttctgtaaagaaggaggcagcaggctggctcctgggattggtggcttacacctgtaatcccagcactttaggaggccaagacgtgtggatcatctgaggtcaggagtttgagaccagtctggccaacatggtgaaatcccatctctactaaaaatacaaaaacagccagctgtggtggcaggtgcctgtaatcccaactactagggaggctgaggcaggaggatcacttgaacctgggaggtggaggcaagatcacaccattgcactccagcctgggcaacagagtaagaccctgtctcaaaaaaaagagtgaggcagcaatgtacaaccaaagataatacatcatttcatgaagataattccaatgttagattaggaagctaccatgtccagcctgctgcatcattctttacagaacgaatgaaagagtcatgatgttattcttaataatgtagaactatttgtgaaatgtggatgcagtgaacgttgatgcagacaatacaatgcccctaaactcattttactaagattcccaaatttactcatgctttagcacaagaattttacatttcagttaagaaaggtgaaagaaacttctttaatctgtaatggaagaccttgtagcagaacaaaattgctaccaagaaagttgaaaagtagatatatataagaaaaatgtttttgtgacctggattcacaaagtctgggataatgttcttgctcaacaactatttaaattgggattccctgaaagcagagcctgagacaaagatttggatacaagtagtttatttgggaggtgattccagggagcataaacaagggtgtggtcaaatgaaatagaacagggaggaaagccaaaaagtacctaatgagtgggggtacactcatagacaactgaggctccaacctactgaaacctctgagagccccacatcagaattttcctctcaggtggcaggagaccaagagtaggtatatatccaccaaccccaggtccttgttgcttgagggttgcttctgtggtattgattccacctgttgtactatgatccttccacgtgtgctttaatccccagctcctcatttcttctctagagctaggttgattaccttcctctttttcactattgacttcaccctttccttccacagttgtttcccctttttactctatgaacaagcccaagtctattaaaccctagaaaattaaaatctctcttactcctgcctctagtaactttcctatttttctctccatttcaactatgcttattttttaagaagacagtccacactcactgattccacggtctctctttccatgaactcctcaattaaagccagtgacttctgactcctttactgcaattgcggctgcttacaagatgccacaacactcctcatggcagtttctcgctgaattctcaggctgctccttcttcctcaaaagttcttcttccacaggcttttataaaacccatccctcttagttctctgggcatcctccaagttttccatctttcctttatggagtattctttcctttttggtccattgaatgttagtgtttaacaactcccaaatatttcattccagctattacttctctctgtaactccagaagtgtttgtccagtagcctgttagctcagactaaatttattatagtctcttctcttcctcttccctccccttgggaagaaaggcttgccttcgaaagaagatagtgagttggcaaaaccagcatttactcacttcatttacccacttcaaaatcttgggattatcagagaacattcctcctcctcatcctgcatttccagttagtcaataagttctgctgattctaccttctaaatggtaaattctctccatcagcgccattgctgctgtcaccttaattcatgtgttcatcaccttggcataatctactggtatctcttagttgatcaatctgctcccagtttcttcctcatgcagaccatctgctacagagtataaaacattatcttgatgcaaaaaaagaccacattacttctctacttaaaaaggcttagaagttctccatcaagtcaacaatcaacaagctaaaatctgatttcttttatgtggtgatctagctagtcccagtgtcagtatccagaagccgctcaggtggtcccaatggctaaagccatcatgagccagccaacctggcatgtgtgggtgctttgaaatcaatggttaaaatctgagtgtgggaatggatcctgagaccttgtagccctaagtcagtattggcacagagccttctctgtaaacttaaattaagtgtcaacatttagaagtcacttactatgagccaggtactctctgaacacttcctatgtactaattcatgtaatctccagagtagccctttgagatatgtattattatttttaattcccattttcccagtgaggtgactgagacataaagagagcaagcaacttgcttaacatcatatatgccacgatttgacttgaagtagactgttctagaagcagggtcttatccatttgctatgggctttgttagctttacacagaggctgtggggttcccaggcttagaacataattccagcctgtgcagggatctagatgaatcagaggtgaagagtggaagaaagaagcagagtggaagcccaagccactgatggcaatctgaacttggagcgtaacatcaccaggagaatctttatctccacatcttcccaatcctctatagttctgtcatccaacacacacacagatacagacatacacacgcacacatagacacacacacaatccatgagaagctttcaccagatcagaagtggaattattgctgcagaaggtaatgatggatggccccagaccacatgagaatgtttttaaaaatgacaaaatattgggaatataacaaacaagcaaaaaaatgggacccatctagagagccacatgtggtctctaattcctccctgcactgtgggtttggaatgaacactggcccctaagaaccgagttagccatgccctgttcttctcttgaatataatgggaggggatgtcagggaaatggagatgtctcttctcacaatatctgctaatcaggattgttcagggccttgtgcaattaattttagctttcaaaaaagaaataatttctcagaactccatggtgaggaaataggtcatactcattagcatagtcatagaggaagaacagtgtttaataataggcctggctgaaataggctagcagtgaaactagaagggcaaaattattctgttaatgaagaattaatgaagattttcgagtttccttaggtaacccaagaagaaaggtgtgaaaaaggaaggagtgaatgagataagaatggggaggaggatgtgaggaaggaatacatcaagatgccagggagctgagcaagaggcagccagggagaagttctgggctatggccaaggatctttaaagagcaaggatctttaaatagtcagttttaagatgtttggtgcagcctaaattcctcttcctcttcccctgcctgaatcttccgtaagaatctactacacagagatgccttgtatctgcagcattttgagaagagggaaagaggctgttgctttgggaatgatgcagagtggagaaaaagaacagccaaaagaggctagacttgagagaaattacagtaattcagtaaaagcaggaaataatagaaaaacattgactccaaagatcctggaaggtgccagcaagtgaggttaggtttcccactgtagatgtaatggaaacatggtttccccaccaacttcgaggcttgagagcattcaggtaactgatacttgttctatgttagtaaagcggatatgtgtcttttgacaatttacatgtgaaataactgcagctgttttctaattgaatttcaaggctccattccatgggctcagagaaatctgattctctactgctttcagcatgatatcagacaatttagagtttctctccagtctgggggttgcatatgatttctggggtttggggtggtgtgaagttggtataatatcactacaactgtctattcttgctctagtcactgggacctcagcctgagggactacacagattgctgccgcaaatccccccgcttccttttcagcaatgcaagggaaaacatcacattcttttgatttcccaccaattcatcctctttccaccccggcaaattgtgggagtgggagcttctctgattttaatcttttttcatctgttgtttctaatattgctggctgtgacaatccgcagaggaaatgcatgcctacctctagtctgaatggggaaaaacaaaatccagtatataagaaaatatatggtacagtggctgtgcatggtggctcatgcctgtaatctcagcgctttgggaggccaaggtgggtggatcacaaggtcaagatatcgagacaatcatggccaacatagtgaaaccctgtctctactaaaaatacaaaaattagctgggcgtggtggtgcatgcctgtagtcccagctacttgggaggctgaggcaggagaatcacttggatctgggaggtggaggttgcagtgagccatgattgtgccattgcactccagcctggtgacaaagtgagactttgtctcaaaaaaaaaaaaaaaaagaaagaaaatatatggtacaaactaatacctacaaatatcattcggttacattggctttataccctctctttctattagttcaaaatagtactcataaaataaccatcctgtaaagtaatgaaactgaattttcttccattgctaatttctcctctgacctaacattaattatctaagaacttaagtgtttagtgctctacatcagaggtcaacaaactattgtatcgcccacagtctaaactcgacccatggtccatttttatatatttaagtagttgaaaaaaatcacaaatagatcgatatcctgtgacctgtgaaaattatatgaaatctaaatttcagtgtctacaaataaagttttattggaatataggcatgctcatttgtttatatactgtctgtagctgctttcattctataaccacagagttgagaagttgcaacagaatgtatagcatacaatgctgaaaatatttaatatctggtcttttacagaaaaagtttggtcaaccttgtaggggaaccagcccgctataccacccgcgggttctccccttcccagtggagacgagggaatgagaaaagaaataaagacaaacacacaaagttcaagagttaacaaaagtgggtccaggggtccatcgcaatgtggaaactgcgacagccctgagctctggattccactgatatttactgagtacagttcctttgatcctataggctgagggtgggcagatggtggggtgatcacagggtgaccatggggagaggtggcagagggggtagcatgcgtcatcagcaagttaatattatttactgttccactgtataagctaatactctatgtttaacttacagataatccttaaagtccaactaattggttaacagaacaggacgtgaaagcagacagcccgtcagaccacaggcctgtgcatcaaaggagcggtccactccaagcaccatcagcagggcagcagagctctctgcctctgggaacgagcgagagatagaagactttccccttatcctcagaggacttctcctcttttacaagcaacctcctgctgttcccttctggggaatggagcaggggtcgcttcccttcccacaagacctttgttcagggactcaagtgggaggttgagcaataagcaagctttcttgcttagaggctccgcacacttcctgtggttgtttgttccaccctgcagttaggcaagcaagctcaccgcctgattcttatattgtcggactaagcagaagctattcttatgattcatgactatattaataaagcactattctaaagcatattttgttaatccttaaacaggcacaccataggccagccctcaaccacctcggcccacatccaagcccctgttttgacccacatttcccccattttttaaatttaaaacagccatctcaatcataacttgcttgtggttttgattttctttcaggagctgccttccgcatctgcagactaaaaacagacaacataagcagacacaaattaaaacaaaattagcaatggcagagcttcccagagttttaatccatttgatagaattgagctccgagagcctatctgcagctccagcaagcatttctgctccaggcaacaaatttaagtgagcctgcgatgctgcaaaaatctgttcttttaatttagttatatccagggttagattatcttctcttccttgtaagtggcatcagaccttttcccactgatgttcagtaacattataagaataaggagtaatacaaaaagcagatgtattccaatcacattgcatttgcatacgatgctctaaatgcataaaacgatctcttatccaggtgactgtttgcctcaaatcattaatttgattggccaacttctgatcaatttttgcctgagaattccataatctggtggaatttttctgccaggcattaacataatgagcagtttgaatggaagaatgcaaggcaacacctgccacagccgcggtggtggtgacagcaatcaagcccataatcacagcaattaaagtaaaaataaatcttattgtacgattaagaatcccttttaaaactccagttattacatgaatagagggaaaagtctcccaaggcctattaagagtaactggaatccaaacgccctctcgtgctcggaccagcaaaatgctattcctcatatcaaaagtagaatgaatacaagtaaacagatggcaattgtcacaagtaatggtttgagagtcaggtaaaatgataagttttccaacaactaacatgtaaggaggtttaacacaactttgaagagaaatagactgattagactgaagaagcatggtaaacagtagcttattacctcttgttccccatgatgcttcccctttccacactctcattccggaggtagccataagcaacttccacaattctggatgttccagacccatgactggactaattatctttggccagggaggagcagtacctttatcttcccatttcaatggatatagtgattccaatcttctaactaaagtggggggattattgggactttctctataatctatcatgaaggaatcctcagcgcacccagcattttgtccagtgcaatttctggcaaaggatcctttgggggcccaatctataattattccataagaatccttttgcaaaactactgcaccatctgctacacagttgtcccaagcaagaatctctagtttttctgaccattttggatttcttttaggacaagccagtccttgagatttgtaattttttacttttaaatttgaccgaaaataaccatccccataagtttttacagtcatgataggttggaaagacattccactcactacgtgataactgggttgggaacgattatgaggaggtacatagattatccaactatgtatttgcaatggtaaacatcaaggagcaattcctaaacaaattggagggtattcataccagttacattcatcaacataccctccttctcaggctgtgcaggacagccatcatcaatcggcccaggcatccaaaatactatcatttgtataaacttcaataggggaatccatccaagtaactggcctaattaaaggaggaaatggaacagaagccagtatgtaaaattttcttcagtccagacagcagggagacttaccgccgcggtaattaccatcaaggcagccaagatcatattacccgggataattgccagttgtttctcctttaggctgccctctgccatttgagtcagcttctttatctgttctcatgtcggtggtgtagcctggcgggtcttctccgtcttctgttgtttctctgagacgctcagcttcgtcatctttctcagctcccgaaaggacaggtcggagggaccagtcttcttcctctttggattcttccctttcttctgtccggtcggtgtagggttcattgcagaatttcaaatgtctattgggtatctaaatgggtgtttgattgtctcctggtgaaacacaagcaaaagcccttccccgcgtcataatttttcttaattcccaagttttagttctggtatccttccaccagaccgtttttccttcatgtaaattaactttctgtccagaaaagtgttgttccgctgctgtggagacctgatctctggaaatgttcaaaaaatttagagtcaaaagggctaattgtaactgcctatggggcgtggtatactccttactgcttccccctttcttttgtttttccaattgtgtcttaagagtccgaatggccctttctactgtggcctgaccttgcaaattatagggtattcctgtagtgtgtacaaatttccattgctgaacaaaactttcaaaagttttactgcaatatccttgtccgttgtccgttttcattttctgtggcacactcatgactgcaaaacaagataataaatgtcgttttacatgagctgtactttctccagtttagcacgtagcccagataaaccaagagaaattatcaacagtaacatgcacaagagaaagttttcccagtgatgggacatgagtcacattcatttgccaaagagcatttggtttaagccccctaggattaactccaggttcttgagtaggtagctgtagcacctggcattgcggacaatgttgcactatatttttagcttgtttccaggtaaatgaatatttattttttaatccagcagcatttacatgagttaatgaatggaattcttgaggctctgttaaaacaagtgtcactaataaatctgcttgattatttaattgggttaaaggtcctggtaaatttgtgtgagctagaatatgtgtaatataaacaggaaaatttcaaactctaactgcttgttgaagtgaactaaacaaaaaatttagctgatcatcagaaatatattttattaaagctgtttttaccattgttgtcgcctgaaccacataggcagagtcagagacaatataaacaggttgatcaaaatcttccaatacaaatataactgcttgtagcttagctctttgtggagaatgaaactgggtttgaataaccttttcttctggtcctgtataagctgcttttccattctgagagccatcagtaaagacagttacagccccctccaagaggatagaactggttattttaggtaaaatccaggtagccaattttaggaactgaaaaatttttgttttagggtaatgattatctatatggccaacaaaaccagctaaattagactgccattctgataaatgtataaaggcttgttgaacctgtgctttgtttaaaggaactacaattttatctggatctgtgccagtgaatctaactattcttaattgggcttggcctataagaatagctatttgatctaagtaaattgaaaaagtcctagttgtactgtggggtaaaaaagaccattcaaccaagtcaacatcttgaataatcactcctgtaagagaatggagagtaggaacaccaagagctgtaagggaacactaggatctattctactgacttgagcactttgaattttttcctcaattattcttaacagctgaagctgttgcaggcgtcagagttcttttgctatgtaaatttggatcccctctcagcaaagcaaacaagtcagacctcgcataagtggcaattcctaaggtgggccttatccaattaacgtctcctaataatttttgaaaatcatttaaagtttttaaggacttcttacgaatttctaccttttgaggcataactgttctctcctccaccttcattcctaggtaatgatagggtgtagtagtttgaattttatttggcgctatagcgagaactgtaagccccaccatttcttgtaacatagaaaaacatttgataagtctatccctacttgtagcagcacataaaatgtcatcaacataatgaataatattaacaatcaggaaactgatcctggacgggctgaatgaccttcccaacgaaagtttgacgaattgtaggactatttaacattccttggggtaaaactttccactgatacctagtagctggttccttattatttatagcagatattgtaaatgcaaatttttcaaagtcctggggatccaaaggaatggtgaaaaaaccatctttcgaatcaaatttttttttttgagatggagtgtcactctgtcgcccaggctggaatgcagtggcgcgatctcgctcactgcaagctccgcctgccgggttcacgccattctcctgcctcagcctccggagtagctgggactacaggcacccgctaccacacccggctaattttttgtatttttaggagagatggggtttccccgtgttagccaggatggtcttgatctcctgacctcgtgatcctcccgcctcggcctcccaaaatgctgggattataggcgtgagccaccgcgcccgacccaaatcaattattaccaccggccattctcttggaatcatgactggggatggcaaccccggttggagagcccacatcggttgaatgactgcattaaccgctcgtaggttggtcaacatgcgccatctaccggattttttctgaattacaaaaaccggggaattccacggtgagaaagaaggttcaatatgtcctttgtctaattgctcttttgctagtcaatgtaatgcctccagtttttgctgaggaggcggctactgatcaacccacacaggtttttgagttttccatttcaatgggatgggctttggaggctcaacagtggccgcccctaaaaagagtacccaattccttttcggtcaagtttaactgaagcttcaattggctgagttattccatcctcattctttcctaatgtttttccaggagtataccccaacttagtcatcatgctttgactctctgaactgtaaatcatagagggaatggtgatttccgtaccccactgttgtaacaaatcttttccccacaaattaatgggaatggcagtaattataggttggatggtgccttcctgtccatctggtactaaacagtgtaaaattgtaacactctgataaacttcagatgccatgcctattccaattaaacccatagaagctctctgtttgggccatgtttttggccactgatccagggctgtaacagaaatattagcgcctgtatcgacaagtccttcaaagagttttccctgaatcgttattgtgcacacaggtctattttcagaaacttgacttacccaataagttgcttttcctttgctatcagtgctgccgaaaccaccttctctttttactgtactttctcctacttaggtaataacaacaattaggtaataaggtaataacaacaattgagcaattctctctgcctggcttgcactccaaggaatactagaactaataaccaattgaatttctcccacaaaatcggaatctatcactccagtataaatttgaactccttttaaatttagactaaatctccctaaaacaagtccaactgttacctcaggtaaagggccaaatactccagagggcaccttttgaggtggttcccctggaagcagagacacagctctggtgcaacataaatctaaagcagcgccccctgttgtaactggcgccaattatgttactgtggtggtcacttgagggattaagggcactggtgcccactgacggacaaactgctggagagggaatgccccagtttggagtggggcctgaggctggcccctcttcccatttcccaattgcgcctgcaagggttggccattttcatcaaatttggagtgacaccgtttagcccaacatttacccttctggcacctgggacataagccaggtggctcctttgtttgattagatctggattgtttgtttgatttgttcttatattccttttttgtatttccaaattgcccacagttataacaattgcctgaaaagtttttcactggatctcccacctttgatcctgccatgttttgagccattatcatagccttatgcatgattccaccaatctatcacatgccctgatatactcattgattacatcaactcccaccagaacctttcctttcacagagcgaataggtgattgacagtcagggttggcattttcataagccaagaattctataatcaccttcctggcactttcatcagtgagagccttctgagctgcatcttgaagaggagcaataaaatcaggatacggttcttttgagccttgtctgacagaattaaaagagggataagtagttcccgggtcctgaattttttcccatgccctcaagcaacaattgcgaatttgctcaacggcatcatcctgaagcactaattgttgtacagttcctcattggcccccaactcccaacagttgttcaagtgaaatggcaacaacaggattagcagcacggtttttttgatcttgattttgagcctcatcggtccaccaacttttaaattgaagaaattgggagggcgaaagagtagcttttgctaaaatctcccaatcgtccggggccaatcgcttgtcctgagttactgagtgtaatagtgactggacagaaggcgaattgggaccttactgaccaacagctgctttgagatctttaagcagcttaaaagaaaatggttcccataccgcctgatgggcaccaccctgctgctgtgggagttccaaaactactggaaactgccaggcatcgggatctccagctaacctagcctgccgaataaccatttgaaatggtgattcattgacattaggtggcagtgcagccctatgctgtactggtgctgcaaaacgtgttcttgattcctgagcccctaatttatccattcgtgaaacagggcaaattggagattcaaacctccaaggctccaggttacgttgccttattggaggtggccactccggatgatcccaatgaggagccaaagattcctcaaggcccttctttgttttaaacatattggcataaatagcttctctattttaggagcagctggaggtcccacatgctcctcaaaagaaattaagtcatctccaggtttgtctgtactttcctcaaaatcttcttcactatcctctcctccttcaacttcctttatatttatattggcggcagcaccgccttcctccgctggaattctttctgccggaggataaacctcgttttccatttgaaacggttccaaggctgctttaaccatagcccagtctgaccagaccgttagaagaataagttttccttccttatgaacttgttttaaggcaattccaacctgctcccaatcttttaaatccatggtaccttattcaggaaaccaagggcaatactgctctactgtttgaaacagagtaatcaagttttctgtgctagcctttattacccccctctttaagaggagtttgataaagtgtaagtaagcagagtgcttacttcccgattgtcccatggtgtccctggaatactccgagcacacaagcttaccgcaaggccgaccacacgttcttgggagtccctcgacagactggtctccgcaatgaccatgctcaggtgtaactccacctgggtacaaggagcccacactgggtgccaaagatgtaggggaaccagcccgctacaccacatgcgtgttctccccttcccggtggaaatgaaggaatgagaaaagaaataaagacacaaagttcaagagttaacaaaagtgggtccagggttccatcacaacacggaaactgcgaaggccttgagctctggattccactgatgtttattgagtacaattcctttgatcctatgggctgagggtgggcagatggttgggtgatcatagagtgaccatggggagaggtggcagaggggcttaacagaacaggatgtgaaagcagatagcccgtcagaccacaggcctgtgcatcaaaggagtggtccactccaagcaccatcagcagagcagcagagctctccgcctctgggaacgagcgagagatagaagacttcctcctcatctctaccgcagaggacttctcctcttttacaagcagcctcctgctgttcccttctggggaatggagcaggggtcgcttcccttcccacgagacctttgttcagggactcaagtgggaggttgagcaataagcaagctttcttgcttagaggctccgcacacttcctgcggttgtttgttccactctgtggtcagtcaagcaagctcaccgcctgattcttatattgttggactaagcacaagctattcttatgattcatgactatattaataaagcactattctaaagcatatattgttaatccttaaacaggcacactgtacgctggccctcgactacctcggcccacatccaagcccctgttttgacccacaaacctctcctctataccagtgtgtttcacccgctatcagagttttacttgtttccttatctagattggggagagtcttggatagaccggcctgccatccaacgtccttggtttttagccctggaaattatttagttcttctggtaaggagagggcattttctcttacctggttaatctgaattcacgtgtgttttgctagttctcccctgactttgggatctttctcatggaaggagaaatgcaatgtggaagcctttttacggtaaaataaaaaattataaggccaaggtgggtggatcacaaggtcaggagatcgagaccaccctggctaacacgttgaaactccatctctgctaaaaatacaaaaaattagccaagcgtggtggcgggtgcctgtagtcccagctacttgggaggctgaggcaggagaatggcttgaacccgggaggcgcaggttgtagtgagctgaaatcgtgccactgcactccagcgtgggcgacagagcgagactctgtctcaaaaaaaaaaaaaattataatatatacagctgtagctttcctacataatgccgtgaatttaacatgaatcattgtaaccccaatcatgccacatactcctctgctagtccgtatggatgcatattacaaatctagttgtcacctgcagatctctttatttctgtgaataaaaacttatttgacccagaaaccaacttttataaaatcactccagattattccttataaccatgataattttgagtccttatttcatatcattttgttttgattaacagcttttttaaagtgaaagctgaggtttaattttcatgcctttctaacatttttcctatgaattaggaaacaaaatctgtatcagcccatatttccatatttttggaactccctcacctaattatccaatttttctacttaattaccaacatatatctagttacatagttctggtttaactgttttggtatagtgctggtgggaaacaaggaaaaagatgtggattattttccttgtagttttaaaaaatggttactcatatctctccgtttaaacctctccaacttggtgtgtcttgggaaggaagcaatttactcaagattttactacatgattgcagctttgaccacattttcagtgaatagagaagatgacgtaaaaacatacatacaagaaaaatacaggaagaatcatgtagtaatcacaactctgtagaagtaaagccatgtgaaaactgatgaaatgcaactatagatgaaattgtcagaatcacgaaggttacatccattaaatgagtgatttttgaaagaaaagaacataaattggttatgaaggaagaggcagttcagaccgttacaaacgttaatattgtatgtcgacggcagtaattaggtattttcaaatctaataataaagaatcaaaactaggcagtaatgagagatgttctgataattagatctggggaaaacagagcaaagtaaaaagagccttgaaacattacttacgcatgtggatttgatagaattcgttgacataattatataatggctggttgattagattatatacatcaacttttaagtttttgagcaaaagagttatgggagaaaaatctccctccccaaactcccgaggatgcttggcaatcaatgtcaggagacatttttggtttttacaatggacaggggtttgctctaggtatacagtgggtagaggccagggatgttgcggaacctcccggaacgcacagaaccgccccacaacaagaatcacccagcccaaactgtcaatagtatcaaggttaagaaactctgggctagattaaaaggtagagaagttaaccgtgctacaatttaaccaaaaggtgtaagaactaggtcagaggcctccaattagtcctttgtttggcatgaccagtctcttcttccattaagttacccagaaagccaagttatatttttcaggaatattcaaaaattaattttacgttctgctcttaataaatttggggtttatacccattaaaatggatgagtcgcagaaacacaatgttgaatgaaaaaagcaagtaaagcaaaaatacattcagtatgatatcatttatataaagcttgaaaacaagcaaaataaaacatattatttagggatatccatagttacatgaataaaatgaaggaattcaataacattgaattccggatagtatttatgtctgcaaagaggaaagagtttgaagaaaatgtggcagggagcagtccttaaacatcttaagttcttttttttttttttgtttttttgacagagtcttgctctgtcaccaggctggagtgcagtggcacaatctcggttcactgcaacctctgcctcccgggctcaagtgatattgtcctgcctcaacctacctgggattacaggctcgcaccaccacgtctggctaatttttgtagttgtagtagcagcggggtttcgccacgttgccttgtctcaaactcctgacctcaaatgatccaactgcctcgggctcccaaagtgctgggattacaggcataagccactgtacccagacacgttttgattaaattctattttcaaagttaggttgtgggttcttgagtgtttcgctcgttattgtactttatgtatgcatgtatgtatgtatgtagaaacagtttccttaagttcctcaggctggtctggagctcctggcctcaagtgatcttccagcttcagcctcccaagtagctgagattacaggcatataatgcgcccagttgtcagtattgtactatagagtttacatgtatgttatatattcttttgggtgtatcaaaaaatcacataataaaaacaaataacatgcagttataaagtagtggatttgtccctgaagatttttcctttaagttctgtcaccatctgcaggttaaaactaggtattgcagaaaacttgtttttcaaagattaaaaagtacaaacggctggatttctgttacagacatgcttacaatccatctgtggataaggagcatacagaatacattaaagagataaacattatagcaccaagtgttttgttttttttttgagacagagtctcgctcaggctggaatgcaatggtgtgacctgggctcactgcaacctccacctcctaggttcaagcaattctcctgcctcagcctcctgagtagctgggattatagtcacatgccatcacacccggctaatttttgtatttttagtagagacggggtttcactatgttggtcaggctggtctcgaactcctgacatcatgatccacgcgcctcggcctcccaaagtgctgggattacaggcatgagccaccgtgcccggctgtgttatcttataagtaccacctggttagtgtcctaccaaatatcaagaaacagaaatagtattttcacatcataacaactgatttagtttatgtgaataaaaatttaaatcccttactttattcatcctgctactaccttaggccaagccttcattacttcatgacaggttggcacctgttctccttgtcttcttttcctagtctttacaaaacattgccactagattgaagtcttcaaataaccatttcattacagcattgacctcttccaaagtctcaaatggtttcacactaactgaagaacaaagtccacactctttagataagtagttgactttctatagtttggccccaacctggtaataaaccttgccttctcccacctccccatcacttaccatatataaatcctctacttcagccagtctgttttttgtccattgcttactctggatgtgtgatctgtgttcttggtatatcccacttccttgaacatcattctgcaatttggaacttccaccccctgcatatttaatacatgtgttaggttgttctcttgaatgtggaaaactgaaaggcagtttcaatgtttatctcttagaggccattcttctgtttcctatctacatttccacagactgctgcccctaatttcatcctacctataaatcctagagctatcattatctctgagacaaaacatccctattttaaaaatctaaattaccacagcaatcagtgtctacatcatttgtttggcatagtgacggactattaacactaagtcgattcattctgataaagtttgtttctaaaaatagatgttaaatttctgaaagccaggtataattttatcgcttcttgttttttttctttccttcttcccttacaaagatcagtaatgctcatatttgagtttgagatccccttttcaatgtaaatatttctcaaattcctcttacctcccaacaaacaatagtattgacattctggggcttcataaattcagaaaacatcatgactagtagatattataatttcatgcttttgaatttattagaattgttttaatgataacagcttctacatttcaatgtaaatatttctcaaattcctcctacctcctaataaacaatagtattgacattctggagcttcataaattcagaaaacataatgactagtacgtattataatttcacgcttttgaatttattagaattgttttaatgataacagcttctacatacgtttaataataatacatatgtataaagcaaaataatgatgatagctaatatttcgggcctcaacatatactagtgtttttatatgcgttgtatttaattaaaaaaaatcttaaaggaatcacatagacctccgtttaaatttaggctctaccacttgcagctgctacaagtttgatttatataatctttcattgccaaaacgggtcagattcagaaccagcctcttcagggtaactgtgaggatcaagaaaatcacaacagccgaagtgctttacagtgtgcctggcataaaacaaactctgagaacattttttaaaaaatcctttcaaggtaggcagtatcattccttccccctcatttcatagatggggcaattaaggctcagaaaggcacgtcgcttgtccaggatcttggagtggtggaattaggatagggcattctggactacaataaacacctgagcgtttagctgctgtgttctgagctcccacagcactttttcttacaacacaaactttatttacatcacactccacttccgcatccttcactaaaatatgagctcttcaagggcagggactatatttttgctaccgcagtagttagcgatacacacacagaatatgaggaaaaagtgtctgaccaacgatcaatgcactcacgactgaacctacggtggcagattgcagtgggatagaagagctttatgtgaattgcgtactgagatgcagacctactattttgggaacaatttgtttttgttgttgaaacccagaatgcaattcttctttttacctttattttgcttaaaaagttattccataattataaactgcgtaaaactagaagaatgcccttgcactcaactaaaactgacaggtgttttacctttccagtcaggcacattgaaggccttgtgactttattgatttttgttttttaaagggaggacctgccaatttattaatcttaatagagctgtaacaggagagtataaataaaaagatagttcagagaaaatttactgaaattaagtttggattaaaatcatctggctcttttaaggaaaagggacattaaccaaaagtggcgttaactatcaacaatatttatgattctctcactcagtagatacataatgacgtctggcaaattgtttaacttccgtggaacaatcccctcatatgtaaaatcaggaggttggactacattgtaagtgtccttttgtttccacctcttcgtgaccgaatgtggggtgaggaaggggcaaaaaagcgatcccggtcttggctccttcttccggcacgggccggagctgacacccccacggaaaaccgcacagcgcctccgctctttctccacgggctgagggatcaatgcacttccgcataggcctagggccccacgctccgcgatcagcgccggaagcgcacggcatgctgggatttgtagtcctccacctgtggccggcaggcgtttagaacgcgaggtctagttggcattctgggatacatagttcctgggcgggtgggggcggattcgttggtgtaatctcttttcggcttaaagagccagaagcgacaccacagactccggcgggtcacatgactccagtctagctcgcattgcggctcccgcccgggcgagttctcgcccccgcgcggccgttgccgaggagacggcgcatgtcccgccgcgcgttgccccctctgcagtacccccgcccctcttctcccaccacaatgagatcctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggtaatgcctgcgcgtccccagcccttggcaacctagggcggcgcgccccagaggcgggagagtaacggctccgggacactcggccctgttgggtctggccacgggcccacgcctcctctgtaggttcccgggtcttcctgccccgggcttcccgtgccctaggcggtcagtccgcccgctccctcaggactgatcgccgggatccccgggtgagcacctcgcgacgcgttggtgattgcaggactcccttcttgcctcctcgcccctcctgctggccctgtcggggaggctgttctgcgtcccggtggctccggctataccccttgcgggcggaggaagcggagcggggactctggtttgggtgctaggggcactgggtcgagttcttagagaaacaggccttggtggccatagttcttccccgcgttccctctgtggaactctcggtgtccagagtttggggtgtagaagggcggatgaggagcgacgcgactctgaagagttgcagttgggctgtgagctgcaggatttccgccgtctctggtgctgtgggagccgatgggccgggggaggcgttcctgggaaggttaatggagtaattattgccccttctttctcccttcctacctatctagttagaattgggcctagaaccgggaaagactaaatgccaagtgggactgggggaaacgttgtttggtttacagaaactggcgtttggggattaggccccgccagggaggctgggcgcgccaactttgcatccctcagcctactccccaggaactcgcctggtttaattttttttgttttgttttgtttttttgagcgagttgaggtctgtattgtgtgtcttacgggtgacggttcgtgtttgggcgctggaaggagcgggctttctgggcgcccctaccacccccgccccataaccgctttccagactccgcctgctggtgttctctggttaccggagtgggtgttgcagagcctcgggtgcacctgctcctttctttccctagcaccttcctggtgaggacccctgaacaccaatataatacagagtttttgaattgaaggtaaacctggtatttatgtagtgacgaggttattttattatgaagtacagtagcttttaaatgagcaaacatttttaaaatcatcggatatacgaggttgttacatagtttgagtaacaggaagctcgatcaatcagaggagtaaactttggcatagactattaaaggatagttagggctaaccatctttgttacactgttccgaaatagatatcactttgctgtttggtaagatttcagaagtttaggggatttaagcatttatgcatatcacactattttccaaaagaattgaggtaacttaaatttaaaatatgaataagttatatttttccccttcttttgatctttctaaacatactttagaccaaaactgaagtattttttattctgtatttcatagcgtaagtaatttacttaagtgatacatatttttaatcctaattaggaaacagctttgaagtgtggagcgggaaaggagcagtttctgagctgcaaaaactagtttctaaacaggtaatttgacattattatctgtattatcctttgtattagagttggagaagactttatggtggacactgctgtcacagttacagtgcatgactgaggatcctctctgcttagtaaacaaactttctgggttcaccgccctgtttgctctgcttttcggcgtgctgctttggcctgccggtatatctttgttcggaaaggccctgtcattcctaattattaattactagaatggtttatgcagtaccgtttgaaatttatttgtcttcacagaattttttcaacctgtttgaatttgtcctataactggatagcctctctttccaaatccatttaatctcaagttctctcctacaacattcctattaattggctgttcatgaactctacttgtcgaacttgttataccttgaccgaaatttagttgtctaaaattactttattattattttttgtacttcgatctccctttcctggtataaagttacttgaaacattacttttagcgcatagtacattgtcacatgcaagtgacataaaggtattctctgtccagcagaataaagtcagtgttgtagaatgtaagttcactaggagaagttcaataattgtttgcaaagggcagtttggaaaaatggctaaaagataattagaagtttgttaaaagctttttagaaataattgctcttcagaaaaaaacctcagaaataaataacctaaatttaattctactcttaaaattttaagaaagttcattttgaaagttttgtagaaattggctgggcgcagtggctcacgcctgtaatcccagcactttgggaggccgaggtgggcggatgacgaggtcaggagatcaagaccatccggctaacatggtgaaaccccatctctactaaaaatacaaaaaagattagccaggcgtggtggcgggcacctgtagtcccagctactctggaggcagaggcaggagaatggcgtgaacctgggagcaggaggttgcagtgagccaagattgtgccactgcaccccagcctaggcaacagagtgtgactccgtctcaaaaaaaaagaaacttttgtagaaatcaatatatattcttgctttctacaaaagcagacagatttttattttatagctctcctatgaggacctgaaatgagactgtcatgagaaaatacgaataggtagttgatgtatatcttaattataattctcagtgggtttttttttttttaaactggaagactaacaaaacagggcaagaaaaatggaactcaagggaaaggtcacatgtgaatgtgtgtgttagagttgttaatactacagtgattgctgtatggtgggctttagtaaaataaacaataattacaaaattagttataagattttccttttagcacattggggaagatgatggataagacgaataaaaataaagggtaattgagttaacttaaattggaagacctgggttttttcaataggagatttggccatttttttctgaaggaggaaagtggatttgagacttggagaaactagtaaggctgtgagattcacagtacagaactaagaagacaaccagaaatacctatcagtactttcatttttacggatttgagtgctaggcaacgtgctatgtaatgactactacagataaaacagtgtgcaaaacagacagggtgcctttcttcatggagtaaatttacattttaaaagtatctatgtgtatgtagagtgtagtatatcttaatagtgatcacaggcaatgccattttatgatcatttccccactttttgacagcttgagaatagtagcagagaaaacagacagtggagtttagccagaattgagtcgacacagtacgcaagtaggtgaggaagtgaaggatgctagctagcaaggcatttttgcaatgacttagttgggtttgggtttgagtaaagaatcaagggattgatggatttagggagagagaaacgatcaaggggctggtagtattcaggaaggctaagagcagtttcagcaggaatcaagtgagagaagtagaatgcaaaaacttatgatcagaaagaggaacttcagaagttcaggatcctgaacaaattatcagttcagtattggaatagagaagatgagatggatattggaattgaggccagagtcctagaaaagtcattgcaagtgtttagttcatgcaagcagggaatgaagtagaaagtgaaaccatgcgccagttactgtcaggaaaagtacaggcatatcttggatattttcagaggtgattatgagtaatttaatgccatttgagaaaaaaataatttttttcgttactgatcactttgatttttttttttttttttttggagacagagtcttgctctgttgtccaggctggagtgcagtggcattatcttggcttactgcatccctctcctcccgagttcaagcaattgattctccttactcagcctaccaaacagctgggattacaggaacgccccaccacacgtggctaatatttgcgtttttagtagaggcggagtttcgccatgttgaccaggcgaatcaagtgatccgcctgcctcagcttcccaaagtggtgggatcacaagtgtgagccactgcacccagcctgattatttgattactttgaatttcttctttaccttatattcttatttcaaaggtaaactgtagtcataggtattttcatggtaattaatactgtgatattctactgtaatatgtctctatagttagaatcctgcaacgggatgttcttttttttggcgatggagtcttgctctggcacccactggagtgcagcagcgcagtcttggctcactgcaacctctgcctcccaggttcaagtgattctcctgcctcagcctccctagtagctgggattacagacgcgtgccaccacgtccgactaatttttgtatttttaatatagatggggttttaacatgttgatcaggctagtcttcaactcctgacctcgtgatccgcccgcctcagcttccctaagtcctgggattacaagcgtgagccaccgcgcccagcctaacaggattttcttaaaaaaaaaaaaaaaaaaaagtcattgaaagtagcttaaaattgccatagtatattttcatttttgtgtctttgtaaaaaaaaaaaaaaaaccactaaggctgttaaaaatagctaaatgaaacttgaaagtaacagtttcaacttcgtttagtaaggcatagcatgagtagaagtgcgtgtttaaagtagaaggattttatttttatccccgttcagctacccgtagtactgtcatcaatcacttctaccaattgttttcctacagtttcaactttcttatcttactgtctttctgtttaacttgcatggcaaaatttcaaccttgggtggattcagtggagtgtttatattgagggatatgagcactgctggaaaaaaatatctgtagtatgtgttatatgagtgaatagtctctcgtttccctgagtccgtagtgctgcccacggtcattctccattccctacttttctacgctctctcagacactgctgtctcaccctcacatttaatgtacagtccttcctacttcacaacacttaggaacacctttggtttcctaccaccacatctgctaagcagcctccaacccattccatcctttcttggtttttttcaattaaagagatgttcttcttcctctctaaagctaatcatttgtcttttgctctagaccccaatggcccccgctttctcagagcccacatgctagttgcttatctcctttctcttctgcatttttagtatctccctcttttttttttttttttttttttttttttaaagtgaggcggagtttctctcttgttgcccaggctgagtgcaatggcactatctccgctcactgtaacctctgcctcccgggttcaaacgattctcctgcctcagcctctcttgtagctgggattacaggcatgtgccaccatacctggctaatttttgtatttttagtggaaacagggtttcgcagtttggaacaggctggtctcaaactcctgaccttagatgactcacccacctcagcctcccacagtgctggtattacaggcgtgagccaccgcacccgaccagtatctccctccttaccaacaaattgtaaacgtactcaagatacttctattttaataaaactttccttatgaccgtctgtgcttgcttctcatcataggctgattccttaaaaatattagctaatgactttctttattttttccctcttccttccaataatacattccagttatggaattgaccctcactacccctgctgaaatttctcaccaaagtcaacagtaaccttgttgctaaatctaggaggatacttctcagtacttctcttatctggcaaggtaactgtttggtttcttatcacattctacttgatacacttttccccttttggcaggctctcctggtttccctcctgtctttctgtaccttattagtgtattagcgtgtccttttcctctgcctctctatttaataccagtgtatttaagatctggtcttctcttactctttatcgtctccctgagtcctctgtcccactttttgagtggatgactctccagcccagatttctctgttgagagatagatcgctatttgtcaaccggacaattttattgggtgtattataggcacatcaaactctccatttctaaaacttgaactcatcatcatcctctctcaacaaagaaaacttgtttcttttctgatcagtttaactgtgtgtcacatacccagtttctagcaacctttatcctttatcttttaactctactatcctttaactcttctgcttctttatcgcccgtgttgtaatacagtagtctgccctattctgtgtgggataccttccagagacccccagtgcatgcctgaaactgtgggtagtaccaaactctatgtgtatgttatttcctgtatgtatgtaactgtgataaagtttaatttatagattaggctcagtaagagattaacaataactaataagacagaatagtcacaacagtatactgtaataaaagttacaagaatgtggtctctgtcgctcaaaataacgtactttactcaccagtttcctgaccatggttgactatggggaactataatcctgtaacacaaaactgcagataaggtggggactatagtcaccaactcctattgatcctgcacagcagttttgcttgaattggtattctgtacatccttagtcttttcgttattggaatacttccttttttttttttttttttttgagacagagtctcgctcttccgcccaggccggagtgcagtggtgttatctgggttcactacaagctccgcctcctgggttcacaccattctgcctcagcctcccgagtagctgggactacaggtgcccgccaccacgcctggctaattttttgtatttttagtagaggtgacagggtttcaccgtgttagccaggatggtctcgatctcctgacctcgtgatccgcctgccttggcctcccaaaatgctgggattacaggcgtgagccactgcgcctgaccgttactggaatactttctgtacttgtaagtactagtttatattaatgtgtttacagaataaaatttagaaggcagagattctgtatttgtaatggtgacatttaggtggttaaagaggttgacatgaagagaaataacatgccattactcttatgagggagatacttagtatttttgggaaatgttgtgaatgtggccgggtgcggtggctcacgcctgtaatcccagcactttgggaggccgaggcgggcggatcacgaggtcaggagatggagaccatcctggctaacatggtgaaaccctgtctctactaaagatacaacaaaaattagccaggcgtggtggcgggtgcctgtagtcccagctattggggaggctgaggcaggagaatgacgtgaacctgggaggcggagcttgtagtgagcccagatggcgccactgcactccagcctgggtgacagagcaagactctgtctccaaaaaaaaaaaagaattcatccatatgcaattatttctttagcttcatactaatagttttactttttaaaggcatactaatgctgtgccttttaaacacatttggtgtcatcattaagttacaaagtattctaccccctatggcaatcacagtgtaacagtggatgaaattgttcattttgccaacctgatagattagactttagtaaattttgttttaaaaaatactaaaaaaatcatctgtttttcccaaactaattagagtgtacagttttaaaattgttttagaaacttattttagtagtgttcaaagtcgttagccagaaataggtctttggaacaagctctgcattttagggggaatttattgtgatagggaaatagaatgcgtaaaacattctttctccagatatattcttttttttttttgagatggagtcttgctcttgcccaggctggagtgcagtggcgtgatctcagcacactgcaacctctgcctcccgggttcaattgattcttctgcttcagcctcctgagtaactaggactacaggcgtgtgccaccatggctggctagtttttgtatttttagtagagataggatttcgttatgttggccaggctggtattgaattcctgaccttgtggtaacgccgaccttggcccagatatattcttaatacatttatcttactttactattacttcattattctattaatagaaagtattgctaacatactcttttaagataaaaatgatatgtaataattttgacttaaatatcttaattttcccttccaatttacgtttcaaaacaattgcttttagtacttttaaatatggcatcacttctgttgcctggctgttttattcttcagtattacaaattatgtcagtatatgtagaatacagtagttgcaaaatgttttatttaaatgagtcattttggttcactggatatacttctatgggtattattttttaaagttttaaaatatatttctagtataaataattacgtaaactgttcctgaaaatatgagacagaaaaaaagaagaaaaatcaccagtgcctaccctgtaaccaataattgcttttgtgaaagcactttaataaagtttcttagcttttgtttaaaaaaatttatgtataatttttcatactgcttttttacttttttatattactttttccatgatacaccgacaggttatattgtccaggcttcataattacatattttgaagggtacttagtattctacccagcaagtgtagtacagtttgcctaatagcattgattttgtcatttgacatttagtgttgttttttaatttatcacaattatagcgtaataaacaacttcattatagttctttccaccatatttaaggttgttttcttagattgcatatagagaggtagaattactgcgtcaaaaattcagttttagttcttgatacagtattgccaaaatgctttccagaaatgttatactggtttatattctcaatgtagtgtctgagaattccattttccttttactgtcattaggattagataatatgtaatttatatgaaagttagcaaatttaatagtttcttattttaatttgcagctggactttatatattcgtatttttttttgcaaactacttgttttgcttatatttctccggttttatttttttaaaacaaattctctgtataacaaaggtattaactatacttagtatttctttgagatttttttttctcccaagctctcatttactattctcagcacacttaggaatttacttttatgtgaataaaatctgttgaactttttattttttatttctttgtgttctaaatttagtaagttctctgtttttaaaaaccattcaattttcttgtctttttaaaatcttaattgatgtttaaaattctgttttaatctttgactattttgatagtatgatataaggcagcctttctcagttgggagagaattaagctccaataccctaaggcatctgttgtttactgtgaattaactttttttctgtgtgtctgggatggatggtactggatatgtaccatccttgggagaattgagaaagtagtgactcaaacgatttttcccctcttctatgattgaggtgaagaataccacttaaggaagactgttaaagctctaaatgtatctttttcaaatctgttagcaaattgttgtatcagtgctcactcctacatcatagaattgttgtgaggctttaatgacataatggacgtgaaatattttagcatggtgtttggcatgtggtaagcaaaataaaatgcgttagctgttactagtttttcttactacatttttctgattacatgtatttgagggtttttgttcctgagctagtactgatttaaccatatagacagcattgttgaaaccatatagacagctaatttggattagcattctaacctcctgacctctgttgctatccttgcttttattttacagatggtaacttttttttccgatatgtttattcttccagataaattttagaattattttgtcaagttctaaggagaatcccagtgggatcttaactggaattacattaagccaatctacatttagaaaaagtggttggttgtaatatttagtatcccatcatggaagatagtttttctacttattcacattttttctcccatattgttttatagagtttaatagtgcttcttgacatagagccaaattattactcctagttattttatatatttgtcactattataagtagcatcgtttaagtggtattggtgatattttgacgttctctagatttttaaaaaatacctactctttaagaataccaccttttctcttttcagtggtaatatttctgtttcatatttgtctgcttgatagaatttctgaaagaatgccaagtaactgatatgtagcattcttattttggtctttattggagatgtccttcatgtcttattttaagcataatgttgactgcttgtttatacttactttcaactctttagagaattattaaagtaatatatgctcattaaaaaaagagtgaaatataacaggaagggtcaatgtatttgtgatttttaagatttttaaaattaatacttcgttgaattttatcatttttattttgagataaaatttaatttgctatataatttgttaaagtaatatgttattctaatagatattctagcatcaaaacatctgtgggacaaattctactttttcagagttgataatccttttgatattttttctctagtgaatgggatgagttagggtcttagaattaaagcaacttggatttttatcattattactatttatttaatttttaatcttttttttttttgagatggttttttgctagtcacccaggctggagtgcagtggtgcagtctcggctcactgcaaccttggcttcctctgttgaagccatactcctgcctcagcctcccgagtagctgggattacaggcacctgccaccacacccggctaattttgtatttttagtagagatggggttttaccatgttggccaggctggtcttgaactcctgacctcaagtgatccgcttacctcagcttctcaaagtgctgggattacaggcgtgagccactgcacccagcctattaatatttttttattgccatttttagctgaatgaccttggccaaactgtctcttttgaatgtcagtgcttttgtgtgtagtttaatgacttttcatgtcccttgaattttagataaaattatctcaacctctcctctttcagctagcaccctttcaacctgtacaattccacagctagtggaaatccaaagtcttctgcaagattatgcagaaatcttactttctgatgatcatctctgcctttgaacctctacttccaccattgctgctgctttttctcatctctttgacccaggtaggaaattcagtccctttcttgattttcacatgtacaagcaaaaaccccatttttatggggaggattagagtttggtagtctttaccaagatttagagaaagcactaatacaaattaaactagggtagtaagcatcactattcttaaaatgtcttctagccactgcacttttggatgttttggccctagtcctgcttctctttccctaccttcttatcatcttgctattgtaccttcctgttaaaaccaaaattttcttcttgtttcttgcagagcagttctcccgtctttgactctttggcatacaactaatgcctgtgttttcagggtatcatcttcatcccaagtccattgtcagaacagagatactttctttcctgggagaagttctgggtctagctgtttatgacacttttcctactttattgttctaccctttggaactgtgttgaattaagtaagtaatcttcaagcatgcagactggtgctcacaaggtatattcaggggttttcctttccttctctgtcattccaactacctagctcattttaatcataatatgcctgtcacagctaaatcaatttgtctgtgatgtggttgacagtgcctcattttagttcataaaaatcagtgcttcaaagattgtattgctaaacttcatggaatgatttgaaaattgaatttgtttttatgtgttataaagctcagttcttaacttgtttcgcagagagttaattgttaaatccagtatggccacaggaggaggtccctttgaagatggcatgaatgatcaggatttaccaaactggagtaatgagaatgttgatgacaggctcaacaatatggtatgattccttactcttcatggtgtgttgttggctattaatgttaaaatgcagttttccccctgaccaaatttaactcactgatgctctttgtatacacttgctggccaagacattaagggaccctgggccgtttattatattaattgaagacacaaatcaaattgagtttttaagccccaaagcagatttactgttacataaagatgtaaaagtgttttttttatggaaaccatgtttaagacatgcagctgggttttaggaagggatttggagaaggaattgggaaattatcaagaattacgttttcaccaccctaactctgcttttgagtgcatctgcctaacacacctttctctttacagaccagttttctctcctctggtccatgtgatatactgtggctgtcccattgttctaaaccttttagttatgggtgcagttatgtactgactagttacctcttagttccaatttgaaattttgtagtatgattatcctaatttggattagatatgtgtttcttttttcagtcttctgtggcgagggtggggtgaggtgtaagtagtgtaacaggttggcaggaatattcactcatagattgggtggaaggacagttcataaagaagggggttttgttaaaataaggaaaatatcccaagtggtttactatactagtactaaaagaattttccagttggataaagtgggaatttacagacctttttgttaatgaattaggttatgtgagtttaactaagtaaataaaaatgttttctatttgaaactataagcactttttgtaattccatattagctgttaccatgtacatttttacctataaaaataatagctgtctttattgcttactaaatgctaggtactaattagttttaatcctattttgaaggtgacactattttagagattaggaaactgagactataggaagcaaaataaatagcctagggtcacacagtggagtgttttttcagaaaacagtaattaggtttagaacctaggttgatttgatttcagatctctttttgatacgtactgactttataggagatcggtaaaggtatctgtaatttatttcactatttataatagaaaatcacaatgtaaaaaaatcctcttggaaatattcagattgattttagggttggcatttgaggatttgtatttgttagtgatcttgataagaaaataatctcttttcagaaggatgggctataaaattaaggtagatgtaatgaggggaaaatgggttaatagaagtaaatatttgtctctaggagtataagtctgtcaaaaatgtcttgtcttttttaattttaaaactgaccaaaactttttaattataccaatctattttcctggtttgatacaggccatgttaatttttgcttttacttttttaaaggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcaggtttgtgaattatttttaaaaatgaagctattactgtgagaaatacttgaaatggattaaataatttgtcttaggaataaaaaattgagctgtttatgtaatttttaaaaaaagtttctgtgcctatggaaagaattttaatcactggggatggtcctgtcttctttagaaggaaatgaagtcccatttctaaacttgctaaagacatgcatttctggactttatactatgttatatgactaactcaagtgattttactatacaactaaattttgcattttggtaactgaataaaatggtattaagtaatggaaagttccagtttagtatatatatcattggctaagtgtgggatgtgctgggttacctcaagtttagaatgaaactattttctgtttataatcaccaaaataaagtttagatctaaaaacaagtagaaatgataataaattcttgagagatattttactcttagatctatatgtcatagagacacacacatttccaaaaatgtagaaaggtagattcaagtctgataatgatgttggtaatgatcatgtatcatttatttatatctatttatcaattattgaacacttaactgtatatcaggcactgagctgaatactttttcagacagttcttcatgtagacacaactttaattacattgattcattgggtccaaagcgtataaaaatactataagcaagtaataaaaagcaatatgagttaaagtgtgatccatggtcctaggacacgttgagcatccctaatacgaaaatccgaaatgctccaaaatccaaaactttttaagtgccaacatgagtggaaaatttaacacctgaccttgtgtgatggtctgcagtgaaaacgcgtcaaaactttgtttcgtgcacaaaattattaaaaatattgtataagattaccttcagattatgtgtataaggtgcacatgaaacataaatgaattttatgtttagactccggtctctttcctaagatatatctcatgtttatgcatatattccaaaatttgaaaaaaaatgaaactcctaacacttcttgtctgaaatattttggataaggggtactcaagctgtacttcatttagacttaccttgttcatattcgtcagttgaattgtctcagcaaagtgaagtctagaaaatgctaatcaaattttcatattgtagtgaaagactgttacagagccaaagctctttcaggtcttagtgcaaagctctttgtgtgcaccttctgaatcaatatctgatggcgaaactaagaacattggggttaaaacaaaattttgtcataaggttaatgtttgtgtgatttgatttctttttcatatatagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccaggtgataacgtttgtttcttttgctcattctttacacaaacctcaaaataccaacagtaaggtttagaaaattaggttacgcacacaggaattttagttgggtggaattaaagtgcttcactgacctcctttgttaatctgccagatttacttaaaatagagtaaatttctgtttatccaaaaatattttagaaatggcatattcaggttagttaaaggcttctgtttatttacaaaatagcatattgccagtttttagtaaagggggattggaaggaaagtgattaatagatttttgtaggaattttttaaaatggcaaatattcttttgaaaagttgtaaaactataatacatttaattaatttataaacattaggaaaatttatataaaaaattgtatgcagttgtagaagtaaaatttttcagatactgtagattaaaattttgaaatgtatttttgaattgacagtgattggagtttttagtattaccaattatgtcttgattaaaatctaagctggattcagattttttgcatgtgttaattcacacaataatccaagtgtctttggttatcttcgaaataaaaatttgtaaaactgttgctattgaactaattatccttagttttatatattgtgtactttcatgctttttttaaaaaaaatatttcccctgcagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgtaagtattcgacttttaaaataacatattatttttgtagtatctcagtgtgtatttactgatgacattctgatgccaccccagaggagttaacatattttcaaaaaatcatgccatccattataacaatttattgcccattttaatagttgtatgatttataccgctaaaatatttcaggctagagaaaatgaggaggaggatgttcggactatagattcagctgtgggatctggttctgtagctgagagcacatcgctaaacatagatgtgcagtctgaggcttcagataccacggtaagcggctttttggtaattaaagtgctggaaatgaaggtttaaatttttctcccagttttcaagatgttatttttataggcgttccttaatgaaaagtgtattccagggaagaacccctcaaattgttaatgctgtatgtgttcttctgtatttaaacacggaagttaagttttatttattaacactaaaaatagttttaatggttaatttgaaaatgtaatttttgatcttcagtttatagaaacattgtttttgtagtttgttttgttaagcaaagcttcactaattttaagaagcatcgaggaagttaaaatggatggtggaattaagggcaataggcaacattagtgattacttagcatgtagtcttttggaaataaccaagttcatttgtcactgaggacacgttaaggatattagaatttttcattttttgggctctatcctagtactggagcaaaaccagatgactgaaaaatcgagagaaagactagtaaatgggacaggatagcatttacattgtgacttattcacaatgagaaaaatgctgtaattgctgacttggcaaaatggaatttgttgaagtactgtttttctgaagaatagtaatttacagaactttgaggaaagatttctaaaacttagtgtggttcaatgctagggtgtttttaggcattttaaacaggcgtgcctataaccatgcattattaagcttttaacacctattacaggctagtaaagcttttgttttgagaggataagcatatatctcttcgggttttgaggtgttcaaaatgccattcagcattaggaatttgaaggtttgtttcctattagtattgacctgcataattcttacctgcctcctttctcttcccggaccttcctaatttgaagaggtgatttggatttcttttctctacattattttcaacaggagatacttagagagcctgatccaaacagttgttgaagaatggattttactgtggggaaattctttttctatttacagtggtgcgaggcataatttcttccttaggttccagcagaaatggaagggttaggacgatgtgggtaaaggaattctgttggggaggagtgggaacttgtatagatttattgtaatttatataaagtattcattgtgatggcaatttctttcataatataaaatgacggtatgaaagttgactaataacatgtagcagagtaaatgttaaaaatgtgctttaacaactgtgtggtatggtaattccgcaggatgtggtacttgcttagttacagtaagcaacagtctagtctacagaaaacttaaaagactaaatatactgctgcttggagggggatgtggattgatttttgtttttttttttttttaaaaaaaaggtggactggtactttttaaattgttttacaaggctggcttatatgttaaacaggagtttgtgttaagaatttaatatgctacactatttaataaaggaggaggcatcttttattctgagaattcggccgtgcattgaggacaaactagggaattcagcttcacaagaacaggtttcagacattgacgttactacaagtccaaaagggaaaggtgacagacctcagaatgacagggaactgaggcctaataggaaatatagccaaaaacgtggatttccctcaaaggtatactttacaatattaacttgggaagtctctaaatgagcacttcttctgttcatatttcctcttctttatttgcttttctgttgttgctattactcttacatattaattgttaatatagttgtcatactgtaatttgctttagtaaaattctgtcccttactgttttttttctactttgttatatacctctccatggattatagcttacagctgtttttaatttatattaacaaaggttttgaaatgtaatttattcccttttttataaattgcgagtataatttataacacgttcttaaaccttgaccatcagtcagttgccctttgtttctgatatttgtgtttattaatttagatggggccaggcgtggtaattctagcactttggaagactgaggtgggcggatcacctgaggtcaggggtttgggaccatcctggccaacatggcgaaaccctgtctctactaaaaatacaaaaattagctgggcacggtggcgcacgcctgtaatcccagctactcaggaggctgaggcaggagaatcgcttcaacctaggaggtgtaggttgccgtgagccactgcactccagcatgggtgacagagtgagactgcgtctcaaaaaaaaaataatgaaataaaaataaataaatttagatggtagtttgtcagattttttggtttatatttttatttttggaaacccctttcatttgctttttttagaaaaattatccagttgacttggttgcctctttttttgctggttttttctgcagtgtttaattggttttttaattttccatgatttgcataatggcattccagatagagttaaagacaactatttgtagttccacataaaaagagtttgaataggccgggcacggtggctcacgcctgtaatcccagcactttgggaggccgaggcaggcggatcacgaggtcaggagatcgagaccagtctggccaacatagtgaaaccctgtctttactaaaaatacacgaaaaattagccaggtgtggtagtatgcacctgtaatctcagctactcaggaggctgaggcaggagaattgcttgaaccctggaggcggaggttgcagcgagccgagatcctgccactgtactccagcttgggtgacagaacgagactctgtctcaaaaaaaaaaaaaaaagagtttgaataaaaataccatttataaaagtgcatgtatctgttggcaggagcaaagtactattttagtaattgagtataggtaagactaatttcatatgttttattactggtttattacctaggactacactttcccattttgtggctattttatgggtttgttgtattttttttttttttttggtgtgtgtggctatttacaaatggtaaaacttcacctctagtattttggcagtttttttattttttctggttcctacaagaatttgagagcacagtttgaaattagttatgggaatcttattatatcaaatatcaagtaaaatgtgccccagttcaccagtagagtgaataaagtagctgattattttaaaaactagtggcattggagaagagcaaataaacatgaagcataataggtaaccattggaattttattctctttaatccttctgaatagtgacaagcgaaatttaagagttaacagttaatgcagtatctgccagttctttttttcttaaggcattacatataatttaaaaaccactttgctgtttttaggtttctttgaataatatccttataagtgattattattcttttttgaattctcttcttggcatttatttcattttgactttcttgattcttaaggctgtctcgttgttctgttagtattctatttgtaaaaacattttaatttcttcaggggaaaaaatcttaattctcaccacctgtgtttatttttttctctactctgcaggaactgtcattcttaccaccccacccctgtttcctccttagaatcttttcaaaatgtagtattctgttagaatagtggaaaacacagttgagggtcttacatgcgattcaaggttgaaagcaaccttgagacttaacgcatgatatgaaatgattgatattctagagctgcctaccaagggcacattccactttatgaaatattttaagacatgatgacatcttgtataagatgtcagaagaaggcaaaagaaagccttctacgagtagccatgcgttcattgttttcctatactcatggcccccaacttaatctcacctcttaaaatttataagctttctttgtaccttgtacctgtgttttgccattattttcatcattgctagttatttcgtgtgagattgccctgtcttttaaaccagctatggttcttcagacatgatgtcttatacttctgtatttagaacccagcacataatttggagcagatagtatgacgtaaagaagactagagcctaagaacctgatttcccttaactgtgacactggataagtcacaactttatcttctctaggcttatagttcctcaaccttcacatgaagaaattgaagtacataattatctgaagctgtcaaaatacattaggatccattaataattactaggagaacctcagttgagtagaggaaaggaagattgagggttctctgaaattggactactacatatttacaactcagggtttgatgcctaagttatttttttaatctgtaaactaaaaatatagttggtgaaagtgactttttcaaaaaaagtttaaagaaaaatatgtgtttgaagaattaatatacacctagcatcctttttggatttctattccaggtgccatcttcctggtatgttattactcctacctagatatttttattttctcccttctgtatatttcatcataggctgtactcccatcttttggctcagtttttttgagcatcagtctgaaatgttgtttatatgaatgtgaaagttattaagtagtaatatttcactaattttgaaaattgagaattcatttttagattagtgagaaatctgaagataattgtgtttaatagcttagaattctttatgattaggttatcacagttttgtgactaataaggattaaagaactttttagaaagtacgcttttttctcatttgcatatttttttctcctaattataatttatgctttgctagaggagtatttgatcaacctagagagattttgttttaccccttccattgatatctgtacctatttgatttggttttacattttaccgttgactttgatgaaatcattataaaattatttttgctgcattctgagagggctagctattgataattatccctacccttcaaagttgtttttttcctaatgatgtaaactgtctggaaataagccagactaggatgaatttccacggaaatggatgtaaatatttacaaggtaactccccttatataggataggagagaactgagtaaacagtacttaatttgttaaaagtttcagtttattagaggttcaagacaacagaaaaacctctaataaatattggcttaccaagatccaggtaggctatttgtttcccatgctcatgaagtctagagatagtctaggatagagaggcactgactaggcacctctgatgtttacatgaaataatctaattatagccaacttcctatttgatcataactttcttgaatatttaactctttgccatgtacttatttgtttacttattaattttatggatttccaagtcacagtgtaaaatattaccacagttactcatgctcattcacaatactgatgagttctacttggggaggtaaagaaatttttatatagtattgtaaaggatgtcacccagaagggagtttctcttgagcccatctgcatgctccataatttctctgggaatcaaatgtacatagcaagtgtagatcagtgcatttttactttcaaaagaaatctttgaacttctttgctctctttagtcatttatttgaaatttacataacccgacaaaaatttgttagcagtacaaatttaaaattgactaagtgaaacaaaagtgaaatattttatgtaaatattaggtaaaatcgttcaacttttaaaataaaagactttttaaaaggtaaatcggtgatgaaaaatacaattacggtatacgtttcgatgtataatttagcttgtaatatattgtttccaggttgtatttaaatttgtctctgctttgcttttccattttcttgttggattacattttgaatagttttaagattaacacttaaaatttcatcattttttgtaagtgccacttatttaatccatccctctacttttagactagatgataacctcctagcattttcggggaatttggaagtagttacttccattttatgtcatcagactcagatgaatgagcataatttaagaggaaaataatgatgcctttgatgacgaatataaaattcgttattttcttagatgtctgataatatgatgtgattaaatgaaaatctttttacataagattatcaaataaaaaatgtatttttaaaatttcagtcctttgttagaaatagtaggtgtgcctactttctaggttttgttgttgtttttaaatattacttctagtcttttttttttccttttttcttttttctttgagacggggtctcgctctgtcacccaggctggagtgcaatggtgcagtctcagctcactgcaatctctacctcctgagttcaagcgattctcttgcctcagcctcctgagtagctgggataacaggcgcacaccgccacacccggctaatttttgtatttttagtagagatggggtttcatatgttggtcaggctggtctcaaactcctgaccttgtgatctgcccacctcggcctcccgaagtgctaggattacaagactttcaggtcattaacccagtataatgtgctccttttctgtaggggcctagattcttcagtgtgtgtgtgtgtgtgtgtgtgtgtgtgtgtgtgtgtgtccatgtgtccgtgtccctcttggccttttatgttttgtatatctttttcttttccttttgttcattcctcttcctgctgagccattgattatgtagctttttactgtgaaattacctcttaagtggcaggctatatatatatctctgtgtcatcattctgttcttactcttttttcttgatgtctactaaaactatatttagggttgtatatttaataatttgttatcaatgtgtatactttgccattgataattgaaaccgcaacatggattttaatagtcagatacaagtattgttggtcttattttccaggccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctggtatgtcacagtctgagaatattctttttgtaaggaagactcatacataattgtattgcagggtggatgctgattattacataatcagatcttgattgttgtctagtttagaaaccttcatatgaggcttatactttcctgtgcttttctctggttatgcagaaaaggttgcagggacaactggccatcatactataccatgcagatagccagatctctctccttttcatcagagagtacccttaagaggtaaaagagacaggctgtagttctgtttttgtacctcagactgataaggctcatgatgcgtttatttcctttttttctattttattcagctaggattgtcattctttgcttgcctcccaagaaagggttaaaaccttaagtgaggcagtgagtaaatttataaagtgtctttaaccttcaaggttagtagtagctagtagctgttattttaattaggtatccttttgtatatgctagctccttggaactatatttatagtgtatacattcttcgtaagactcagaaattttcttcctcctttcctcatagccatgtgtgaattagatgaaagttgtgttgaatttcttagtattgagtctaattttgtacgtttatcatcaccttcaaacttattttagtttctcgttaaattgcaaaaaaagatgattagttattaaaagtcaacaaaactaagttatgttttctaatagtctatcccccactgtctgcttttagtaataatttctcttctttgagcgctttgtttttgcgagtgagttaggttctcactgaggctaccctgttgtgaatcagtttattctgctgtccaaacctagcccactggctcacctgtctaatccctgttatacctaatttaagtttgcattttcacaaggaacgttatgactttcaaataacctctttttttttttttttttttttttttttggagacagagttttgctctgttgcccaggctggagtgcaatggcatgttctcggctcactgcaacctctgcctcccaggttcaagtgattctcctgcctcagcctcctgagtagctgggattacaggtgcgcaccaccatgcctggctaatttttgtatttttagtagagtcggggtttcaccatattggtcaggctggtcttgaactcctgaccttgtgatctgcccgccttggcctcccaaagtgctgggattacaggcgtcagccaccgtgcctggtcaataacttactcttttgtagtaatgatatagctgtatagagtactgtatacagtaataattacaaagatttttgtccccatttctccattgtaaaatttaaagtaccattagcttttatatttaggaaacagataatttaggaaaagataattaaaatgctttaacataatgactagtactagtttggttaatgactaaccttttaaatatttttcgagtttggaatatcagatttaaaagctttcctttggtagttaatattaatctctaaacttgcataatctcctttgatcatcagagatttctaggttagtcagagctttaattcttatttctgttttatagagaaggaactctacagagtttgtggcttgcctagatttatatagaattttagcagaattacatttcttgaattgtaggtcaggggtcttgtttctttttctgaatatgaacttttgaaagtaagcagataatttctttttaaaaaatactattatgagtcagagaataggagtataatgcacatgagtttgaacttcatactatttcaaaaagaattttagcttagtaattttaaaacaaatttagtcttgtatttatgagattttgcaggggcatgctaatgaaaagccatggaaagctacaattacagtatttaatctagtatatgagacattatcttgggataattatgttacctcaaagagtgtccctttcaccatttaactaacaagttacatataattactgtaatttctttcttctcagcatagagttttgactagacatataggattctatatagccttgaaattctcagttctcagtggaaaaaaggtagtgttttcctttaaaacagaagcaatttataactaattgtcttttttctttatcttttttttttttttgagacaggatcttgctctgtcacccaggctggaatacagtgggcgtgatcttggctcactgcagcctctgcctcgcaggttcaagtgattctctcaccccagcctcctgaatagctaggaatacaggcgtgctgtaccacgccgggctaatttttgtagttttgtagagatggggtctcactgtggtgcccaggctggtcttgaactcctgcgctcaagtgatctgcccaccttggccttccaaagtgttggaattacaggtgtgagacactgtacctggccaccaatgtctgttttagagttggagagttagaagtcaggttaaggatggagttatttgttagtagaacagtgactatcatgaaaattgttgtcacaaaactgctttatgaatatgggggcattttttttaaattaagaagataaaaaccacagtcttttagtatgacttgtatcacaaacagccacttcaataaattatccattttactgcaggggtcagcaaactatggtcagctgagtttggctcattgcctgaaataaagttttagggaacacagccatgcccttttgtttacattgtctgtggttgcttttaccttgtaaaagcagagttgggtggtcgagacaaaaactgtatttcccacaaagtttaacatatttactatttcaacctttaagcaaagtttgccagcccctctaccggagaattgattctattcaagaacatggagattgaaacctgtcagaatcagctgtgcttttttacactatcactttccctttcactcctcactgatcttagacctgctccactgagtcactactattaattggaatgtaatagtaaccctccttgtatgttgggacaggaaaagatgaaccactttaccagagttttgtgagcatccctttatttttaagttaggtggtaacttctaataaaatgattgttggcagatagatcggattgttaactagtttcaagttacgtatgtgagctttttaaattctttttttaaatttatttttagcttctcagagattaaaaaaggtgtttgattatttacattaatcagtagttactaatttctttccagttgttgcagaaactgcaggtagcttatctggcgtcagtatcacatctgaactaaatgaagaattgaatgacttaattcagcgttttcataatcagcttcgtgattctcaggtaacctagatgttttagtatagttgagtttaaaaaatcacattaattagaacagtgattcagaaacttcagtgagcatacatatcacctggcatgattgttgagcagtgtaggtttctgattggtggggtcccccccaccttcaaaattacgattcatggatttggggtgggcttctccacgtctcagtccaatgctggtggcctggggactatactttaagaatcactaaattagaggagagtttactttgaaggaagtgattaatgaagtttttctttgtatgctactggatgacgtattcttttttcctctaaaagacttaatggtcacaacgattaagactttgctttaaatctgtgtccttcgactagatacatgggattctatacagccttggaattctcatttgaaggaatattttactaacaattttaagaaagttcttaatttgagagttagcaagtgttataatttgatgcactttgtaagtgatataaatgcagattttcaatatgggggccttgggtaagaaaggatgaattaatgcctctccattggaagtgagtatgattgaagatgcagtgtctcttgtcttcttgctgaccaagtgaaaatgagagaatatggcccaaccactttggagagttatatagcagtacctagtaaatttcttctggtagacctggggcctactttagagaaactctcacatgttcagaaggaggtagatggaagaatattcatggcaactctgtgttaatagcaaataaccagaaacagcccaaatgtccatcaacagaaatgggctaatgaattcttacatagagtgaaattctttatagcagttacagtaaataagccattgctaatgaatacaaaattcaagtttaagaaggatcccacttaccttattttaaaaaaagtctacatttttaatgtatgtatacataggcattagaaaataaaaacatgtagagaatggtagatgcctgattccaggttggggttacctttggagtgggtaatgacattggaaagggtacaaacagagctttagttaaatctgtaatgttatatttttcttaaaataattgatgcaaatatgggaaaatcttaaaatttgactaagcataatgggagatattcattatatgatttcctaagccctagtggattcttgcaaagtttcataattaaaaaaaatttaaaaaaaggccaggtgcggtggcttatgcctgtaatcccagcactttgggaggccgaggcgggtggatcacttgaggtcaggtgtttgagaccagcctggccaacatggtgaaaccctgtctcaactaaaaatgcaaaaatgagccaggtgtggaggcatgcacctgtaatctcagctgcttgagaggctgaggcaggagaatcgcttgaacccaggaggcggaggtttcagtgagttgagatcacgccactgcactctagcctgggccacagagtgagactttgtctcaaaaataaataaataaataaataaataaataaaaaataaaggaacatgagagagaagtggtgggaaaaattgataggttaagaagttaaagtttacagtggtagttctagaaagaaggcaagagagagaatgagatttttgaaggtttattttatgtaacgtggcattgttattacttttgattcaattactgatgtctagtgaatccaagacctctgtgtggtcatgtgtctctaaaactatgtagagtcagctctcagtatctgtgggttccacatccatggattcaaccaaccatggatcaggaatattttggggggagaaataacacaacaatttttaaaatgcaaatttaaaaatataacagctatttacatagtgtttatattgtattaggtattataagtagtctagagctgatctgaagtatataggaggatgtgtgtagattatgtgcagatactacaccattttatataagggatttgggtatctgttgtttttggtgtccccaggggtccttgaaccaatccctcatggatactgagggatgacttcatatgttaatagtggcatatcaggaaaccgtatttaatttgggaatagtaagggtatatacttacctaccagcacagcctagcaaatatttctttctctttataaagaatatttatgcatttaaaaaatgagaatgcatttaattgcgttagtcttaattcttcttttttgttgtttttttttaataagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatgtgagtaaatctggttcagcagtattgggtataagacacacaagtatatatactgtcacataataaatttagtatttggtgaatgaacacatagctcctcaaaaatatttgtagggacttaagacttgcatatgaaaagtttctaagttgcaagccaatatatatgaaagccaaataggtgataaatcagttttataattcagaaaagggaaagaataaagttggaccttgaaaaattagtaggattttaataagggaaaggtagaagagaaggcaactgtttgatacgtggacatattaatactttgtttcttaacattcaaaattttcccttaaagaaaagttaatccagttagtactttgatttaaaaacccaaaactgtgaaacatagtgtgtattaaaaaaaacaaaaaacaaaactatgaaaaacttttatatatggtttagtctagagagcccagaacttccaactgctggatttatattcatttttaaaaaatatataaataatcatctcaagcaggtataactgcgggagttatcttttttgctccacacgtgtttaaccttctttgtctaaatcagatctagtcttcagttcctatcctaataccttttcaaacatggcccctgtctcatatccaaatagtaatagaggctcaagcattagaaattgaagtcagtagggacaacttccaactagtctttaaacattctagctgctgtctaattaaagaaaagatgagggatttaaaaataacaaaaccattgtctctggagcctctggtccttattctccacctatctccttttccttttccacccacaaaagaaccttaatattcctgtcctaaaacatactcctttcttttctctgacttctgctagtctctttctcctctagagtataatcccagtttttatcctttacaaacacatgaatacaactaagatgtgtggctgggtgtggtggctcacgcctgtaatcccagcaccttgggaggctgaggcgggtggatcacctgaggtcgggagttcgagaccagcctgaccaacatggagaaaccccgtctctactaaaagtacaaaagtagccaggtgtggtggtacatgcctgtaatctcagctactccggaggctgaggtaggagaatcgcttgaatctgggaggcggaggttgtggtgagccaagatcgtgccattgcactccagcctgggcaacaaaagtgaaactccatctcaaaaaaaaaaaaaaagaaaagaaaaaaacaacttaacatgtgaaagttgcgcttaagtccttgtcgtcagttttgtatgcataaagtagcactccgtatactgatgactcttaaagcctatttttttcctcactgggaagcagtgtgagagcagcagcaaaaggtagactcgtcaaggaatagaatgaggagactgctggaaaccacctacaggaattgtggtactaaagtgagcaacaaataatgatggttcctttgagaaagatactggtaaatgacagcacctttgaaatggtaggaggtagagaagtgcaaagattcttaatctttaattcctcttgaaagcatgatttatatttgatagtaacagaagttaaatagaaagtaattaaatttagttcaaggaccatagaggattagccattatctaaatagcaggtttttattgctgtttaatatttcatggtttgaggtaccacagtcacttttaacacttttctttctctcctggagcaagaaaagttccttcttggtgtccagatgtgacatccccctgatctgtgggtatgaaaaactgatgaagacctaatcagctacagctaccctgtaaagattacagattgagtactgcacatgattcatagtggccctgtttaacttaacctagaaccaagtttatcaagttagttaccaagtttactcgttagttaaaactaactagagtacttctctagttagttttccaaggtagaatatcattattcttgtcaatttccatcttttttctttcctttctgttttaacccagtggttatattgtaaaggtgatagaacctgtggaagaaagaggtaaacaagtctttgtacattttgatgtgtttaattgtggagtaagttaataaacaattttctgaaatttaaatctgcagaaattaagttgttaatttttactttttagttttcaatatccaagccaactgtatgtgtttgtttatggtaactggtgattaaaaaaaattttttgttgttgtgccttcttcagcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagtaaaacatttataatcattgtttacatgaagttaaataatagggataaattctgtttttttttttatgttgaaaattctgcaaaacgagatttatttaatattgttgtaaacattcttaagggataggtagaagaggcgtgtgtgtgttgtgtgggcataatttgagttgtctaagagatgtgatgtaacatagtttctgtgaactgatgttactttcttgtttttcaaataaaggatcaaaaataagattacagttaaaatatttctatattcagatggtttagagaccaggctgtagaatcagacagccctgaaattgtatcacacaaggctgtgttaccctgtacaaataacttagccttactaagcctgtatttcctcatctgcaaaatagggatgataatatacctgttgataaatatgttttcattaaaaaacgttggcgcagttcctggcacttacagtaagaactcagctaacttaatttttatttttggtaaacgtagtatgtagtgtatagatctcatatgtgcagacaaatcaagaaccttccatacatgctcagtaatgtctgtatacctgattttcctgagaggtagtatttagtagtacttcacacttttgatacttgagaaactagaaatctttttgacatcaggttttctgctattaacatttacacctgcttaaaatgaacaattaaattgaaattggttttcttacacttttgtccctaaaacagcataagaaaataatgtgagattttgagtaagctgtacttggcattaacctcattattttacagtcataccccctggagagttcactaggtggatattccattaggtctaaattttgtttctgttagctgctatgatatgaaaataatgtctgtattattttgctaaaatgggtgtaaatcgtatacataaattttttgtttatcaggaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcggtaagaacttttctggggatgtttttccagcatattcattctgtcttgatacttataatgtgggaacaaaaatacttcgttgtagtatttactatttgccttttatttaagctttctactattttggtcagtgtaatcatctctgccctgtgaagaaagatgaatagggaagtatggagtacaatagttcagtaaatttgccctttgttagactgaattcgagtaaatcatgagatgtatctaacttagcattttgctgtctttttctttttaggcgtaattttcattttttcagatgtttttctacttaaatagcacatatgcagaagttaatgaaaagcaggagtcgattattcaatttgaatttaaatggaatagccaacaatgtgcttggtttggtgttattttattagcagttctaaacttggatttctttctctctttttttgtgccttaaatgacttcaggctgttttctttcttctagaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttaggtatgactgactgtatttacatataattttgctgtgttattcttacaaagtgggttttcgttcatgtgtgctctttcctttaaaagttactggttttaattatacatgttttcagcagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggtaaatattgcttggtcttttaaaaacctatttgtcaaatagtacagtcttaagtaaaatttgtgtatgataattactttggtttaattatactaatacacatttatgtatcatatgtgaggtttaaatttttagcactttacatgctgtatgtcagaggtcagcaacctttttaaattaagagtgagttggttagatagttgcggctttgtggcgatatagtatctgtcacaatttcacaatgcaaaagcagccatacataatacataaatgagaatgattatttgccaatatagctttattttattataaacaatatagctgtttttatttacaaaaacagaagaggttttgttgtttttgttgttttgctgacaactctggccttatattatgtacaacttgcagcatctcaatgaggtagacattaaataggttaaagagatcttaattgccgaagtttatatgactgtccaatccagaattcagacttcctgataccagagcctgcgatcttaacctactgtatataaaagaaaaaccatatgttatcttattcagtaaggttaaagttagaactattaatcataaattttaaaaagcagtttatacatattttgtattatagttacacaattaactataatgtacaattgtatatttatacaaatgtaaaaatatacaattatagttacataactattaacacaaaatatgcctacacttataattgtataaatatgtaattaactataattgtattaccgtgtaactattaacacatttataaaggtgttgtgtatatatatataaaaatcatataaaatggtttttgtgagtgaaaaacctcaagttttattaacagtttcttttgaaatgctatgtactttgaattactcaagtaaaaggtgagcgtgctctctcggttcaaaaaaagtacgtatttgtatttatttattttttggggacaaggtcttgctctgtcacccaggttggagtgcagtggcatgattttggctcactgcaagctccatctcccgggttcaagcgattcttctgcctcagcctcccgagtagctggaattacagatgtgtaccaccacacctggctaatgtttgtatttttagtacagatggggtttcaccatattggccaggctggtcttgaactcctggcctcaggcagttcacccaccttggcttcccaaagtgctcagattgcaggcacaaaaagtacatattactaataaactctgtctttacctccattaataatcctattcttcttcactgaagttgctaggccttttctctgcagttaggtacatcactatgcacctatttttaaaaaaatacatgacgttttgtggtatgtttctttgtttttacaaactgtatatataatacactaagtattattttatagctttccttttttccccactccacattgtctcagagaactttcatgtcagtatagttctatataattataagtaattaagaaacacaaatatgataattataaaatataaataatactgcatatatatatatacacacagtacatagttatttgtagctgcagtacagttttcagtatatcgatggactttagttaatgtataatagcatccagttactatatacttgttttcaatctttcgctatttagaaacaatgcaccaaagaatatacttgcacaagcttttgtgcatttgtgttttttaagaaggatttggagaagtggaactactatgtcagttggtgtacattttaaaggacacaacttaattggtctctagagagcaattttctatatgtatttccgtatgtatttatatttctatatgtatagaatttttgatatgtattcatatttttctatatgtattttttatattttaagcagtggtatgtgagagttcgtttctccacacccttgattgtgttttattttattgatataccgtagcttgtttaaccattactggaattggccttttccaaatttcccaattataagaagagttattgaggtgagataaacatgtatgcaaatacaaacgtgtgtaaacaaatatatattgaacacgtgtacacatgtatacaaacgtgctttctttactgctttaatctttttatgtaaattttacagactagtggtatttactaaggtatgaattggataatgtcttgaggtatcaagattgttttaatgtaatgatgctctttcaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaaggtatgttaagcttttggccttcatttaatataataaaaatttagtgcctgttttggagaaggtgctcagctaggtactgtgttatgttgtgcctaatgcttcatcacattttattggagtccataaatataatgtcaatttaattgtagagagaaattttatgaggctaaactacagcagcaacagagagagctaaaacaattgcaggaagaaagaaagaaactgattgacattcaggagaaaattcaagcattgcaaacggcatgccctgacttacaggtaattatgaaatttatttctaattgtctgaaaaaagatgtttaaaaccttaggtcaactgaaagtactcttttttgtttttgtttttctttttttttgaggcagagtctcactctgttgcccaggctgaagtgcagtggcgtgatcttggctcactgcaagctctgcctcttaggttcacgccattcttctgcctcagcctcctgagtagctgggacttcaggcacccgccaccatgcctggctaattttttgtatttttggtagagacagggtttcacagtgttagccaggatggtttcgatctcctgacctcgtgattcgcccgtctcagcctcccaaagtgctgggattacaggcgcgagaaactactcttttttttctagtattaaggtgacagaattatatctagtaattttgtgattaatgaagtggatgaactaatgaagagttggggttatacgtttacagtgtaaaagacagcacataggaattgactcattattttcattcttactgggctggctggccatagattcagaacatgtgtactcataactgtttattatgttaaaatattctgatttgacttttgcagttatggaccagcatttccatcttttactggcctgaaataatataataaaatctttaagccaccataagatatctaaggaaaataactgtatgtggtttaaagagtaagttgtatatacttttgcttattaactaggatcttatacatgggtcttgagattgaacagaaaataagatatctttggtgatatcaaataatcagttaataatatgggaaggggataataattccttctgatattttcccagagtttattggctagcttttttttttttttttttttttttgagacggagtctcgctctgtggcccaggtgggagtgcagtggtgcaatctcggctcactgcaagctccacctcctgggttcacgccattctcctgcctcagcctcccgagtagctgggactacaggtgcccgccaccacgcccggctaatttttttgtatttttagtagagacggggtttcaccgtgttagccaagatggtctcagtctcctgccgtcgtgatccgcccgcctcggcctcctgaagtgttgggattacaggcgtgagccaccgctcccggcctattggctagctttatcttcagttaggttgtgttttcaaagaaaggaaaacagggcaactgtgttcattttctaaacccttgcctttcctactgtatctaatcctttttctctccttatctccaatctaaataatgtctagagaaatatgttgcaaaggtgggttaagtatacaaaattttccattatgttttatccctgttgtttctgttgtttctgagggcttgtgtttgttaacctcagcttgtgttttcatctttgttttcttatttcatgttatcttcggatgatgatggaagtcagggtctgatagcagattaaatatggcactagagccttagtgccatatttaaagtaactgcttttatgaaattaatataattgctttaattcctcataacgttttttgtgaattcctttttagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgaggtattgtaaattgtactctcttgttcctgagttagtcttttgttttcctttttttttcttcaataaggcacatctcaagaaaggaaactgaatatccttgaaacatgtttgtaaatagtagtctgctttgtgccttttttagtagacacaaaaatgtaatagattataataatataagaaagataaaacattttaatttttaaactttaattgaaaagttttaaataattttttctaaaaagtaattatcttttaaaaatatccatgttctttgttagtaaatatttggcagaaatatataggggggtagttgcagcaaatagtaatcatttcagttagaaagacctatcctttgacattttatttatatgtggtttgtagaaaatataatttttcctaaataatttctgaagtatatttgagttctacttgtttctattaataggccatgtgcggtgactcacacctataatcccagcactttgggaggctgaggtgggcagatcatgaggtcaggtattcaagaccagcctggtcaacgtggtgaaaccctatctctactaaaaaatacaaaaaaaattagctaggtgtagtggtgggcgcctgtaatcccagctactcaggaggctgaggcaggataatcacttgaacctgggaggcagaggttgcagtgagccgagatcacaccactgcactccagcccagatgacagagtgagactctgtctcaaaaaaaaaaaaaaattggctgatttttttgtaatcataactatattattattttaaccttcatggacatgttagtgtgaaaaggagagaatgagaatagaaacctttgttgatactgacaatactagtagtcttttactcttttaggctacagcaaatccaaatatttatttaactctggtttcttaaaaaaaatagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaagtaagagagctgcataaatcacttttctaaaaatgtcacctgccgaagattgacctgtaggctaggcagccacatttctcctctacatcacagcacaaatctgctatttcagtgaggctactgtttaactaccacctttgtgacccagtttaattgaatccagccactttctgttctgacttctcgtagcatcagctttctcttttgtcttaaattactatggcacttgatcaaatggtgatacagattttcttatgtgtataagccttattagttaagtttataaaaagaaaatgcttgatattttgtagtgcttttctgtcaggccagaaataggcccttttttgcttaaattgagtatctgctgtttgtaaggttcttaaggatcttaaaacattttattataatcatttagtttttaggatttcagtttaaaatgtccatatttagaatatttctaaaagagttggtcatctataagatcagtgaattatttagctatatagtagtaaccatatcaaaaattttgaaatatagatttgtttatgaccttcccttttgatatcctcagatggcatttctggaatttctggagttttgcaccaagccctactctcttctcagatgaacttctattcttggggtcccaatatgcattttactgatcagactatatctacaatattttattctgttctgggtactacacgtctgttcttctacagagttcttcagatagttttgatgagcatctggtttcagaatcattggtctggatttttgctgtccagtatggcagccactagatataggtggttatttaaatttcaatcaaatgaaattaaaaatttattttctcagtcatattagctgcattttaagtgctcagtagccatgtgtacctagtgtctactgtattggatagcacagatacagatgattgccgtaattatagaaagttctgctgaactgcactgatcttgaaaactccctcaagcaaatgttaagggtagtttagctttgggaagtagtcccaggggatatgatgattatttaaatgtatttgaagaattgttttgaggaaggcaaactaaacatattctgtatataacagcaatagggagagtgccacccgtagcatagttattgtgattaaatgaaattttatatacagacatgtatatgtatgtttgaaacaatgtctggcacatagtaggtggcagagtatttaacttatctccagaatgacatctgttttatgtctcttaatcactagaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggttagtttcagtattttaattttgtgcttaatttaagaggctcaggtctttttgactgacagcaagcacttctgcagttctccaagccaactgaatgtcctacaactcaattcaatttttacactaactactcagagttagtgcagacccctcaagttaaggggctcagttcagtaagactgccctcacctcagacttcaatttcaactgcttggtccccacgttacccacacttctgtgcaacatggctagaaatttgggagttcttacaatccccttcaggtttatttgctagaacaactcacgaaatacaggaaaagacttacttacgtttcctcatttcttataaaggattctgaactgccaaatggaagaggtgtgttaggacagtgtgtgggttggggaggtgtgcagagcttccatggtttcctctgtgtgtcccaccctccccagcactttgatgtgttcagtgacccagaagctgcctgaattctgtttacggttttttaggagatttcattgcttaagcgcaattgataaaattgttgactgttggtgattgttctcattagcaaaaattcacatctggttgaaaggggcttgttacggataacaaaagacattatcacttgggagattccaagggttttaggagctctgtgctaggaaccaggcacaaagaacagatagatattttattataccacaagaatgttgttccagtagatccaggtaaactggatcagtcttcactcctgctgttgagaattaagcaaaaataacaaattgtagatagtgaaaagagtctgccaacaaagatgttattacattgttactaataattataactgaaaatttcttcatgaataacagatggtgaagtagatacagtagctccacttgatgaaatactatgtggttgaacttaaagcgtgaagaatggaaaactacttgtgacataataaatatttttattttgcagaatacttaattatatggacactgctgtgtaaaaacatacatgaaaaagactggagactaatgaaaactaataattgtacaaagctaaagatctggacttctcccccctctatattttttaatactttgtatgttcttttaatttaaaacagaatattggcccataggcctgagtatcagagtttattgctgtattttaaaaaccaaattattatgtatgatgacttaatgctttcaatcttgtgttaggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcaggtaaaatttgctatgaaagtatatttttcgtctatttttataacttctgaagcaatacaaatttttctcaagtcatcagtaactattaacaaacattttctttcaatagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggtaatctgtttcttagaagtattgagactgtataagagctaacattgagcagaggttttacagttagcttctgggagaaaagagcaagaccaaattgcatatttggacattctctttcccttgagaattttataagtggtgatttacctaatgtttccttttaataccatggatttctgtttttataaatttatgttattgaattttacttatattttggcagattttatggtgtgtaaattgtaccacagtgaagctataaacaaacaaaaaagtgattttcttacagttttaccgactgtcggacagaagtactaagttcatttcttgttccagagggaaagttattgaattaagccttatagagcaagcacgtatttgttacagtatcagagcagtttgtctgcatgcttttgaatcatttttttacatgtattcttcctgaatgtactttatatatatggcaatataactgattcttagattactgacttaaatctttgtaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtaggtgacttaacctaaagagaaaataaataaaagcaaagtgtttggaacaacgtaatttgtctattgcctagatgttttaacattttcttttggagtggggtaggaaatgtttgcaaagaaagttacaaactcttttttttttttttctttttgaggcggagttttactcttcttgtccaggctggaatgcagtgacatgatcttggctcacggcagcctccacctcccaggttcaagggattctcctgcctcagcttcctaagtagctgggattacaggcatgtgccaccgtgcccagctaattttgtatttttagtagagatggggtttctccatgttggtcaggctggtctccaactcccgacctcaggtgatccacctgccttggcctcccatggtgctgggattacaggcatgagccaccgtgcccagcctacgttgttccttttaaaccaaactttaataatacggttgctaatgaaattaagtaaactacttaggaatgattgcttcaactatttattaagaggaaagagaacctgttcaatggctgctgtatactaggcactgtgtaaaacgctgggagagtaaagatgaataagacagtgctctcctaaaggagtaccatgtcttgttagggggatgctaatagactaaaggagagcacatttagcttaagcttttctttggatggttttttctgcactcattatgtaccagacactatgtaagttactgggatctaaagatgagtgacactgatcctttaaggaattcagggtctagtgaggatgctgttaatgaatgcttatagtacagtgccacgggtgccataacagtagtgcaaatgctgggaagtgtcagcaaatcagttccgccgccaaaaaaaaaaaaaagagttgatatttaagctaaagaatgaatagaatttatttccagagagattagaaatgaaagggctttctaatagaaccacttagagttataaagcaatgaaatagtacatcactcagggaatttagaggtatttaagtgtggctagtatttaggggaagagtaattgatgtggttgaagagtggcagagagattttatgatgtgcaaacaagcttaggttttatattgcagacgagggtgccattgaaggactttgagcaagggataacatgaaatttatattttagaaagattacactggtgaaagtgttcgggagaagttggaggaaaggagtgaagatttagctggtgaacagaaggctgtcataataatatggaaagaatgatagcttggccttaggccttgtcagtagggatcaagaaaaaggagtaactgaaagacattatagtgatagagtgaataagttaagtgaccgattatatgaggtgaatcatgaggaggagttaaaggtgttggcagggaatataggaggagaaaaaaggttgagagggctttgtgaatatatatatatataatcacaatatatatgtactcaatacttcttacatacatatattacagtgttatgcccagcaatgtgtatatatatggatgtatatatgtgtgtgtgtgtgtgtgtgtgtgtgtgtgtgtatatatatatatatacacaccacagtgttttttctttataggattttcaagacagtggcataaaaaatttaagagactttttagttcttgggtgtcaattaatattggcagcaaacatcacatgagtagacttttaagtaataagaaattgcaaatgctcttcctttttactaaaatatacttcatacccacaccaactctatataaaggctcttcattcttcttaacagtacaatttttgtgaaaccttcccagtctctttccccacacgttgttagtagcctcttgcaaatagctctgatacataacagtatttggtaagtatttaattatattctactttcccaataaaaatagagtagaaacaacataagcgtaggagtcatacagacctgagatctaatcatctttttcatttattagacgtttgatttctaaccgtatttgctcactggtaaaatgaatgcagtatctattttataagttacttggttttaagtattaaaccaagtaacatgtaaagtgcctgcagtagagtgtgtcacccagtaattgataaatgtcaggtaccattatttctaacttttagctcttaagggagtggggattattaattgtctttgaccaatgcctaaaacatagtggcctaagctgtgaacagtgattggataaatattagcttttttttttaattaacagttttttgttttggtggatttgaatgacatgtttaattaaaactgtcttttaatttcattttaaagctaaagacatttatttatttttctcttacccattgcttttactgattaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggtactgattgtaaacagtcttttattgcttaaacattcacttttgtgattacatctaattatgtgtaatttgaaaacacaactagggaggacgtttgtgatgatttggcttgatgatgttggaaatatgaaactttgacgtatcagtagatgagatgccagatacttcctggtaaccctggtacattaaaagttgtttggaaggatgtggcgtaactcataggatttgttttgtctctaatttgatacctgtctttacggttaaagcagtttgctgttcaatgacttagggctggaaactaatattaactgctagaagatagttgttaagtgatgatccctttttttgattcctagctcttgattagaatcacttcctaaagcctattcaaatataatgttgagtactattagattataaaaacaacttttgtctcataagttttgaggatgcatggtattaatgatatttaggatttcttctgaaacagagtttttgactcagtgtgaaaggttggctccgttgaacctagtctgtcagatgtatctctctgattgtctttcctactccataaaaatatatataattcacattatatttctctttagctatgtgattaggaaggtctcaggctcttatattagcattttgacactgtttaattactgagtcattaactgggatttttttttttttttactcgattaaccaataactctgagaattccaactttgtattcaccactaggagtgctatgattaacatccgttactttgttgactccttttttttggttgttctatctttttcctgttaaatctcatgttgctctataaaggtattctgttgtcagaagcctaacacagtgttagttcacagttgccattcagaaatgattgttgaatgaatatccatcacgagcagtaaacatttattcaaagcttcggtgaatagactttcctattagaatgtccctacttcattattttcatataattgatagtaaaaaattactctggttttaaattatttatatcatttttaggatggatctgaatgtctaatattattttagatatttggcctacttcagattagacctcatttcccaaaatctcaactattgtaatttcatggaattaaatgactagagataaaaagtcagataaaatcctgtagtcttattcaggggtcagaaaacttttcctataaaagactagatagtattttaggccttgctggccatatagtgtttatcatagccattcatctgtgacagttttgcacaagagcaaccataggcaatatgtaaacatgagtatggctgtgttctgcaataacactttatttatgggcacagaaattttattttcatataattttcatttgtcacaaacttttaactttttttcttccaactatttaagaatataaaagccattcttagctctcaggtcatatggaaacaggcagcaggctgaatttggtctgtaagttacaggtttctaacccttgtcttgagttaaatcctgtaggtcactgtctcccagactattaggagcagtgttgttgttcacgctaggttctgtgataaagttttggacttgttgcccactaccacttttaagagatttataaagcacattggcatattaaaagttgtgagatattttacagacctgtttaactttgttttatgtgttttctccccaacctagacgaccgatgagtacctattaaatattaagggatgctagtgttcagcagataaaatttgagaaatgacagtagactaatagaactacggacttaaggagtggagaaataaattgctaattgaatgaccaattgtattcaccaaattcttgttctacttgaactgctttaggtgaacacaaatccatgtatgttcccaagccctctgctatagctctttttgagccattcttccaacttttgggtcttgtatatcccatcctcccttgatttttctttttgttgttttttctagaggcagggtctcactttgttacccaggcaggagtacagttgataacgatcatagctcactgcctccttgaattcctgggctcaagggatcctcctgcctcagccccctgagtgtctaggactggaggcacatgccactgtgcctggctcatttttaaaattttttttagagacggggtctcaccaacttgtctgggctggtcttgaactcctgggctcaagcattcctcctgcctccgccttccaaagtgctggagttacaggcatgagccactgcagctagcctgatttttctttcccactgttttccattgctaatgctagatctttgataaggaacttttgccagtaaaagtggtttagtgagatgggtccagaattaaaactaatttactaccttagcttatgtgatatttgcatatttaatgtgtatttttgtgaaaacatttttatagcctgttgacaattttattcacctaaatctactcgagtagactataaattcagtgtatttggagtttttgtaaactatagttgttaacttataaaaacttgttttcattggtaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcagtaagtgttgaaatttgttgaatgttgatcagtgtaaattttggtaatcttactttgacatgttgacatagatatagtttcagtaaggctagatgtgcaggtgctgttctagacttagttgaacagtcatttttagttacctttatatatataatttttttttacaaaataatattcgaaatagggtttaattttctggattaatgttgtaaaacatggcatttattttttgtacttcttaaagcttcagttttgtagattattgaaaaattgccaaatgcccacgtttactattttttttcttttgctattgtatcagatcctgcatccaactctttggtcatgacttttagatggattcttgattgattagtttaaagaatagtgggcttctaaatacattgcagtttttgaatatcatatgataaaaccagttttaaaacaggctggcttaagtccttctggaagtaaactcatattttactcagtcttgccattgaatgtcatattaaagttgtttaaaaaatttttttaaaattttctttatggtgttagtcatacctcttacaaaaataggttttctgtgatttttgaattatttactgaagtgtagtactaggttaaaaatagtttcattagctaaaatctgcagtgttacagctgaaggatattctttttatgtttgcaaaggatgggctatggccttgaaaggttgttctgagtttaaggagatagtatttggtgcctaaggctagttgcggtggctcatgcctgtaatcccagcactttgggaggctgaggcaggtggatcacctgagagcaggagtttgagaccagcctgaccaacatggtgaaaccccatctctactaaaagtacaaaaattagccgggcatggtgggcgtgcctgtaatccagctactaaggaggctgagacacaagaatcgcttgaacctgggaggcagaggttgcagtgagccaacatcatgccactgtactcccagcctgcgtgacagagcaagtctctgtcagaaaaaaaaaaaaaaaattggtgtttaagaacaaagtattctaggcttataatcaggaaagtttgaaatgcattgcacactgctaactccctttcttggaagttcacaacacatacaagtatagtaaatgccctgagaaatcctgtagtaagaaaatacacttgtaaactttggcaaccttcatcttaatcacttttggataatgaaaccttagaaaaatctaatgaaaaccacagatacaagagaatattggcacatttttaaaaatttcagtaattcatctatccttgaagtccttggctcctaccttgaaccccatgtgaagaatctgacggatggtttaaaaagcaagtttgaacaggagtgaaagaggtgacatttttcttagcatacacattatcagccttgaagtaattttctggttataaaggtttaggagaagctggtttatttagtaaattaattggtaatctgaagctattcagaaagttactgcgcttttccaagattactgttggtgctaccagagaagatttaagtagataatggccatttagagacagggccgttaggcaactcagaactttctatttcctagtgctttgccctcacagagatgctctttgtcatataaataaatgaagaaaagctgacattttaaatttcagcattgtctcattcagatagttaatttgaatctgatagggcaatacttcataaacttgagtttcacatgaatctccttaggaatacagttttaagtgcagattctgattcatttgacttggaagggacttgagagtctgccttcctaacagactctcttgtgttgccagtattggtctgtggactacacttcaagtagcagattttacaggaaccttagctaatttatggctatgaccacctaaccctagaaatattggtatgttttaatttttctgaaacccctttattctcgggaattacttttccaaatatataattcagccttttaacttcaagacaaagattgacattctgatctttgtgctcttgtccttcatattgaagtataaaaatacctgctgtttgaaatgtacagtcacatttgctcaacaagcattcaagaccatctgtcagtgagtgccccactttaaggcacacacacacacacacacacacacacacacacacaaataaaaggcttgatagcagaatcaaactatacatagcagagccgaagtaatatggggtaaaatcaaattagctcaatccttgctattcaaactctgaactgtggacaagcagcattacatcatctgggatattattagaaatgcgtgcttttgggcctcaccttatgccaactaaatcagtatgtatttttcttcagtatgcattttggcaagatttttggtatgaagatatgtacgtgaaagtctgaaaagtactgaactagaacactggtttatgtggtttttgttccttttgtgctataggaatggtcaagatttgttagaaaaaaggatttttactgtatctttaacctccacctcccgggttcaaacaattctcctgtctcatcctcccgagtagctgggattacaggcatgtgccaccacacccggctaattttgtatttttagtagagacggggtttctccacgttggtcaggctagtcttgaactcccgatctcaggtgatccacccccattggcctccggaagtggtgggattacaggtgtgagccacagcgcccgaccaatttttattatatcttaaaggaagtggtaaatagaggtgggtggggaaaagtttagaaagcctttcaaattgttactacagtaagaaaagtatagagtggggaacaagcaggatgagaggaattgggaacggatatgacagatatttcagcatagtgggaattacactgctgtcttgagagatatggtacagccagttatactgtcccatacttactagactgatccaaatatatatgtgttttttgtgcatgttgacattctttcagaagtagcttgataaatctcatataactttgtttcccatgatggtaatgtgttttaatccttagaaggtctttatatatgaaaatagatattgcatatgaggtaagaatatataaattatgtaataatcgtattttaaacttgagttcagacttagaccttatgagttgaaggtgatttcctgccttactgagtttttctgttatcagacctataatttgtttacactatactcttctgatattattagtagtagccaagattttcttcactcttttcttggaaaattggatagaactgttaaggtacagccttctgggttcttactgtccttgaatcttttcatttcttccttcctccctttcctgttgcacactaatgaagatggacatgaaatggacgtgaaacattaggcaaggcaaggcctgacagatttggctggtaaacaactagtcaactttttgaatttagacagttattaattacttaggcagagaaaaaagtagtccaaggtgccatttctctgtgccccttgtctcacacttgaaaagagtgacaccgaaataaaaggggctagctaacgattgtcccttgaatggtgggacaccctgttgctgaggaatcattgttatactgcagctaagcctgtttagtctgcaaatgtaccctacaaggttgaggaagaaaggtctcatgtttcattagaacctgagaggagatgggaaactctcctgacagaagcatcctggggcaagagagaggtgagtggaaaacgtccatccatatagcaacttctcacaagcctctcttgtccatgttccaggatgattccatggccttctgccaagacagcttgcactgtgattcagaccttaacctctctgcgctctttggacatgtgcaaggtctccagagtgccatggctgatctctttcccttcagtggaggctcaagtagaagtactgtttcttctactaatgtcaccccctcatgctgagaaaaacagaatgagaaagggaaagagtggtgaagtggcataggcgataacatccttatctctcatcagtcacacattagtaccttaactttggaaatctagcctttgatgtttttaatttgggactcatatataaaaccagttttttttttttctcttttcgtagcatcttaataattatagcctacttctcttcacagtttcagctattttggaggatgactgtatgtattcctttttaaagtacctattgggactccccactgagaatttcgtatatgccacattaagtgcattttaattttgattaaaatttattcatcacttttcatgtgatacagtaacagcatttaaatgtttaatttcacttatataaatgttcatgttagaataacatacttaaaatctttttctttagatcattgtatgttattaaatgagcaatagtactaccagtcatgtcattttacatattgcttttggcactcatactctttattgctggttttatattaagatcaataataatcaagaggtctctcttttcagtaaatttcatgcagactcggtggcagaggctaaactttagtttgagagaccagtgaaaaaacctggaacctaaagttgagatgatgaagtcttacataatggccttggaaatagagagggagggctgaatctagatgggatatcacagataataaattgacaatatttgggaaaattatttgttgttagtagacctgtgcggtgatctggaagatgcaagcaaggctttagggtctgctggctttttcctagagtgtcaggagcatggtcagatctccatgattcttggagaaagctatgttggaggagatccttgcaattcctcctgttattaacccttccccttacccccaagagtagcagtgttttgctactgcaagctactagttggcagaaaggttattgagtaagtaggtggcagtcttccttaaccctgtacatgggagagcattagtctttgcagctgaagagactaagcagtagagaagattcctctcattgtcttgatgagggactgacagcttgctagcgaaaatgttgcttgaccacaggaatgagacttccatgcaccctcatcttgccattattaaagctatccagcatttgggtccagccttaagagaaggtgagagtcatgactaggccagtgaatataacagtgcatataaaagggacctagttaccagggagaaaacagaagtagaccactgaaagaggcaaaacctagtgaaaatagaattattgaacaaaatattgaacaaatacacttgaacaaaataataagggcacataagcagattgaattataacaaattctttagagctagaaaaaaatgacattaagttttaatgtttagattatttaaaaaagaggacacgtgctattaagttccaaattacaggcctagaaaatcagggggaagaattatgtcattaaatggaatgaaagtactaacagataaaatcaagagaagacgattagagacttacaagaagttctgaaggggaaaataaaaaaccaggtggacaagcaataactaaataatagatgggatgaagaaagacttgagactgcagatcagaacagctggctgttgtctagccaggagagaagtgagggaaacacacaaacacctatgcagagtctggcaaaatccctgaattccaaggaaaaagtaaaaatcctctaagcttccatatgaaagaccaagttgcatacaaagaaaaagaaccaaaccgacaccaggcaatcttccttaccacacaagcagaagtagaaaaaagtggaatgacgctacacagttgacaaagaactgcaactcaggaaccttgtactcagccaaaggaccctccacatgtcagaatgaaaaggagatactagtttatcctatctgaggaaaactaaagaaacaa

SEQ ID NO: 1979 - DNA, 3228 bp, Homo sapiens
gcaggcatctctcagacttaaacattgcttcataggatatttaaacacgccaattgaaaacaataataacaatgacaatttatgaaggttgcattcccaaatgtatttgagaaattctagtttaagaaaagtgaacatgtttctttatttcaagacttcccgatgtcttagaatagtcagacatcaaatttcatccacagtttccagagttgctatttctttcccatacctttgctttggaacttgatctaatggaattgttactgttactatgacatttttcatgtgtactatgtcctaaaaacactgtggttgcattcattttattttatttttgagagatgaatctagggcctcttgaactttttattcgtagttatgctgagtactagcttactttaaaaataagtctccagtacttgtgaggaagactcattgtcagagcatgaaagatttttctgccttttgttttgacttctaagatacgtttctttattaaggaatagttttatgctttgcagaagatgcattgtaccataaaaaccagtaaaatctgtgcattaaaaaaaatacctggatttaaaccagttacttggcattctgtgaaggtaaaggaatacatttttaccttaaatgatagtgtttatattttgttcacacagaaaaaaacaaaataaaaacaagcaactcttagtgattctgcatatagttatagtggttgtggacctttaaatattctccatcagttatgttttttaaaagcagaattttgtaaactttactaaattcaagctgctctcctgtctgcgatggctgaggacattggaagaatacttctgtacttttccatgacagccagtgtcacctcctggaagcaatcattcgtagattacttataaattttactcctagaatagcaatggtcactttagacaaatgaaatcatgcaaagagctggtatcaatttcccacctatacccactttcacccaagtcaggagggggcaatgtggaacttggtgtgggtccaagtcctaagtgaattattcctagtatagcccgttgaaatggcaaataaatggccacttagagaatgtttgagtgaaacaaattggtcgtctgttatttttaggctacttattcataaaatccaagctatattatctctggcctcatgatgctctaaataattttctgttgtagaacccatatgcttatggttatccaagagcttctaaaatctactttggtaagatgaggaaatattttatatagtatacaaaccctgtattttatatagcatacaaaccctgtagcctaaccgtcctgccatcttaattgtacagtttgctgctataattattaatagattgtaaattaggaacatctggccaattattagaaacacaaaaataaatcatgaaattgatatgagagcctaaagtgatgaccatcaaaaaggcaggcaggaatattttgtatttggtccttcacaggtaaataatttaatgcctgcctaatataatcagttacctttcttgtaaatttaattctttgatctccatttccttttgtagcagcaatttccaacataaatttcagcagcagaaaaagaatcaggaccctataatataaagcaactgtttttttgctttataatgtatttatgtggatcatcattctcatttctggtttctatatagtctaaaaggcaaggatagttcccctccccaagatatgggccattttatggattatataataaatgggctctaaaggtaaattgttattattcaaaaccagctggtcaggcaggcaaggcagcttagatacagtgaattctgttttgctctagtggaaaatgtcatgctgacaaggtcagtgctgggaactggtgtcatccagaagcaggcatgcagcacctggggaaggctgagaaggaggcccctgctctgtttgctgttggtcaaatgagtgccagaaatgcagggcttcagcagcacctagaagtccaggtttagcagtaggtttgggggctcacataatctgtactagtgattgttattgttaatcacataattactagtgtgttgttagagcatattgtgctttaaataggatttcccaagaaactaaaacgtcatggtgtttttcactgaccacagctgtcttgtggcaatctcttgagcagtcaacatctatggctggcgcaataagtcattaaatcaaaatacatcaattactggttttcaaagagagtcttgatttctgcataatgtgacttacataagggtaactgtattgttgctgagtgtgattgcacaaagaactcactgggcactgctttaacaaatgaaagcaggtcagagggaaatgtatcctttataaatggcttcatctattcattcaatttaggaaaccatttcttttaggctggtaatttaaggatagcactgctgaggactaggaatttgtttttacctgtactatttcatctgattataaaagtaatatatgccgaccaaaaaaaaaaattacacaaataaatgtcttacagagaatgcaatctgttgaaatcctacccctcagtaccactgtcaccagtttgctgcacatctttcagatattttccatgtaaaatacatacatatgcatttctgcaattcgcttttcccctgtagcatttaaggggatatgtattttagaaggacattttctgatatatctgaatattcctgatagaaattaacttttctatatatcagcttttaaaaattatgtgtgtgcctggaataggttaagatagagacattttcaatgcctgtttattgctgtaatattcaaaatccctgagagactgtggatagtttattagacagaattagaaagaataactgcagtactaagctttttgctacagagtgggcttccagtgcacaaagcattatgattatttggagacaatctgtagccttggaaacaatatggcgatagtgacatcagtagcaattatgtgtaatttttatccccagtttatcaccaaggtaaccagagcaggtctccctgcttgaaattttaagaatgtcgtagtcttatatacagcaaggatgtaggaaaggattatattcagaattctttctacagttcattctatttcccttataaaagagctctttagaattctaatagcacacatctatttttggcaacagccgcaagtttttgaagc

SEQ ID NO: 1980 - DNA, 1127 bp, Homo sapiens
attgtgctttaaataggatttcccaagaaactaaaacgtcatggtgtttttcactgaccacagctgtcttgtggcaatctcttgagcagtcaacatctatggctggcgcaataagtcattaaatcaaaatacatcaattactggttttcaaagagagtcttgatttctgcataatgtgacttacataagggtaactgtattgttgctgagtgtgattgcacaaagaactcactgggcactgctttaacaaatgaaagcaggtcagagggaaatgtatcctttataaatggcttcatctattcattcaatttaggaaaccatttcttttaggctggtaatttaaggatagcactgctgaggactaggaatttgtttttacctgtactatttcatctgattataaaagtaatatatgccgaccaaaaaaaaaaattacacaaataaatgtcttacagagaatgcaatctgttgaaatcctacccctcagtaccactgtcaccagtttgctgcacatctttcagatattttccatgtaaaatacatacatatgcatttctgcaattcgcttttcccctgtagcatttaaggggatatgtattttagaaggacattttctgatatatctgaatattcctgatagaaattaacttttctatatatcagcttttaaaaattatgtgtgtgcctggaataggttaagatagagacattttcaatgcctgtttattgctgtaatattcaaaatccctgagagactgtggatagtttattagacagaattagaaagaataactgcagtactaagctttttgctacagagtgggcttccagtgcacaaagcattatgattatttggagacaatctgtagccttggaaacaatatggcgatagtgacatcagtagcaattatgtgtaatttttatccccagtttatcaccaaggtaaccagagcaggtctccctgcttgaaattttaagaatgtcgtagtcttatatacagcaaggatgtaggaaaggattatattcagaattctttctacagttcattctatttcccttataaaagagctctttagaattctaatagcacacatctatttttggcaacagccgcaagtttttgaagc

SEQ ID NO: 1981 - DNA, 1427 bp, Homo sapiens
atcagactctttcctctgatggattagaagcaaattggatcctgctttctaggaatagatccagtttgaagaaaaggaggccttattttttaaaattctagtaaattcttaaaagtctattaagtataatttacatacagtaaaattcagtttgagaacactagatcccctccataatcaagaaaaagaacaaggagacacaggtccttcctccaaggagcttgcattctaatacagaaagtaagaataaaaagagattaaagatatgaaagcacctgaaacttttaaggggggtgtgtcagtttgactagtgatatcccaaaattcatgtccattcagaacctcagaatgtgactttagttggaaacaggatttttgcagatgtagttaattaaaaatgaggtcatactggatgaaggtgggtcctgaagccaatgactggtgtccttataaacatgccatgtgaaggcacaaagaagaactccaaaaagttcccttatgcccttcttgacatccacccccctcaccctcagcccctgataaccactaatgggttttctgtcctatagtcttacctcttccagagtcttgtccttatagtcttgacactgtaaatggagtcatacagcgtgaaacttttgagtctggcttttttcacttagcataatgcttctgagattcatctgcgtgttgcgttttttagtagttcatttattttcattgctgagcagaatttcagtgtatagatgtaccacaattttattcatttaccagctgaaggacaattggattgtttccagttcttggtgattatgaataaagctgctataaacatttagagcattttccttttgttttttttttttttttgagacggagtctcactctgtcgcctaggctggagtgcagtggtgcgatctcagctcactgcaaactccgcctcccaggttcatgccattctcctgcctcagactcccaagtagctgggactacaggcgcccgccaccacgcccagctaatttttttttttttgtatttttagtagagacggggtttcaccgtgttagctaggatggtctcgatctcctgacctcgtgatccgcctgcctcggcttcccaaagtgctaggattacaggcgtgagccaccgcgcccagccttagagcattttccttttgagtaaaatgtatagtaaagtaaataactttgcttcacaggaaaccagaactgtaggagcaggaatgatcctagaggtggaagttgttttctttttgattagctgacaggtatagttattttatacttttgcatagcaatttatagtctattcaaagcactttcacacaccttacttcctgtaattatcattatagtaaccctgagaagtaggctaggaatcttgcttcattttacagatagaagctagga

SEQ ID NO: 1982 - DNA, 17747 bp, Homo sapiens
attatgacacccttctaatataacacctttcttcaggcaagttacaagatgctcttccttcccacctttcacacatattttaagctccatattaaatactacaacttatatgaagccttttcttactaccaactggaaatgtttttttgtttttttgtttttttgtttttgagacagagtctcactctgtgcccaggctggagtgcagtggtgtgatcttggctcagtgcaacctccgcctcccaggttcaagtgattcttctgcctcagcctcccgggtagttgggactacagatgtgcaccaccaggcccagctaatttttttgtatttttagtagagatgttatttcgtcatgttggtcaggccggtctcaaactcctgacctcaaatgatccacccgcctcggcctcccaaagtactggggccaccgtgagccaccaggcattagccaccatgcccggctagaaatgacctttataatctgaattgtgtacctgttttggagcacatgtcacattctgccatgtattaccatgtacctgtttttcccacctgtcccctagattttaaaccctttgaatgtaggagctgatcttacccttgtatttgctttgcatacaactgaccctcaggaagtaatcttgcaacttggcagttgttctcaaccttcatttcaaaagccaaaagccaactatttctacctttaaatcggctccacccttctaaatactgagaatctaaatcttacatcctttacttatatagttctaaaaagaaaaatgctcaagtttcaactttcatgtaagaaagcctgaactacttaatgttcagaaaatcagtaatttccaatgttgcagtgtggctaattgttaaggttcctaaccctagcctactgtacagttttgaagctagaaattgtgccttaatcctttcacaatgtgaggatatattaaaatatcctcaattagtgcttatttgaattagaaatgaatcaaaatgattttctgtcctgagaagagcaacttttaaatatcatataaagtgatacatgcttgcttaaaaaacaagtaaaaacttaaaacaatacaaaaggaatacagtgaaaactaccttcctcccacaagccttaccccaagtccctgttaacagtttcttatgccattaatatgcaaggaaataaatatgcacattcttacattcttttataatatacatttttttttattattatactttaagttctagggtacatgtgcacaacgtgcaggtttgttacatatgtatacatgtgccatgttggtttgctgcacccattaactcatcatttacattaggtatatctcctaatgctatccctcacccctccccccaccccacaacaggccccggtgtgtgatgttccccttcctgtgtcctggtgttctcattgttcaattcccacctatgagtgagaacatgcggtgtttggttttttgtccttgtgagggtttgctcagaatgatggtttccagcttcatccatgtccctacaaaggacaggaactcatcattttttatggctgcatagtattccatggtgtatatatgccacattttcttaatccagtctatcattgttggacatttgggttggtcccaagtctttactattgtgagtagtgccgcagtaaacatacgtgtgcatgtgtctttatagcagtatgatttatattcctttgggtatatacccagtaatgggatagctgggtcaaatggtatttctagttctagatccctgaggaatcgccacactgtcttccacaatggttgaactagtgtacagtcccaccaacagtgtaaaactgttcctatttctccacatcctctccagcacctgttgtttcctgactttttaatgattgccattctaactggtgtgagatggtatctcactgtggttttgatttgcatttctctgatggccagtgatgatgagcattttttcatatgtttgttggctgcataaatgtcttcttttgaaaagtgtctgttcatatactttgcacattttttgatggggttgtttgattttttcttgtaaatttgtttgagttctttgtcgattctggattttagccctttgtcagatgggtagactgcaaaaattttctcctattctgtaggttgcctgttcactctgatggtagtttcttttgctgtgcagaagctctttagtttaattagatcccatttgtcaattttggcttttgttgccattgcttttggtgttttagacatgaagtctttgcccatgcctctatcctgaatggtattgcctaggttttcttctagagtttttatggttttaggtctaacatttaagtttttaatccatcttgaattaatttttgtataatgtgtaacaaagggatccagtttcatctttctacatatggctagccagttttcccagcaccatttgttaaatagggaatccttttcccatttcttgtttttgtcaggtttgtcaaagatcaggtagtgtagatgtgtggtattatttctgaggcctctgttctgttccattggtctatatttctgttttggtaccagtaccatgctattttggttactgtagcctcgtagtatagtttgaagtcaggtagtgtgatgcctccagctttgttcttttggcttcagattgacttggcaatgtgggctcttttttggttccatatgaactttaaagtagttttttccaattctgtgaagaaagtcattggtagcttgatggggatggcattgcatctataaattacctagggcagtatggtcattttcacaatattgattcttcctatccatgagcatggaatgttcttccatttgtttgtgtcctcttttatttcgtagagcagtggtttgtagttctccttgaagagatccttcacatcccttttaagttgcattccgaggcattttattctctttgtaggaattgtgaatgggagttcactcatgatttgtctgtctgttattggtgtataagactgcttgtgatttttgcacgttgattttgtatcctgagactttgctgaggttgcttatcagcataaggagattttgggctgagacgatgggactttctagatatacaatcatgtcatctgcaaacagggacgatttgacttcctcttttcctaattgagtaccctttctttctttctcctgcctgattgccctggccagaacttccaacactatgttggataggagtggtgagagagggcatccttgtcttgtgccagctttcagagggaatgcttccagtttttgcccattcagtatgatattggctgtgggtttgtcataaatagctcttattattttgatatacatctcatcaatacctaatttattgagagtttttagcataaaaggctgttgaattttgtcaaaggccttttctgcatctattgagataatcatgtggtttttctctttggttctgtttatatgatggattaagtttattgattttcatatgttgaaccagccttgcatcccaggaatgaagcccacttgatcatggtggataagctttttgatgtgctgctggattcggtttgccagtattttattgaggatttttgcatcgatgttcatcagggatattggtctaaaattctcttgttttgttgtgtctctgccaggctttggtatcaggatgatgctggcctcataaaatgaattagggaggatttcgtctttttccattgattggaatagtttcagaaggaatggtaccagctcctccttgtacctctggtagaatttggctgtgaatccgtctggtcctggactttttttggttggtaagcagttaattattgcctcaatttcagagcctgttattggtctattcagagattcagcttcttcctggtttagtcttgggagggtatatgtgtggaggtatttatccatttcttctagattttctagtttatttgcatagaggtgtttatagtattctctgatggtagtttgtatttctgtgggatccgtggtgatatgccctttatcacatctatttgattcttctctcttttcttcattagtcttgctagcagtctatcaattttgttgatcttttcaaaaaaccagctcctggattcattgatttttcaaagggttttttgtgtctctatctccctcatttctgctctgatcttagttatttcttgctttctgctagcttttgaatgtgtttgctcttgcctcgctagttcttttaattgtgatgttagggtgtcaattttagatctttcctgctttctcttgtgggcatttagtgctataagtttccctctacacactgctttaaatgtgtcccagagattctggtatgttgtgtctttgttctcattggtttcaaagaacatctttatttctgccttcatttcgttatgtacccagtagtcattcaggagcaggttgttcagttcccacgtagttgagcggttttgagtgagtttcttaatcctgagttctagtttgattgcactgtggtctgagagacagtttgttataatttctgttcttttacctctgctgaggagtgctttacttccaactatgtggtcaattttggaataggtttggtgtggtgctgagaagaatgtatattctgttgatttggggtggaaagttctgtagatgtctattatgtctgcttggagcagagctaaattcatttcctggatatccttgttaactttctgtctcgttgatctgtttaatgttgaccgtggggtgttgaagtctcccattattattgtgtgggagtctaagtctctttgtaggtctctaaggacttgctttatgaatctgggtgctcctgtactgggtgcatatatatttaggatagttagctcttcttgttgaattgatccctttacgattatgtaatggccttctttatctcttttgatctttgttggtttaaagtctgttttatcagagactaggattgcaacccctgccttttgttttccatttgctcggtagatctgtctccatccctttattttgagcctatgtgtgtctctgcacgtgagatgggtttcctgaatacagcacactgatgggtcttgacttttcatccaatttgccagtctgtgtcaattggagcatttagcccatttacatttaaggttaatattgttatgtgtgaatttgatcctgtcattatgatgttagctggctattttgctcattagttgatgcagtttcttccgaggatagatggtctttacaatttggcaagtttttgcagtggctggtaccagttgttcctttccatgtttagtgcatccttcaggagctcttgtagggcaggcctggtggtgacagaatctctcagcatttgcttgtctgtaaaggattttatttctccttcacttatgaagcttagtttggctggatatgaaattctgggttgaaaattcatttctttaggaatgttgaatatgggcccccactctcttctggcttgtagagtttctgctgagagatccactgttagtctgatgggcttccctttgtgggtaacccgacctttctctctggctgcccttaacattttttccttcatttcaactttggtgtatctgacaattatgtgtcttggagttgctcttctccaggagtatctatctttgtggtgttctctgtatttcctgaatttgaatgttggcctgccttgctaggttggggaagttctcctgggtaatatcctgaagagggttttccagcttggttccattctccccatcacttcaggtacaccaatcagatgtagatttggtcttttcacatagtcccctatttcttggaggctttgttcgtttctttttattcttttttctctaaacttctcttctcacttcatttcattcatttgatcttccatcattgataccctttcttccagttgatagaatcggctactgaagcttgtgcattcatcacgtagttctcttgccatggttttcagctccatcaggtcctttaaggacttctctgcattggttattctagttagccattcatctaatcttttttcaaggtttttaacttctttgcgatgggttcgaacttcctcctttagctcggagaagtttggtcatctgaagccttcttctctcaattcgtcaaagtcattctccgtccagctttgttctgttgctggtgaggagctgtgttcctttggaagaggagaggcgctctgatttttagaattttctgtttttctgttctgttttttccccatctttgtggtttatctacctttggtctttgatgatggtgacctacagatggggttttggtgtggatgtcctttctgtttgttagttttccttctaacagtcaggaccttcagctgcaggtctgttggagtttgttggaggtccactccagaccctgtttgcctgggtatcaccagcggagggtgtagatcagcgaatattgctgaacagcaaatattgctgtctgatcgtttttctggaggtttcgtctcagaggggtacctcgccatgtgacatgtcagtctgcccctactggggggtgcctcccagttaggctactcgggggtcagggacccacttgaggcagtctgtctgttctcagatctcaaactctgtgctgggagaaccactactctcttcaaagctgtcagacagggacatttaagtcttcagaggtttctgctgccttttgtttggctatgacctgcctccagagatggagtctacagaggcaggcaggcctccttgagctgcattgggctccacccagttcgagcttcctggctgctttgtttacctactcaagcctcagcagtggcaggcgccccacccccagcctcactgctgccttgcagttcgatctcagactgctgtgctagcaatgagcgaggctccgtgggcatgggaccctctgagccaggcgcaggatataatctcctggtgtgctgtttgctaagaccgttggaaaagcacagtattagggtgggagtgacccgattttccaggtgccatctgtcacagctttgcttggctgtgaaagggaattccctgaccccttgtgcttcctggatgaggcaatgccttgccctgctttggctcacgctcagtgcgctgcacccaccgtccgacaagcccctgtgagatgaacccggtacctcagttggaaatgcagaaatcacccgtcttctgcatcgttcacgctgggagctgtagactggagctgtgcctattcggccatcttggaactgtcctcttatattcttataaatcaaactctgatattacaaaacctacagccactgaaggcatcaaagcccccctagaagttcactttaccaacaatggtccatacagcatcttttgtgaagctttagtataggattggatagtaggcttcaagtttggatatttttaccaaacaattttttttaaaagaatcttcccatagtctttcccaggaaccctataactctgatcaggtctgggttttcatgactcaagtgtcatgtttatgtaggcacacttacatcctatgaaaaccaaaagtctccatgagaacagtgagaaaagtcaaaatcagagtgagcccaaccgaagaacgttaaggacaggattcatccatacccacagtgttctgtctctgggacttgcttgtctgtttttaaacaaactctgttctgtgtaattggacctccgattaatacactgtctcagacaggctggccagtatgggcataaactgtcaaaagtttaggattggatgatttaaaatgatccagattcaatccccagaatcttgcatttctgctggacttctgctggactgccagccaccctgattacccctccaaatgatgcccacttcctggattagcagccagtatcacctgactcaccctctggtgaggctgtatctgaggctacagagtcttagatcttccctgttatttttcccccatcccaagcatctataaactggccagaagcttcatgagggtgattttagcagagggtaaaattatcataaaagtaccatcaccatctaaaaacaaatataccctgaatcctttttcttgtaataccttttttatatcagaactaagggtatactgaagactaatgttaaaagccacacaacgggctgggtgcggtggctcacacctgtaatcctaacactttgggaggccaaggcaggtggattgcctgagcttaggagttcaagaccagcctgggcaacatggtgaaactccatctctactaaaatacaaaaaattagctgggcatggtggcacatgcctataatcccagctactcacgaggctgagacaggagaatcacttgaaccttggaggcagacattgcagttagccaagattgtgccactgcactccagcctgcgcaacagagcgagactctatctaaaaacaaacaaacaaaacccacacaataatgaactagaatgtaattcctctaatgaactcagctataatattaatgatctgatttccattccaagacggccaaataggaacagctccattctacacctcccagcatgatcaacacagaagatgggtgatttctgcatttccagctgaggtacctgcttcatctcattgagactggtcagaaagtgggtgcagcccatggagggcgagctgaagcagggcggggcattgcctcacctgagaagcacaagggatcgggggatttccctttcctagccaagggaaaccgtgacagactgtaccaggaaaatcgggacactccacctaaacgtggcacttttctgaaggtcttagcatgcagcacaccaggagattatatcctgcacttggcgcagtgggtcccacccccatggatccttgctcattgctagtccgagatcaaattgcaaggcggcaagcctggctggtggaggggtgtccaccattgctgaggcttgagtaggtaaacaaagctgccaggaagctcgaactgagtggggcccaccgcagctcaacgaggcctgcctgcctctgtagactccacctctggaggcagggcatagctaaacaaaaggcacagaaatttctgcagatttaaacgtccctgtgtgacagctctgaagagagcagtggttctcccagcacagtgtttgagctctgagaacagatagcctgcctcctcaagtgggtccctgacccccgtgtagcctaactaggagacacctcccagtagaggccgactgacacctcatacagctgggtgcccctctgagacgaagcttcagaggaaggatcaggcagcaacatttgctgttctgcagcctccgctgcttatacccaggcaaacagggtctggagtggacctccaacaaactccaacagacctgcaactgagggacctgactgttagaaggaaaactaacaaacacaaaggagtagcatcaatatcaacaaaaaggacatccacaccaaaaccccatctgtaggtcaccatcatcaaagaccaaaggtagataaaaccacaaagatgggaagataccagagtagaaaagctgaaaattctaaaaaccagagtgccccttctcctccaaaggaacgcagctccttgccagcaacagaacaaagctggacggagaatgactttgacgagttgagagaagaaggcttcagatgaccaaacttctccgagctaaaggaggaagttcgaacccatcgcaaagaagttaaaaaccttgaaaaaagattagatgaatggctaactagaataaccaatgcagagaagtccttaaaggacctgatggagctgaaaaccatggcaagagaactacgtgatgaatgcacaagcttcagtagccgactctatcaactggaagaaagggtatcaatgatggaagatcaaatgaatgaaatgaagtgagaagagaagtttagagaaaaaagaataaaaagaaatgaacaaagcctccaagaaataggggactatgtgaaaagaccaaatctacatctgattggtgtacctgaaagtgatggggagaatggaaccaagctggaaaaccctcttcaggatattacccaggagaacttccccaacctagcaaggcaggccaacattcaaattcaggaaatacagagaacaccacaaagatagatactcctggagaagagcaactccaagacacataattgtcagatacaccaaagttgaaatgaaggaaaaaatgttaagggcagccagagagaaaggtcgggttacccacaaagggaagcccatcagactaacagtggatctctcagcagaaactctacaagccagaagagagtgggggccaatattcaacattcaatgtgcagagacacacacaggctcaaaataaagggatggaggaagatctaccaagcaaacggaaaacaaaaaaaggcaggggttgcaatgctactctctgataaaacagagtttaaaccaacaaagatcaaaagagacaaggaaaaccattacataacggtaaagagatgattccaacaagaagagctaactatcctaaatatatacaggagcacccagattcataaagcaagtctgagagacccacaaggagacttagactcccacacaataatagtgggagactttaacaccccactgtcaatattagatcaacgagacagaagattaacacggatatccaggacttgaactcagctctgcaccaagcagacctaatagacatctacagaactctccaccccaaatcaacagaatatacattcttttcagcaccacatcgcacttgttccaaaattgaccacatagttggaagtaaagcactcctcagcaaatgtaaaacaacagaaatcataacaaactgtctctcagaccacagtcaaattagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacatttaaagcagtgtgtagagggaaacttacttatagcactaaatgcccacaagagaaagcaggaaagatctaaaattgacaccctaacatcacaattaaaagaactagagaggcaagagcaaacacattcaaaagctagcggaagccaagaaataactaagatcagaggagaactgaaagagatagagacacaaaaaacccttcaaaaaaaccaacgaatccaggagctggttttttgaaaagatcaataagattgatagactgctagcaagactaataaagaagaaaagagagaagaatcaaatagacataataaaaaatgataaacggcatatcaccactgatcccacagaaatacaaactaccatcagagaatactataaacacctctatgcaaataaactagaaaatctagaagaaatggataaattcctcgacacttataccctccaaagacagctgaattgctgaatagaccaataacaggctctgaaattgaggcaataactaacagcctaccaaccaaaaaaagtccagggtcagacagattcacagccgaattctaccagaggtacaaggaggagctggtaccattccttttgaaactattccaatcaatagaaaaagagggaatcctccctaactcattttatgaggccagcatcatcctgataccaaagcctggcagagacacaacaaaacaagagaattttagaccaatatccctgacgaacatcgatgcagaaatcctcaataaaatactggcaaaccaaatccagcagcacatcaaaaagcttatccaccaaaatcaatttggattcatccctggatgcaaggctggttcaacatacgcaaatcaataaacttaatccatcatataaacagaaccaaagaagaaaaccacatgattatctcaacagatgcagaaaaggccttggatataattcaacagcgcttcatgctaaaaactctcaataaactaggtattcaaggaacatatctcaaaatagtaagagctatttatgataaacccacagccagtatcatactgaatgggcaaaaactggaagcattccctttgaaaactggcacaagacagggatgccctctctcaccactcctatccaacatagtgttggaagttctggccagggcaatcaggcaagagaaagaaagaaacggtattcagttaggaaaaaaggaagtcaaattgtccctgtttgcagatgattgtatatttagaaaaccccattgtctcagcccaaaatctccttaagctaataaggaacttcagcaaagtctcaggatacaaaatcaatgtgcaaaaatcacaggcattcttatacaccagtaacagacaaacagagagccaaatcatgagtgaactcccattcacaattcctacaaagagaataaaatacctcggaatgcaacttacaagggttgtgaaggacctcttcaaggagaactacaaaccactgatcaacgaaataaaagaggacacaaacaaatggaagaacattccatgctcatggataggaagaatcaatattgtgaaaatggccatactgccctaggtaatttatagatgcaatgccatccccatcaagctaccaatgactttcttcacagaattggaaaaaaactactttaaagttcatatggaaacaaaaaagagcccacattgccaagacaatcctaagccaaaaaaacaaagctggaagaatcacgctaccggacttcaaacaatactacaaggctacagtaaccaaaacagcatggtactggtaccaaaacagagatatagaccaatggaacagaacagaggcctcagaaataacaccacacatctacaaccatctgatctttgataaacctaacaaaaaacaagcaatggggaaaggattccctatttaataaatggtgctgggaaaactggctagccatatgtagaaagcggaaactggatcccttccttacaccttatacaaaaattaattcaagatggattaaagacttacatgttagacctaaaaccataaaaactgtagaagaaaacctaggcaataccattcaggacataggcatgggcaaggacttcatgactaaaacagcaaaagcaatggcaacaaaagccaaaattgacaaatgggatctaattaaactaaagagcttctgcacagcaaaagaaactaccatcagagtgaacaggcaacctacagaatgggaggaaatttttgcaatctacccatctgacaaagggctgaaatccagaatctacaaagaactcaaacaaatttacaagaaaaaatcaaccccatcaaaaagtgggcaaaggatatgaacagacacttttcaaaagaagacatttatgcagccaacagacacatgaaaaaatgctgatcatcactggtcatcagtgaaatgcaaatcaaaaccacaatgagataccatctcacaccagttagaatggcgataattaaaaaggaaacaacaggtgctggagaggatgtggagaaataggaacacttttacactgttggtgggagtgcaaactagttcaaccattgtggaagacagtgtggcgattcctcaaggatccagaactagaaataccatttgacccagggatcccattactgggtatataccaaaaggattataaatcatgctactataaagacacatgcacatgtatgtttattgtggcattattcacagtatcaaagacttgcaaccaatccaaatgtccaacaatgatagactggattaagaaaatgtggcacatatacaccatggaatactatgcagccataaaaaatgatgggttcatgtcctttgtagtgacatggatgaagctggaaaccatcattctgagcaaactatctcaaggacagaaaaccaaacactgcgtgttctcactcataggtgggaattgaacagtgagtacactcggacacagtaagaggaacatcacacaccaggggcctgtcgtggggtggggggagcgggggagggatagcattaggagatatacctaatgtaaatgacaagttaatgggtgcagcaaaccaacacaacacatgtatacatatgtaacaaacctgcacattgtgtacatgtaccctagaacttaaagtataataaaatatatgtatatattaacgatcctcacagtgagattggaagctttgtaatatctcttaaagatcacattatagggcatctctgttctttaagtctaatctgtgatcaaaagaaataaaatattgtattttaaacatgttttctttcttacatatttatagataaggggaaggaggaggagatatccaaaggtctaaaaaagagaaagagaaaatgaatttaatcaataatgtaaaccaagttcgtaaccacatgtatgtaatatgcaacacccctgactgacatttccttgtacaaattaccttagaaagtgaacccaggcttgttttagaattatttaagttgtgtcaaaaatcacaacttagatgatcagcttgaacacaggttttctaagcaaagctgtctgtttttttctttttagtcacagatcgtattatatagtgtgtggaatatgattaatgcattattggatatgagctgtgccccatactttagatctgacatattccagttaccttattatgaagcatgtgtgttacgatctctcgccactatcaaagtataagagtttgttggccatacacttggtcttgggctggtcccaacccaggtgccaataactggttcatcatggccagaaacaggcctagaaatgtgactgcctggccctactctcaaaaacagagcactttgaagataacctaacttccaaggaaggagccacgctggaaataacataactgtttgtgttatgttattgaaaagaaaagatctccatgaatttctttttttttttttttaagccaactttgacagcctctttccttccagatggtgcctggagccaagcctgtcagagaaccttagtctcctgctgccttttaatgctggtccttgattgctaatgacccctggctggactggcttctcaacccatttaacccctctctgctgggtccccatctcatgcaggatgagcggccacgagagctggaagtgggaaggtgccaagtcagccagagcctcccacccttccagagctggtggcgcgtttcccggtgccatcatggatgtccaagatcattccagtgaagagctcatgttaatatgattttctctatattgtcagataaatgctgccaggtttctgattgttaatattttatttgactaaaccaagacaaccaagtccctgaaagaatgtttccttcaggggtcaagagctgaggaccactgatatgagcctcctggaatatgttcatttggaaacttaaaattacattgcactggaactatcttttagtttggtcgaacttcatggacaaagcatttgcttttgtgcgtgtgtgtgtgtgtgtgtgtgtgtgtgtgtgtaggcaataatttccttgtcaaggctgaaatatcacttgtataacacaggagatacccatttctcagctttgttagcaacaactgtaaccatttactttttggttaagcttggtttgttttttatgacatataggaaggtgcttatagctatactgatcaggtaggtcactcagagtgtagggtttttttttttttttttttagatggagtatcactctgccgtccaggctggagtgcagtggcctgatcttggctcactgcaacctctgcctcccgggttcaagcgattctcctgcctcaccctcccgagtagctgggattacaggcatacgccaccaggcccggctaattttttgtatttttagtagagacagggttttgctatgttggacaggctggtcttaaactcctggcctcaagtgatccacccccctcagcctcccaaagtgctgggattacaggtgtgagccaccacgccccacctgagtatagggatatttaaaaggggtgggggcaggaagctgctgatgctaatttgttgagaaatcttgagtccagtggagaaattcagatctcttgcaacctcctcaggtcagggagggcatgagaagtcatcattttatgcattatttccgtaacggatttttactaatctcatattggattgtaaaacaaggcaaagaaatttggtagttctctgtgaccctgaagaactgaaatttaaattcttgattagagcagagaactgaaagctttgtgctgccctacttgtacaaacgtcttaatgtttactggatagttggaccaaattgattttataatgtaatgtacttaagaaatttgttccaaaattcggcacaaattaggaaaataaccaaaccatacctttctatttaatctttgcttctctcagatacttactattttcttggcttttttgaagattaagactgaaagatcacaactgcatttctcaccactaacacttcattgatttcatttttacatcttattaattaaatgcaagaaaaaaattatatttgtgattttattttggtctactactgacattcttttctatttccactcaatctctctctccctctctctctctctctctcacacacacacacacctgccagacatttgtagatataacctcccccaaatcatgtcattcatactaatgactgccctctctatgtgtaaaaatattttataatttatggacctgggtggggatttgtacagctgtgcaatattaatctatacactgcaggttttgctaacagctgggcaaaggctgaggtgaggttttaatgatgtcctttagcccatcagtaaccaaatgacccagaaagtggttcaggggaacctaccttgtgcagctgtgctctttgaatgaatgaatcatgttagaatgaaattctggtgtatttatggagaactttttcctttgaagcctaaacacattttgattggtcgtatttaaattccaacaagctgaaaagcaaaagcatttatgtcagtttcacagatgaggctccaagaggttaactggcgattactctggagttacagcatcttaaagttggaagggactttaaagggcctctgggctaatggttcttacccttttcctgccttcacactggcttcaggcaacagatccccatcaggcatgtctctcactgcacacagatgttcacacactgggaaagaatgtgactccaaggagagcagctcagaatcttcaggccagaacatgtgtaatttgccacaccaatgttctccattaaaaattactacctcagtccacccctctctttatcattttacacataaaacatggcagcagaggggtaagggattcacttaaggtcacataccaatatgtgtcacaacttgaactatgtgtgccggggtcttctgatcccccatgtccagtgctggttttgctacagctgaccagccccttgcacactcacagtagaactggaactagctcctcaaagagtgaggcagagctggagacgagtgccccagggtcccctgctgcagggaatcaaagaccccgtcacaattagcttagtaaaaccaacactatctggtgtcc

SEQ ID NO: 1983 - DNA, 11748 bp, Homo sapiens
aactgtcctcttatattcttataaatcaaactctgatattacaaaacctacagccactgaaggcatcaaagcccccctagaagttcactttaccaacaatggtccatacagcatcttttgtgaagctttagtataggattggatagtaggcttcaagtttggatatttttaccaaacaattttttttaaaagaatcttcccatagtctttcccaggaaccctataactctgatcaggtctgggttttcatgactcaagtgtcatgtttatgtaggcacacttacatcctatgaaaaccaaaagtctccatgagaacagtgagaaaagtcaaaatcagagtgagcccaaccgaagaacgttaaggacaggattcatccatacccacagtgttctgtctctgggacttgcttgtctgtttttaaacaaactctgttctgtgtaattggacctccgattaatacactgtctcagacaggctggccagtatgggcataaactgtcaaaagtttaggattggatgatttaaaatgatccagattcaatccccagaatcttgcatttctgctggacttctgctggactgccagccaccctgattacccctccaaatgatgcccacttcctggattagcagccagtatcacctgactcaccctctggtgaggctgtatctgaggctacagagtcttagatcttccctgttatttttcccccatcccaagcatctataaactggccagaagcttcatgagggtgattttagcagagggtaaaattatcataaaagtaccatcaccatctaaaaacaaatataccctgaatcctttttcttgtaataccttttttatatcagaactaagggtatactgaagactaatgttaaaagccacacaacgggctgggtgcggtggctcacacctgtaatcctaacactttgggaggccaaggcaggtggattgcctgagcttaggagttcaagaccagcctgggcaacatggtgaaactccatctctactaaaatacaaaaaattagctgggcatggtggcacatgcctataatcccagctactcacgaggctgagacaggagaatcacttgaaccttggaggcagacattgcagttagccaagattgtgccactgcactccagcctgcgcaacagagcgagactctatctaaaaacaaacaaacaaaacccacacaataatgaactagaatgtaattcctctaatgaactcagctataatattaatgatctgatttccattccaagacggccaaataggaacagctccattctacacctcccagcatgatcaacacagaagatgggtgatttctgcatttccagctgaggtacctgcttcatctcattgagactggtcagaaagtgggtgcagcccatggagggcgagctgaagcagggcggggcattgcctcacctgagaagcacaagggatcgggggatttccctttcctagccaagggaaaccgtgacagactgtaccaggaaaatcgggacactccacctaaacgtggcacttttctgaaggtcttagcatgcagcacaccaggagattatatcctgcacttggcgcagtgggtcccacccccatggatccttgctcattgctagtccgagatcaaattgcaaggcggcaagcctggctggtggaggggtgtccaccattgctgaggcttgagtaggtaaacaaagctgccaggaagctcgaactgagtggggcccaccgcagctcaacgaggcctgcctgcctctgtagactccacctctggaggcagggcatagctaaacaaaaggcacagaaatttctgcagatttaaacgtccctgtgtgacagctctgaagagagcagtggttctcccagcacagtgtttgagctctgagaacagatagcctgcctcctcaagtgggtccctgacccccgtgtagcctaactaggagacacctcccagtagaggccgactgacacctcatacagctgggtgcccctctgagacgaagcttcagaggaaggatcaggcagcaacatttgctgttctgcagcctccgctgcttatacccaggcaaacagggtctggagtggacctccaacaaactccaacagacctgcaactgagggacctgactgttagaaggaaaactaacaaacacaaaggagtagcatcaatatcaacaaaaaggacatccacaccaaaaccccatctgtaggtcaccatcatcaaagaccaaaggtagataaaaccacaaagatgggaagataccagagtagaaaagctgaaaattctaaaaaccagagtgccccttctcctccaaaggaacgcagctccttgccagcaacagaacaaagctggacggagaatgactttgacgagttgagagaagaaggcttcagatgaccaaacttctccgagctaaaggaggaagttcgaacccatcgcaaagaagttaaaaaccttgaaaaaagattagatgaatggctaactagaataaccaatgcagagaagtccttaaaggacctgatggagctgaaaaccatggcaagagaactacgtgatgaatgcacaagcttcagtagccgactctatcaactggaagaaagggtatcaatgatggaagatcaaatgaatgaaatgaagtgagaagagaagtttagagaaaaaagaataaaaagaaatgaacaaagcctccaagaaataggggactatgtgaaaagaccaaatctacatctgattggtgtacctgaaagtgatggggagaatggaaccaagctggaaaaccctcttcaggatattacccaggagaacttccccaacctagcaaggcaggccaacattcaaattcaggaaatacagagaacaccacaaagatagatactcctggagaagagcaactccaagacacataattgtcagatacaccaaagttgaaatgaaggaaaaaatgttaagggcagccagagagaaaggtcgggttacccacaaagggaagcccatcagactaacagtggatctctcagcagaaactctacaagccagaagagagtgggggccaatattcaacattcaatgtgcagagacacacacaggctcaaaataaagggatggaggaagatctaccaagcaaacggaaaacaaaaaaaggcaggggttgcaatgctactctctgataaaacagagtttaaaccaacaaagatcaaaagagacaaggaaaaccattacataacggtaaagagatgattccaacaagaagagctaactatcctaaatatatacaggagcacccagattcataaagcaagtctgagagacccacaaggagacttagactcccacacaataatagtgggagactttaacaccccactgtcaatattagatcaacgagacagaagattaacacggatatccaggacttgaactcagctctgcaccaagcagacctaatagacatctacagaactctccaccccaaatcaacagaatatacattcttttcagcaccacatcgcacttgttccaaaattgaccacatagttggaagtaaagcactcctcagcaaatgtaaaacaacagaaatcataacaaactgtctctcagaccacagtcaaattagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacatttaaagcagtgtgtagagggaaacttacttatagcactaaatgcccacaagagaaagcaggaaagatctaaaattgacaccctaacatcacaattaaaagaactagagaggcaagagcaaacacattcaaaagctagcggaagccaagaaataactaagatcagaggagaactgaaagagatagagacacaaaaaacccttcaaaaaaaccaacgaatccaggagctggttttttgaaaagatcaataagattgatagactgctagcaagactaataaagaagaaaagagagaagaatcaaatagacataataaaaaatgataaacggcatatcaccactgatcccacagaaatacaaactaccatcagagaatactataaacacctctatgcaaataaactagaaaatctagaagaaatggataaattcctcgacacttataccctccaaagacagctgaattgctgaatagaccaataacaggctctgaaattgaggcaataactaacagcctaccaaccaaaaaaagtccagggtcagacagattcacagccgaattctaccagaggtacaaggaggagctggtaccattccttttgaaactattccaatcaatagaaaaagagggaatcctccctaactcattttatgaggccagcatcatcctgataccaaagcctggcagagacacaacaaaacaagagaattttagaccaatatccctgacgaacatcgatgcagaaatcctcaataaaatactggcaaaccaaatccagcagcacatcaaaaagcttatccaccaaaatcaatttggattcatccctggatgcaaggctggttcaacatacgcaaatcaataaacttaatccatcatataaacagaaccaaagaagaaaaccacatgattatctcaacagatgcagaaaaggccttggatataattcaacagcgcttcatgctaaaaactctcaataaactaggtattcaaggaacatatctcaaaatagtaagagctatttatgataaacccacagccagtatcatactgaatgggcaaaaactggaagcattccctttgaaaactggcacaagacagggatgccctctctcaccactcctatccaacatagtgttggaagttctggccagggcaatcaggcaagagaaagaaagaaacggtattcagttaggaaaaaaggaagtcaaattgtccctgtttgcagatgattgtatatttagaaaaccccattgtctcagcccaaaatctccttaagctaataaggaacttcagcaaagtctcaggatacaaaatcaatgtgcaaaaatcacaggcattcttatacaccagtaacagacaaacagagagccaaatcatgagtgaactcccattcacaattcctacaaagagaataaaatacctcggaatgcaacttacaagggttgtgaaggacctcttcaaggagaactacaaaccactgatcaacgaaataaaagaggacacaaacaaatggaagaacattccatgctcatggataggaagaatcaatattgtgaaaatggccatactgccctaggtaatttatagatgcaatgccatccccatcaagctaccaatgactttcttcacagaattggaaaaaaactactttaaagttcatatggaaacaaaaaagagcccacattgccaagacaatcctaagccaaaaaaacaaagctggaagaatcacgctaccggacttcaaacaatactacaaggctacagtaaccaaaacagcatggtactggtaccaaaacagagatatagaccaatggaacagaacagaggcctcagaaataacaccacacatctacaaccatctgatctttgataaacctaacaaaaaacaagcaatggggaaaggattccctatttaataaatggtgctgggaaaactggctagccatatgtagaaagcggaaactggatcccttccttacaccttatacaaaaattaattcaagatggattaaagacttacatgttagacctaaaaccataaaaactgtagaagaaaacctaggcaataccattcaggacataggcatgggcaaggacttcatgactaaaacagcaaaagcaatggcaacaaaagccaaaattgacaaatgggatctaattaaactaaagagcttctgcacagcaaaagaaactaccatcagagtgaacaggcaacctacagaatgggaggaaatttttgcaatctacccatctgacaaagggctgaaatccagaatctacaaagaactcaaacaaatttacaagaaaaaatcaaccccatcaaaaagtgggcaaaggatatgaacagacacttttcaaaagaagacatttatgcagccaacagacacatgaaaaaatgctgatcatcactggtcatcagtgaaatgcaaatcaaaaccacaatgagataccatctcacaccagttagaatggcgataattaaaaaggaaacaacaggtgctggagaggatgtggagaaataggaacacttttacactgttggtgggagtgcaaactagttcaaccattgtggaagacagtgtggcgattcctcaaggatccagaactagaaataccatttgacccagggatcccattactgggtatataccaaaaggattataaatcatgctactataaagacacatgcacatgtatgtttattgtggcattattcacagtatcaaagacttgcaaccaatccaaatgtccaacaatgatagactggattaagaaaatgtggcacatatacaccatggaatactatgcagccataaaaaatgatgggttcatgtcctttgtagtgacatggatgaagctggaaaccatcattctgagcaaactatctcaaggacagaaaaccaaacactgcgtgttctcactcataggtgggaattgaacagtgagtacactcggacacagtaagaggaacatcacacaccaggggcctgtcgtggggtggggggagcgggggagggatagcattaggagatatacctaatgtaaatgacaagttaatgggtgcagcaaaccaacacaacacatgtatacatatgtaacaaacctgcacattgtgtacatgtaccctagaacttaaagtataataaaatatatgtatatattaacgatcctcacagtgagattggaagctttgtaatatctcttaaagatcacattatagggcatctctgttctttaagtctaatctgtgatcaaaagaaataaaatattgtattttaaacatgttttctttcttacatatttatagataaggggaaggaggaggagatatccaaaggtctaaaaaagagaaagagaaaatgaatttaatcaataatgtaaaccaagttcgtaaccacatgtatgtaatatgcaacacccctgactgacatttccttgtacaaattaccttagaaagtgaacccaggcttgttttagaattatttaagttgtgtcaaaaatcacaacttagatgatcagcttgaacacaggttttctaagcaaagctgtctgtttttttctttttagtcacagatcgtattatatagtgtgtggaatatgattaatgcattattggatatgagctgtgccccatactttagatctgacatattccagttaccttattatgaagcatgtgtgttacgatctctcgccactatcaaagtataagagtttgttggccatacacttggtcttgggctggtcccaacccaggtgccaataactggttcatcatggccagaaacaggcctagaaatgtgactgcctggccctactctcaaaaacagagcactttgaagataacctaacttccaaggaaggagccacgctggaaataacataactgtttgtgttatgttattgaaaagaaaagatctccatgaatttctttttttttttttttaagccaactttgacagcctctttccttccagatggtgcctggagccaagcctgtcagagaaccttagtctcctgctgccttttaatgctggtccttgattgctaatgacccctggctggactggcttctcaacccatttaacccctctctgctgggtccccatctcatgcaggatgagcggccacgagagctggaagtgggaaggtgccaagtcagccagagcctcccacccttccagagctggtggcgcgtttcccggtgccatcatggatgtccaagatcattccagtgaagagctcatgttaatatgattttctctatattgtcagataaatgctgccaggtttctgattgttaatattttatttgactaaaccaagacaaccaagtccctgaaagaatgtttccttcaggggtcaagagctgaggaccactgatatgagcctcctggaatatgttcatttggaaacttaaaattacattgcactggaactatcttttagtttggtcgaacttcatggacaaagcatttgcttttgtgcgtgtgtgtgtgtgtgtgtgtgtgtgtgtgtgtaggcaataatttccttgtcaaggctgaaatatcacttgtataacacaggagatacccatttctcagctttgttagcaacaactgtaaccatttactttttggttaagcttggtttgttttttatgacatataggaaggtgcttatagctatactgatcaggtaggtcactcagagtgtagggtttttttttttttttttttagatggagtatcactctgccgtccaggctggagtgcagtggcctgatcttggctcactgcaacctctgcctcccgggttcaagcgattctcctgcctcaccctcccgagtagctgggattacaggcatacgccaccaggcccggctaattttttgtatttttagtagagacagggttttgctatgttggacaggctggtcttaaactcctggcctcaagtgatccacccccctcagcctcccaaagtgctgggattacaggtgtgagccaccacgccccacctgagtatagggatatttaaaaggggtgggggcaggaagctgctgatgctaatttgttgagaaatcttgagtccagtggagaaattcagatctcttgcaacctcctcaggtcagggagggcatgagaagtcatcattttatgcattatttccgtaacggatttttactaatctcatattggattgtaaaacaaggcaaagaaatttggtagttctctgtgaccctgaagaactgaaatttaaattcttgattagagcagagaactgaaagctttgtgctgccctacttgtacaaacgtcttaatgtttactggatagttggaccaaattgattttataatgtaatgtacttaagaaatttgttccaaaattcggcacaaattaggaaaataaccaaaccatacctttctatttaatctttgcttctctcagatacttactattttcttggcttttttgaagattaagactgaaagatcacaactgcatttctcaccactaacacttcattgatttcatttttacatcttattaattaaatgcaagaaaaaaattatatttgtgattttattttggtctactactgacattcttttctatttccactcaatctctctctccctctctctctctctctctcacacacacacacacctgccagacatttgtagatataacctcccccaaatcatgtcattcatactaatgactgccctctctatgtgtaaaaatattttataatttatggacctgggtggggatttgtacagctgtgcaatattaatctatacactgcaggttttgctaacagctgggcaaaggctgaggtgaggttttaatgatgtcctttagcccatcagtaaccaaatgacccagaaagtggttcaggggaacctaccttgtgcagctgtgctctttgaatgaatgaatcatgttagaatgaaattctggtgtatttatggagaactttttcctttgaagcctaaacacattttgattggtcgtatttaaattccaacaagctgaaaagcaaaagcatttatgtcagtttcacagatgaggctccaagaggttaactggcgattactctggagttacagcatcttaaagttggaagggactttaaagggcctctgggctaatggttcttacccttttcctgccttcacactggcttcaggcaacagatccccatcaggcatgtctctcactgcacacagatgttcacacactgggaaagaatgtgactccaaggagagcagctcagaatcttcaggccagaacatgtgtaatttgccacaccaatgttctccattaaaaattactacctcagtccacccctctctttatcattttacacataaaacatggcagcagaggggtaagggattcacttaaggtcacataccaatatgtgtcacaacttgaactatgtgtgccggggtcttctgatcccccatgtccagtgctggttttgctacagctgaccagccccttgcacactcacagtagaactggaactagctcctcaaagagtgaggcagagctggagacgagtgccccagggtcccctgctgcagggaatcaaagaccccgtcacaattagcttagtaaaaccaacactatctggtgtcccatatccgcaagcacttaaaatgtcgttccaatcttcaaagaaattctttcattccatttttatctgcttttacccaggacattgtttcccagctccccagtagttcactaggtgatttgcatctcattagaagctccagaagtgacatctcccagactgctgcctggcattgtgggtccctaagcatcagatctaggtcttggattttccaagttgacacttttttaaaagctgagttaatgctgttttcccactgggtgcagtttgggtggccattttcgccataattcctgctcccgtgctggatcaaggttagggaactgccattgtcaaagatgaagtcagtcatctccacgtgaaagtacgtggtggatgagaatattctggggcctcagaataaaggagtttaaagactcctaaaaatagaaagatgctacatgatgcagatattctgaacactacacaaagcaaaacaaaaagacagcaagacaatagcaaaccattgctgaagctgtataattgattctaaacgtttgccttttaaacattttcccctggatccaatcctcctgagaccgcagagtttttgccctacatttatattttgctttaaagatagtctccctaggtcagaatgcctttttggctttgtcatttcttcatactacaacctccagaagagcactgaacagcactgtacctctggaaaccagagatagtatttccatggtcagcaaaattgttctcttggaataagagaaatgattttcccagtgtccagggaaataaggagcccttatgtctactttgggctcaagccatttgatgcagcttccagcacaaagcaagtgcctgatggtgcctagagcttccgccatccagaattccttttgtccagtgaatacttccctgagcttatgccaccttttcaaaatggcagatagctaatctgcagaattgatctaagctcttaggaaagggttaagtccatggtttttccaacactggctacaaattaaaatcactgggaaggaggaggaactttgttttaaacaagtaacaatgccagaaccctacccctgaccaattaaattaggatctccaggggtgaggtcatgatatctgtatttttaaaaagcccttcagatgattctaatatgcatccagggtggagaaccactccagtataacaagaaatacaacagccccttcgcagcacctgctaatgcctctggcaccatgttttatcttttcatatattatctgtcattctcactacaaccctacaaggaagggtcatcattcccaagtga

SEQ ID NO: 1984 - DNA, 38115 bp, Homo sapiens
gaggacttcaagcaagagagggacagatttgccttctgtgtagagaccgccctctggtggccacatggaggatggcaggagagaatggcgccgaaagaaaagcggcaggctgagctcataaagctgcgaatgctgttccttcttcctctttttcaaaagacggattttgggccgggcttggtggctcacgcctgtaaccccagcactttgggaggccgaggcgagcggatcacgaggtcaggagatcgagaccatcctggcaaacacggtgaaaccccatctctactaaaaaaaaaatacaaaaaattagccaggagtggtggcagacgcctgtagtcccagctactcgggaggctgagccaggagaatggcgtgaacccgggaggcggagcttgcagtcagcggagatcgcgccactgcactccagcctgggcgacagagcgagactccatctcaaaaaacataaataaataaataaaataaaataaaataaaagacgggttttgctctgttgcccaggctggtgctgtggtgcaatcttggctcagcctgtaactcctggcctcaagcgatcctcccaccttggcttctcaaactctgggatgacagatgcatactaccataccccgcccatccccagtgtctggaaaatgtgcccactggagaaatctattggccggattgtgactggttggatgctcccacggcaggaaagggggaaggacaagtggccacgtcgaggcctgcctgaactccaagggtatccaggccgaggttgctcaaacccagagctgatttatttttatttttatttgtttttattttttgacacagtcttactctgtcgcccaggctggagtgcagcggtgcaatctcggctcactgcaacctccgcctccgggttcaagcgattctcctgcctcaatctctggagtagttgggattacagacacctgccactacgcccagctaatttttgtatttttggtagagacggggttcactatgttggccaggctggtcttgaactcctggtcttaggtgatcctcctgcctcggcctcctaaagtgctgggcttacaggcatgagccaccatgcctggcctgaacgaaacatttctatgctccaacttaaaatgaatgtagaacttattatctgagaatgacccagggaagtcatgggactgcccatattttcatgcaataaagggaaaattcttcccacaaataaattttataggacggtagaagcaaatatagggcattccaattacatttcaatgagttattcttgatgaagtcctggatacacaaagccagccagcaaataggattgaccaaagtcagaggatgctgtgaccaccccagggctctttttgtttgtctgtttgagacgggtctcgcttcgttacccaggctggagtgccgtggcacgatctcggctcactgcacccttgacctcctaggcttaagagagtctcccacctctacctcccaagtagctgggatgacaatcataagccaccacacctggctaatttctagaattttttttttcatttttttcatttttttttctttttagccggagtttcactcttgttgcccaggctggagtgcaatggtgcgatcttggctcaacacaacctccgcctcccgtgttcaagcaattctcctgcctcagcctcctgagtagctgggtctacaggagagcaccaccacgcccagctaatttttgtatttttagtagagacggggtttcaccatgttggccatgatggtcttgatctcttgacctcgtgatccacctgcctcagcctcccaaagtgctgggattataggtgtgagccacagcagccggccataggacataagcttttttttttttttttttttttgagacggagtctggctctgtctcccatgttggagtgcagtggcacaatctcggttcactgcaagctccgcctcacgggttcacgccattctcctgcctcaacctctcagtagctgggactacaggcgcccgccaccatgcctggttaagtttttgtatttttagtagagacggggtttcaccttgttagccaggatggtctcgatctcctgacctcgtgatccgcccgcctcagcctcccaaagtgctgggattacaggcgtgagccaccgcgcccagcctcagctgtgttcttaactctatttttccttcactggggatggtaccatttccccgtcctgttaagtgcccttgactgctcttacctttagctcttggaattccgccatctaccctaacttcacctccatctaaatcctgctcactcttcaaagcctgcctctccacgcatcctccctcctaactccatcccaatgcccaacagctctttgctaagcagatgcctttatttacagacaaagaagtaaacaggcaaaaggaagaggcttgtccaaggtcatgccacagactgaactctcactgggaggacagttcagggtcctgatacccaatctaaggcagcagctttgtagcacatcaggatgggggcaggtcatgcctggccatgttcacttccagaacgattatagctttaacaacatttttttttttttgagatggaatctcgctctgttgcccagactggagtgcagtggtgtgatctcggctcactgcaacctctgcctcctgggttcaagcgattctcctgcctcagcctccggagtagctgggattataggcatgagccaccatgcccggctaatttttgtagttttagtagagagggggttttgccattttggccaggctggtcttgaactcctgacctcagttgatccacctgcctcggcttcccaaagtgttgggattatgggcatgagccaccacgcccagcctactacagctttaacagtcttttttttttttttttttttttttttgagattgagtctcgctgtgttgcccaggctggagtactgtggtgtgatctcagctcactgcaacctccgcctcctgggtttaagcaagtctcctgcctcagcctcccaaatagctgggattacaggcacatgccaccatgcccggctaattaacaacattattttttaatttttgtagaaatgaagtctcactgtgttgcccaggctggtcttcaactcctgggctcaaacgatcctcccaccttggcctcccaaagtgctgggattacaggcatgaggcactgcgctgggcccagaactaccttttattggaggcatggagtccacagtgggtggaggtctcagtgccttgggctcaggggctcagcgaaaggccgcggccaggcctagatgaaggtgaggcaggtggaagcggggaccccacagctttccttgtgctcctcgaagagctgctccagggccgtcatgtagagggcgtgatagtgattgacttcctcctcggtggggtggaggcgctgggggacggggatggggcggcccactgcagggagagggagacaggtgggcgagggatccctgatgcccacgcagctgctggtggccgtccccccggaggtgggcactcacccacagtggtgatgggcacagcaaagggcagcaggccccaggaggtggctgagaagagaccgcgaccccagaagatgcaaggagagaagcccatgagcttcttgaaggtgagctggcaccaatgctgccaggagcctgtggcaaaagccttaagtctaaagatgtcattctccccaaaggagtacacgggcaccagggacgccctgggaaggagcaagagagaagagggggctcaggctgctggactgctccgagatgggcacccccaggggctacaagtccttcccactacgtccagatgctacctcccagggtcattcaaagcacatgactatggctacaaagaaagatctagaagacaggactcgcatttctttctctttctttttctttgttttagagagagggtcttgtaaccacacctgtaatcccagcattttgggaggccacggtgggaggatcatttgaggtcaggagttggagaccagcctggccaacatggtgaaacccccgtctctgcaaaaacataaaaattagccaggtgtggaagtgggtacctgtaattccagctactacagaggctgaggcacaagaatcgcttgaacctgggaggcagaggttgcagtgagctaagatcacaccactgcacttcagtctgggtgacagagtgagactttgtctcaaaaaataaataggctgggtgcggtggctcatgcctgtaatcccaataccttggaaggctgaggtgggtggatcacctgaggtcaggagttcgagaccaccctgaccaatatggtgaaaccccatctctactaaaaatacaaaaattagccagacgtggtgacgtgcacctgtagtcccaggtacttcagaggcttgaactcgggaggtggaggttgcagcgagccgagatcacaccactgcactccagcctgggtgacagagcaagactccatctccaaaaattaaaaattagaaaattttaaaaaataaataatttaaaaaattttaaaagagacaaggccttgctctcttgcccaggctggagggcagtggtgcaatcatagctcactgcagcctcaaccttctccgctcaagccatcctcccacctcagcctcccgaatagctgaaacttcgggcgtgcactaccacacttggctaatttattttattttatttttgtagagatgatgtctccctatgttgcccaggctggtcttgaactcctggcttcaagtgatcttcctgccttggcctcccaaagcactgggattgcaagtgtgaaccaccacgcccagccgggactcacatttcttgagacacagttgtgtagtgggccttctcatagtcattttctcattcggtctttgcaataacaacatcgtggcaaggtaggtatcagccctcttcgcaagtaaagaaacaagtccggccgggcacggtggctcacgcctataatcccagcactttggaaggccaaggtgggcggatcacttgaggccaggaattcgagaccagcctggccaaaatggtgaaaccccgtctctactaaaaatacaaaaattagcccggagtggtggtgggcgcctgtagtcccaactactcgggaggcggaggttgcagtgagccgagaccacgcctttgcactccagcctgggcgacagagcgagactctgtctcaacaacaataacaaaaaaagaaacaagtgcaaggtcttgcctttgagttggggtcagagagggaagccagggcttctgagaccgagggccctgctatttgcattatggtcctgtctccacggatgtgggagggagcttagggtaagcgggccccatgtttggtaccgagtcatgccctggagagcccacgtgggcctcggtgcagggcagggcgctggtctctgggcacccggatcccccatgcagggacctagatgtctggggactgagagagggcataaaccagcagagaactgacaggtagggcctgcacgcgcactcacccgtgcctcagcgccaggcgcacgaagcctttgcgcttctggagcgtaaggcagtgctccccggggactgaatacagggcctcgtgcgcaccccccaccatgatgaccacggcctgcccgagctggggctgggacaggatgaagtccaggctctggcggctcaccggacagagtcctgtgggcaggaggaggtggaaagtagttcccatctgcctccacggcacccccgcccctcacccagcctttagttccaagccccctacccccatctccaaggcggggaacctacccaaatgctcactgcaagtctgggcagtgctcaggctggcccctgtcctgggtgggggacttattatgggggggggtggtcccagaggggctggggaacatctggtcaggagtctcctcccgttctcctcctcccattcggctcaccaaaggacatgatgtagtcgcgatagaccgggaggtagaagaggccagccagcacggctaaccagggccggagccccgggaagagctgggagaagccattgctctcggtggagaaattacagaggaagcctgtacacatgatcccatgagggtgggcgcccagcacgtagttccgatccgggggcagctctgctgttttcaccagcttcggggtgttgagcaggatgaagggaggatggaaggcaagacaccggctgaaaagaggggccctccaccccaacagagttccgagttaaaggttcttaggatagggtcaagggccaccccagcagagttccgagttaaaggttcttaggatagggttaagggcccaggttttttttttttttttttttgagatggagtcttgctctgtagcccaggctgaagtgcagtggcacgatctcggctcactgcaacctccgcctcttggtcccggttcaagctatcctcctgcctcagcctcccgagtagctgggattacaggcatgcgaaactatgcccagctaatttttgtatttttagtagagacgcagtttcaccatattggccaggttggtcttgaactcctgacctcgtgatctgcctgccttggcctcccacagtgctgggattacaggcgtaagccacctcacccactctctctttttttcttttctttttttgaggcagagttttgctcctgttgcctaggctggagtgcaatggcatcatctcagctcaccacaacctccgcctccctggttcaagcaattctcctgcctcagcctccagagtagctgggattacaggcatgtgccaccatgtccggctaatttgtttggtatttttagtagagatggggtttctccatgttggtcaggctggtctcgaactcctgaccttaggtgatccacccacctcagcctcccaaagtgctgggattaaaggcttgagccaccacaaccgcctttttttttttttttttttagagacggtctcactctgttgctcaggctggagtacagtggcgcaatcatggctcactacagcctccaactcctgggctcaagcaatcctcccacctcggcctcccaaagtgcttggattacaggcatgagccatggtgccccaccaaggccccgctcttgaacatcatccactcccaggccgggcgcggtggctcaaggctgtaatcccagcactttgggaggccgaggtggctggatcacttgaggccaggagtttgagaccagcctggccaacatgttgaaaccctgtctctactaaactacaaaaattagccaggcatggtggcgggcacctataatcccagctactagggaggctgaggcatgagaatagcttgaacctaggaggcggaggttgcaatgagctgagattgcaccactgcactccagcctcggtgacaggagactcagtctaaaaaaaaaaaaaaatccattccctgtcccactgcctgagcttaggcagcggggagctcaggccccagcacaaggaagggctcctaggtgtgggagggagatggggagaggtaggaagcagtttttctgcagggtgacccatcaccttgacaggataataatcccttagttgtctccaaattgcccggttccttatccactccgaacgccttccacctgcggacaatgagatactggtggacgaacccccggagtcacctcccctcaccccccatgtccccaccatctctggctacctgggcccccatccggagctcaccttggttgggtgtgtcccagtccacatagagccacaccaagtaaaaaacagagaagggccagagtgacgtgaagaggaggacaaagacaagaagggagaagaaagggcctgggggaagggagagaaagaaaagagttcacttctgaaactccatcattccctccagctgctcccttcccttcctccccttcagaacaaccagctctctcctctggccctctcccagaccagtcacctggtcactgtcctcaggcatgcaagccagcagcccagccactctccctccaagccctactcccctggcagaccccaggcacccacgcctccccagctctcacccatgaagaggaaagtgagcacatattggtaggcgcccactgcttctagatgctgcttctgcaaggttttggaagtggttgggggctgcagggttgtggcaactcccattgcagaagctcccctcttccagcaggatcccagaacccggaggacaaacgatgaaggcttggatgtggacctgggcagactttctccctacaggagcccagctttgggggcctggctaagtcgcaaatcacctcccagagtagcgtgtgtccgtaggtgtgtgagtggggagatctttggatccagagccccagatgtctctgggttttttctcagcctgatctttgaacttcctgtcagtcaccagtctgggctggctgctgggtggggctgggaggcgtaaggggtgtgcaagggagaggtgacacccgagtgcctcaggaattgatgttggagtggacaagagtgatctggctagccccacccactgggtcccaggtgctggaaggggccagaagccctgctgagactatttgacctccagtcggggtgggggcagggcctggtccggggcatctccaggaatgtcaaggtcaccacccctgcctggacctcccccgccatgcacaaacacacacaggctgcaggtctgtttcccactttaatttttttctttttcttttcttttcttttttttctttttttttcacacgtctcggtcacccaggctggagagcagtggcacgatctcggctcactgcaacctccgcctcccgggttcaaacgattctcctgcctcagcctcccgagtagctaggattacaggcgcgccaccacgtctggctaattttttttttttttttttttggatttttaatagagatggggtttcaccatgatggccaggctggtctcgaactcctgacctcaagtgatccacccgcctcggcctcccaaagtgctggaatcacaggcgtgagccaccgtgccctgccgccagtctttaatttcacttccccacctgcagtcacccagcggacaggcgaggccaggcggtggggcgcgcctccgtgaggaccaggtgtctgtcggcggggacaccatagcgcgcctggtgctcctcgaagagctgcgtgagtcgccccacgtagcgcgcttgcagcgtgtccacctgggccggactgggcggggggctctgctgcacgggaatcgccgaccccactgcgggcgggacgggaggcgatctgggctgggatccccggttctcctcctcttttcctccttggggataggcgggaacagagttcagggctggcgcggtggccaaaggccagtctgggtggccccaacccgggacggggagggagcgggccctgggccaggatcgcggggcggaggccggggctcacctacggtgcggatgggcgcgcggaagggcagcgggaggccccggcggcccaggaacagctgcagggccacgcttagcagcggacgcagagcctcctgcgtcctctgcacccacgagctctgcgggttcgggaactgctggaagagctcattctccctggagaagacaggcactagggaggccgcaggagagcatggcgcggctgactcctggccccggggtccgcgggtggcgccactctcctcctccccggcccggcagccctggggcgtccccaccgggtcacgctcgggtcctcacccgagttccagagctgacttaaccaatctcttctgattccgaatcggcaagctcagttgtccgggttttgcctccagcgcctgcaggggccctcccacgccaggacagccacctggccaccactgaggcagcggggccttgacaaaggagaccaaacctggggggagggcagaagctgggggacccaacgcctgggtcttatttacttatttatttagggacggagtcttgctctgttgcccaggctggagtacagtggcctgatcttggttcactgcatccttgaccttcagggctcaagtgaccctcccacctcaagcctcccagtagctgggaccacaggtgtgtaccaccacacctggctaaatttttgtttttgttttttcttgtgtagagatggggtttcactgtgttgcccaggctggtcttgaactcctggccttaagcgatcctctcgcctgcgcctcccaagtgctgggattacaggtgtgaaccaccgcacccagccaaagcctgggacttggaaagaagagtggagaggacatggggaaaggagagctgggccccagtgtcccctgggaagaggatggtggggcgggagacagcagcaaggtcctcctcttctcaccacctgacatgatgtagtcctggaagaagaggagatggaaccaacaaggcagcatgagcaggtgtggcgggagtttggggaagaggcaggagcagcccgtgggctctgtgcagaagttggcgaaggctcccacgaccaggaccctgtgagggtggaagtcaaagaggtagttccaggaggtgcccaactttgcagttttaactagctggggagcagacgggcgcaccccaccccaacggtgagattgcactttgggagatggtggtcccaagagtctattctgaagccccaaccgcacccagcaccccacagcccaggtcctcactgagagggggaagtagtcacagaaatgtctcaaactgcccagttgcaaacccaggcagatctgcgggctccagccctgggtatgtttctatcccaatagagccagaccaggtagaggaccgccagcatccaagcccagccgaggaatgcaagagccaggctgccaggtgcacctgggctggaagatggggcagggggagctcacagtacaggtgtttaagaccattcagttgttgctcctacccatccagtggcctgagtggtgggagctgcagaccagtcttctgtggcaggctgaatgctccagtcttcagtagggaactgctagatagcacagagggcacctgcacgccttcagaccagtctgcaacctcaggttgagtagcagtgaactcaggagccggagcagtccattcaccctgaaattcctccttgtcacagccttttcagcagcagcctgctcttctttttcaatgtcttcatgatctctgtagaagtagagatcaggcatgacctcccacgggtgttcacaggaaatggtgccacgcatgcgcagaacttcccgagccagcatccaccacatcagacccactgagtgagctcccttgttgttgcttgggatggcaatgtccacatggcgcagaggagaatctgtgagacacagagcaaggtaggtaggttaacataagatgcctctgtgagaggctgctgatcagccctggggtcagtaaacacaagaagccgtggctcccggaaggctgcctggatctggttagtgaaggttccaggagtgaagcggccagcgattggagtggctccagtggcagcagcaaacttcagcacggccctctggccagtatttctggagggtatgacactgacatcagcggggttttcaatggcaacaatgccacgagctgccagcagaagcttctcccaggtcctcttcagatttgggatgtagatgccatcacttttccttttatacatgtactgttccatctgtaagtcaaggttggtgccacctaattggtttcctgctgcaaggaaattaaggacatcttcctccttcatttgcaggacatcaagggctccggatgttgtgaaagtttctctttaagttacaacaggaatccagaacaacgccggatggagccctctgtgggtagcgtggaaagctttttttgttttgtttttttgttttgagacgaagtcttgctctgtcacccaggctggagtaccgtggcacgatcttggctcactgcagcctccgtctcctaggttcaagcaattctcctgcctcagcctcctgagtagctgggattacaggcctgtgccaccacacctggctaatttttgtatttttagtagagacagggtttcaccatgttggccaggctggtctcaaactcctgacctcaagtgatctgcctgcctgcctcggcctcccaaagtgctaggattacaggcgtgagccactgagcccggcttatttatttttttgagttggagtttcattcttgctgcccaggctggagtgtgatggcgcgatctcagctcactgcaacctccccctcccaggttcaagcaattatcctgcctcagcctcccaagtagccgggattacaggcgcccgccaccatgcccagctaatttttgtattttttagtagagatgcggtttcaccattttggcctggctggtcttgaactcctcacctcgtgatctgtccgcctcagcctcccaaagtgctgggattacaggcatgggccaccgtgcccagcttaattatgtattttttaagtagagacagggtttcaccatgttggccagggtggtctcaaactcccaacttcaggtgatccatccacctcagcctcccaaagtgctggaattacaggcgtgagccatcgcgcccagctaatttattttttgtagagatggggggggtctcgctatgttgtccaggctggtcttgaactcctggcctccagtgatcctccgcctgccttggcctctgaaagtactgggattataggtgtgagccactgtgcccagcctgggaagtccctcttttggtctgtgccctctcatgcactttttttttttttgagatggagtctcactctgtggcccaggctggagtgccggggcacaatctcagctcactgcaagctctgcctcccgggttcatgtcattctcctgcctcagcctcctgattagctgggactacagatgcccgccaccacgcctggataattttttgtatttttagtagagacggggtttcaccgtgttagccaggatggtctggatctcctgacctcgtgatccgccccccttggcctcccaaagtgttgggattacaggcgtgagccaccgcgcccggcccctctcacacactgtctccagctcaggcaatacaggggaaggggaaagtgggagccagggaagctcccaggttcccacgagggtctaacattctgcctctcccttttcctcttgtcttcgcttttctgggtctctcccctctacgctgctggcaggaggggagatggggttaatgggcagaccaatggactcaagacttacaaactgtcctttattcagagtgagactgcggaacattaataatttatcacgcggggagtccccagaagccctgtgcccacgaacccctgtgggcggaggagagaggcggggactccgggagcttcctgagagggccgtgtcttgggagcaaggtgacatattcagttcaggcacgcggaacatgaactcaggaagtggggagacagagagacccatcccccaactcccaggacgggggccaggccccctaaaaaggcacaatggcagggcaggtttggcagagtggttgagtgtcaggggtcgacaaaggacaccatgatgtagcgtgtgccccaggtcgttggcagcccctcgtggtagtgggtgaggcggccggggtgcaggagtgcccagcccttcctcggggaggagatcacacagtcgtagcgcaggaagcggcagccacctccctggaaagagaagggaaaggaaacatggagtgagcagacgtggggcctggggagcaggcagatacacggggcagggcggccagaccggggggcacggtgcagcagaccggggtgacaagggagatggcagatatggcagacaccggaggctggggtgcctgcagacaggaagatccaggaggaagcagaggccgcctgcccagaagcgatccaggagctgatacccacaaagtcactgggaaatgggcagggaggggagctgggggatgcacgcaggggctctaggtggggacccgagggtcctgaggtgaagcgtgggtgggtagtgtgactggggcgcacctcatagtccaggcccttgtggttgagggcaacgttgagggtgaaggtggatgagtcgtggtgtggccgcagagacggctgctcgtctggccggtagcgaaccacaaagttcatcaccgcccgcgcctgggggagaggagggaagaggctgcagggacagctgcgggcgcagggggtcttttattttgtattattattattcttttgagatagtctcgctctgtcactcaggctggagtgcagtggtgcgatcttggctcgatcttggctcactgcaacctctgcctcccggtttcaagcaattctcatgcctcagcctcccgagtagctgggattataggcacctgccaccacacccggctaatttttgtatttttagtagagacgaggtttcaccatcttggccaggctggtcttgaactcctgacctcaggtgatccacccacctcagcctcgcaaagtgctgggattacatgtgtgagccaccacgcccggccatcgcagggtgtcttcagggagatgacggtccctgtccagggaggggaggggaggggcggcgggacccctgcgtaggaggctctcgctgctcactggcattaaattagggccaagcctcaccttgggtctcagcctggcgccctccctcccctggggtgcctcctgcagcgtctcattcccctgggaactaaaatgcatggagcccaaatgctgccggggccgaaaggggtctgcgtggagacttcctgtccgggactggggtggggaaggtggggaggcagctggcaggtgggcagcgcaccttggtgtggtaaccgggaaacaggctctcggtcatggggcccacatacgtccgcagcagctgcagccactggtcctcgtaccccacctgcttcatgtggatgtccacggtgggcacattctcgtagcctccagccagccttgaatcctgggggcggcgggcactgagccacccgcccctccagccatggcgctccccaccccagggcagtccagcctccttcctcccgtcctccagccttcacacctgtgttcctctgtgcagaacagtcttctttgctacttctcggcctgactcactgctcccggcccttcaagtctcagctaagatgtcacctgtcctgtgaagctccctactcctcccaagtctgggtcaaggcttccccgtggcttctattgcacccaggctgctcatcgcagccttagaagctgtgtggtggctgctgctcacagcagggcagagctcgaccggcatgaggcattcctgcagtgcagtctaggacagtggcccaggaatgatttccttttctctttttttagagacagagtcttgctctgtcacccaggctggagtactgcggcatgatcatagctcactgcagcctctaactctggggctcaagtgatccttctgcctcagcctcctgaatagctgggacatgccaccatgcccggctaatttgttggtttttctgagatggagtttcactcttgttgcccagcctggagttcaatcttggctcactgcaacctctgcctcccgggttcaagcaattctacctcagctcccgagtagctgggactacaggcgcccgccaccatgcccggctaattttgtgtttttagtagagatggggtttctccatgttggtcaggctggtctcgaactcctgaccccaggtgatccacctgcctcggcctcccaaagtgctgggattacaggcgtgagccaccgcacctggcccaaactcggctaatttttaaattttttgtagagacagggtctcgctatgttgcccaggctggcctcaaactccccctgctcgagcaatcctcccgcctcagcctcccaaagtgctaggattacaggcatgagccactgtgcccagcagtaaatatttcttgaatacatgaatgaatgcagttgtgaccccagggtctgcctcccccctgggaacccctctttgctcccattttcctgattccattgtttgtttaccagatcctgcacctcctcctctgggaaggcctctgccctcctcgcccaggcccttacctcatgccggccgcctgaccactggccgtagtgctccatctctgccaccagctcatcacacatttgttctgacagcagtgggaaccagtacacgtccgggcatggctgaggatggggcgagggagaacagggctagctgacgccgcagaacggggaaggggacaggcagcaggcagaatgggaaggggcagggaggagcagggaaggctttgtgagagcagccggggacccgccaggtaggggctgagggagtggcaaggctgaggaccggtttctggcacaggagaggtggcagagggtcctggagcccctcgtgctgggacagtggtttccaaacttccgtaacagtgcatacctcttttttttttttttgagatagggtattgctctgtcaaccaggctggagtgcagtggcacaatcatagctcactacagcctcgaccttctgggctcaagcgatcctcccgcctcagactcccaagtagctggaactacaggcacatgccaccatgccaagctaattttttcttttcttttttttttgagacagggtctcgctgtgtcacccaaggtggagtgcagtggcgtgatcttggctcactgcaacctctgcctcccaggttcaagcgattctcccacctcagcctcccgagtagctgggactacaggtgcacgccatcacacctgactaatttttgtgttttttttttttttttttttggtagagacaggatttgccatgttggccaggctggtctcgaactcctgacctcaggtgatctgcctgcctcggcctctcaatgtactgggattacaagcatgagcaccactcctggcctcatttcttatttaatttttttgttgttgttgtagagacagattctcgctatgttgcccaggctggtcttggacttctggcctcaaccgatccacccaccttggcctcccaaagtgctgggattacaggcatgagccactgagcccagccccattcttcttttaagatgtgatttcaagcataacaccagtatacccaatatacaggagaagaggctgtctgatcaatgctggctttgggggcaagagtcctttctgttcggcctctgccttcatcttgtctgaacagaaaaccctcagatctctggggaactcagtgtgaaaactttgaatccaggcgggggcccccaagaggcgatggccatgagggcagggggtgggtggggaggctgcgtgggctcacctgctccacgattccttccccttccagggcccggctgtagttctcgtggatgtactgctccttccagtcctgtgagagggtggggggcacatcagatctgtgcccccctcgctcccagcccccaggggaccgccccctcccactcagtgtcctgcgctggcagcagccatcacgtttggtgtcttccttagcacaaggcggggaacctgtgtgctctgggcgtggggtccccactcacgacggggttgtcgaagatctgccagaggtcggggtgcaggtgctccgtgtcgtatctggaagtggccaggagccggccaaattcatgctgattgctcagatggaggaagatgccctgtagtggggtgggggtgtccgtgatgcaggcgatgcctggagtctgggggactgcccccaggccagaccgtgcacccgcgctcaccttgtctcgaaagctcttacagaaggccatgtccgggtctgtgtcactgcccgagaacacatccctctggggcagctccatccgcagggtatcaccccggatcacataggcctgggagatgtatggtacattccacacacccctggaggcaccgacaccgcggtcagctgggaggacagccccccaaattctgcccagctcatcccgggaagtccttcttccctcagggtatcccagtccctgaacataaggcccctgcatgtcccttgtcaagcactgctggtcccaaccaccccacctcccaaaatgcggtcagttcctaccccaagctgtggcacttcttttttgtttcttgtttttggtttttgagacggagtcttgctctgtcacccaggctggaatgcagtggtgtgatcttggctcactgcaacctccacctcccaggttcaagcaattctcccaccttagcctcccaaatagctgggattagaggtgccagccaccatgcccggctgatttttgtatttttggtagagatggggtttcaccatgttggccaggctggtctcgaactcctgacctcgagtaatccacctgcctctgccttccaaagtgctgggattacaggcgtcagccaccgcggccggcccttgttttttattttcttgagaaagggtctccctctgtttccaggctggagtgcagtggtggaaacatggctcactgcagcctcaacctcccaagttcaagtgattctcccacctcagcctccgtagtagctgggaccacaggcacgcaccaccgtgcccagctaatattttaagttttttgtagagataggctcttgctacgttgctcaggctgatcttaaactcccaggctcaagcagtcctcctacctcagcctcccaaagtggtggcatcaaaagtgtgagccactgcagccagcctcatggcacctctgactggtgaccactccaaacccctgagagtagggggcttgggtctacctgggccccgggtcggaggaggcggggggctgcaggctggcgggactcacactcgcttccgctgcaccagctccacgtagtcctcggagcgggcgtagtactcatcggggctcagggcgccccagaagttggaccacagcttgccgtggcgggacagcatgggggcgatcaccttcctgcggacaggtgggggtgagggctgggcagacgggagcaggcctggggagcccggtgcccagggcaggagtggggttcccggggcctgttggggtgccctccggctgcggggagagggggtaagccacctgttctcctcaatgaggatacgcagggtctgcaggttggtgaggacagcgtcggcgtccaggctgaagtagaactcacactcggggtcctgccgacacaggtccctggaggtgagaggcgagctgagacggcggcaggtggggaggcggtgtggatggggtaactggcccatgcccccaggagaagaggagggaggcagtgtctatccttccttccccaggctctctgctgtctgggtgagctggcaagggcaggagtgacagcatgggggctgcaaggatgcgaatggggaggcccaggaggggctggatgggtgacaggtgaggcaagggccaggcagcaggtggcagcacccctgaccctacagcctcatcccaccctctcctccccgcaagcacccgctcacatggccatgtccctggcctcgcctgggctcagagcctcctccggccccacgagcttcacagctgagaagtggtcctggagctgcggccaggagtcagcgatgtggggttcatggaagacctcctgggaggggaagacatagggggatgggctcagagggcagggaggcggcacctgagggatgggggtgcaggaaggagatgggggtgggggcacgagagttctgatcagggcagggaaagggtccctcaggagaggctccaacaggggagtctcacgttgttgtgcaggaaaagggtgaccctgtcggggggatagtccaggagtagcagccgctgcaggaagcggggcagaaacggagtaggctgttccacaaacacggccagaaacacccgggggggaggctggaagatgcaacacgcagggactcagagagaagcccggacttccctgctgcccccacccaacctccaccctgacaggtgcagggacccaggagcgatgcccccaccgccccccagtccgctgtccttgtacctcctgctcagcacgctgccctctcgtgcccctccctggcacccccacctcacctgcccccccgggagtgtcctccggtcctggttgcagaagccacagcctccctcaggagtccagccattggggacgtagtttcccaggtagttgagctgcagctgttggggacagactgaggctgagtggctgaggcctccaggggtggaggtgggggtcaggcacctctgatatgggggctgggaagggccagcttctcagaagggttggaggtgcctgggggttggggcagggcggggcgggggttgagaccactggtggcaccttagtgggaccgtttccatggaccacaatggggagcgtgtcgtaggccacgttccggatacgcacacggttccgatcaaactttaaaaccacttcatctggggaagaaaaaggccaggcttcagaccccctttctctgggagctaccaagcaacacattcttctaaatatggggtcccaaattctccagggaataaagggacaccagggctatcctggagtgtggctcgttgtgggcaggaacctttgggttctgaccaggctgctggcccagagagctccactgcctactacctgcgtgatcacaccgcagctgggcgaggaaggggagggtgagctgagcgggaggccagtaggagcctcagcatccctacccctcctcatattctctctctccttgtttttttttttttttatttttattttttgagatggagtctcactctgtcacccaggctggagtgcaatggcgtggtctcggctcactgcaacctctgcctcctgagttcaaaagattctcttgcctcagcctttcaggtagctgagactatgggcacatgccactacacctggctaatttttgtatttgtattttttgttttttatgctgagatggagtctcactcccaacacgcaggctggagtgcagtggcacgatcttggctcattgcaacttccacctccagggttcaagcgattctccttcctcagcctcccgggtagccaggattacaggcgcgcaccaccatgcccggctaatttttgtgtttttagtagagacagggtttcaccatgtcgaccaggctggccttgaactcctgacctcaggtgatccacctgcctcggcctcccaaagtgctaggattacaagcatgagccaccacacccagcctaatttttgtatatttagtagagactgggtttcactatgtcagccaggctggtctcaaacttctgacttcatgatctgcccgcctcagccttccaaagtgctgggattacagatgtgagctgtcgcacctggccttttttttttttgagaaggaatctcactctgtcacccaggcaggagtgcagtggcgcaatctcggctcactgcaagctctgcctcccgggttccagtgattctcctgcctcagccttctgaatagctgggattacaggcacccgccaccacgcccagctcatttttgtacttttttttagtagagacgggttttcgccatgttggccaggctggtctcaaactcctgacctcaagtgatcctcctgcctgggcctcccaaaatgttgggattacaggcgtgaggcaccgtgcctggcctctctctctccccgttctccccatcccctgaggcaagtcaccaacccctccacaagctgttttcctcatctgtacaagaaggataaccagggaccttccctttgttaaatggaatcacagaagtagaccgggcacagtggctcatgcctgtaatcccagcactttgggaggttgaggcaggcggatcacctgaggttgggagttcgagactagcctggccaccatggtgaaaccctgtctctactaaaaatacaaaatgagctgggcgtggtggcgcatgcctgtaatcccagctactcgggaggctgaggcagaagaatcacttgaacccgggaggtggaggctgcagtgagccaagattggaccactgcactccggcccgggcaacagagcgaaactctgtctcaaaaaaaaaagtccctggcccggtgcccaggcacagcatgtgtgcaacagatgccagacacgtttttgcttcccttgcttctggtagtaccatcagcacagtgcaacttacacaaccagccactcagacgcctgacaaaaccacatagaggtgggcttggatcagcccagctcctccagaagcctctcccagctcaagacccctagctgcagaggctgcgcatcgcccacctgcggctgtcttcctcctcacctaaagccccgttgaggttctgaaagatccgagacttatgatccagattaaggctgagtttctcctaaatggaatgagatgcgatggagtggttaaaatggaaggagtggaaaggacatcatttctcacttttctctctctttttttcttctcttgcttttgttgcttaggctggagtgcaatggcacgatctcagctcactgcaacctctgcctcccggtttaattgattctcttgcttcagccttccaagtaactgggactacaggagagtgtcaccacgcctggctaatttttgtatttttagtagagacggggtttcaccatgttggccaggctggtctcaaactcccaatctcaggtgatccacccgcctcagcctcccaaagtgctgggattataggcatgagccaccatggttttcctttttttgtgagagacagagtctcattctgtcacccaggctggaatgcagtggtgcaaaacatcctcaaactcctgggctcaagtgatggtcccacctcagcctcccaagtagctgggattacaggcgtacaccatgaagcctggctaattttttctttctttttttttgtagagatgaggtctcaactatgttgtccaggctggtcttaaattcctggactcaagcaatcctcctgcctaagcctcccaaaagtcttggatgacaggcgtgagccaccacgcccaggcacacatttttctctttgcaaccccctttgctccccaaatcccattcagcctgaggcctccactcccacagagctgcgggatgcgcccactcctctgccttccctaccctcagtcctgggtccaggtagagccgtgtgtagaacagctggtcgtcgtcatcatccttgtacttccactggcgcacgatttggtggatggtggtggcaaaaccgatgaatcctggcggggagggggagtgttgacctcgagactcccagggtcccagggcctgtcccccaggctgtctccagccctcaggcgcctttaacactctgtgtcccaccgctcttggcccctctgccttgggcactctgccactcaccaccagaattgaggaagcgcttccccgtgcccacctcagggtactgctccgccagcccccactcgggccagcagaagctctctgcagagaagagcaggcggctgccactctggacgaacttcttcagcagctctgtggggctgccggccagaatcacgtcgtagctgggtgaggaaggggaggatgggcaggggtccactgggaacctcagcatccttaccccgctccctatccccagccccgttacctatccacaaacatgatgatcatatcctcccggtcagcgtatttctccatttccttctttaaccaccggaccttctgtcctccaccaactgttcgagccacatcaccccctcgccactcctctcccaggcccagggtctgtggagaagattgccccgtgccaggcaaggggtggggagttgtggggggaactcctgaccaggcttaccgtggggacctgggcatccagacttcagcccacccctcctgctgggaccccctcccaggggcctttccctctcctcacccgcacagtgtagttgaagaactccgcagagcgcaggaaacgcaggtacccctcggtttcagctgtggccacagtgatcaccagcagcttctctgttaccagagggaaatggcacttgagatccaccgcccagctccgggcctcacgtgctttgctgtcctccctctcactcgacttccctccctttcttccttcccattcttaaactcttctcacccaggaacactctgaccccaaggagggcagggtgggagtggtgcccaggaattccgagtccctttgcatagggaggctggaaaccccagttcagggtagtgatgggcgaggggcttggcgcgactcagcctcaagagcacgctgggcgggggacgggccagacacctcctcgagcctccgaccctctccgggccaggctggcaggcacgccagcctctgccccctcggccgtgccgggcctccccgggatctcacctgggttgaccgggtctcggccccggggccggtcggaggctgaggccgcagggggcagcagcagcggcagcagcagcaggaaccggggtccaggccccgaggaggtcatggtggggagcgggcccagacagcacccaggatcctgggatctccgctacgcgcctggatcccagctccggaggggagctctggaaagggggcgctcgggctgctgtgcggccgccgcggggagcagcttggctggggctacgccctgaaaaaaaggcgtatccggaggctacagaaagctccagatgccggcgccacagacaaggcgaggattgtcccgggcgcacgggaggcgggggaggggcggcggctcgggccggcgggcgggagacagggactctgggctgagccagccgcttgacacatgtggaagctgaaacctggacaggggaagtgacccctggcggagggtcgggcgggacgcgggggcgggtcctggccgcagccctgcccagagagtgcgggcggaagacggggagagcgagaggctggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcgggtatgtgagcccccgcggttcgcccccttccccttcccaagtcagtcctagaattttcttacctagtcattcctcttttttggtctcgctctttcgcctaggctggagtgcagtggcatagtcatagctcactgcagcctcgatttcctgggatcaaaccatcctcccacctcagcctccggagtggctggaactgcaagcatgaggccccacgcctggttaatttttaatttgttatgtggtgacgggctctcgctatgttgcccaggttggtctccaactcttggcctcaaagcgatcctcctgcgtgggccttccaaagtgctgggattacaggcgtgagctgccgcgcccggccccagctattcctcgtaaatcccttcctcagccctcgggtcctggcgttgacccttcattcacgttttattggtgcctgctccaagccgggcgctggggatgaagaggagaaagacccctcttatccaagcattggctttttctggaaggggggcagaaacgcagacctaacactgtattttactgtgatttgtgatttgtgctatggcagagggaagcacagcgcctgggaacagggagacgtggcatctagcccaggttctgggaggcaggggactgtgaaagcttgaaggaaaaatgaaaaagcttgaattgagtcttgaaagtctagttagggtttctctcagtgggaacctcacgtgcaaaggcagtgaagcaagaaaaagcaagtcgcttaggaagccaagttcacagtttggatcttacagagtaataagaaaggatcgaaggctggggaaaggttacattttgaaaggcattatacacactgcccaggagtttgaactctgtagggaaacactggagagccagcaaagactttttttttttagacagagtcttgctctgtcacccaggctggaatgcagtggttctatataactcactgcagcctcaacctcccatgctcaagtgattcttccacctcagccacctgagtaggtggaactacaggtgggtgcaggccaccatgctgggctagtttttatattttttgttgagatgggtgtctcactatgttgcccaggctggtcttgaactcctgagctcatgtgatcctcctgcctcggccttccaaaatgctaggattacaagtatgagccactgcgcttggcccttttagtttttctttctttctttttttttctttttgagacggagtcttgctctgtcccccaggctggagtgcagtggcgcaatctcggttcactgcaagctctgcctcccgggttcacaccattctctggcctcagcttctggagtagctgggactacaggcgcccgccaccacacccagcttatcttttgtatttttagtagagacagggtttcaccatgttagccaggatggtcttgatctcctgacctcgtgatccacccgcctcggccccccaaaatgctagaattacaggcatgagccactgcgcttggccctctcagtttttcaaaggcatcgcagtctcccagccatcagttttttcatgttggcctcaaggtctgaaataccccgctgtctcccctagccaggtcattcaccagttaggccttaacctagacttaccttcttctgggaagtcttccctgactactccaaggccaggttgggtgtttctgtcctgggctctgcagcactttatacttccgtatcctagcctactccatgctgtacttactgtgtttgtttcattaatcatttgtgtttgccactggactgtaagctttggcatccctaaaacctagagcactgcctggcatttggaggggagacagagtagtacagtgatcataatcatatttttttttgtttggttggttttgggtttttttttttttttttttttttttgaaacagggtcttgctctgtcacccaggctggagtgcagtggcacaaacacagctcactgcagccttgagctcctgggctcaagcaatccttgcgcctcagcctcctgaatagctgggactacaggtgtgtcccactacacctggctaatttttgtattttttttgtagaaacatggttttgccatgttgcccaggctggcctcgaactcccgcgctcaaacaatccacccaccttggcctcccaaagtgctgagataacaggcatgagccactgcgcctggcaaggtcatgctttttgatgctgggtagttctttgactcctgacctggccacttgttagctatgtgaactttggacacatttcttaatctctgaatgttggtaaattggggatgatgatactgtcccatacagctgttgtaagggttaaatggttcaagtgttgcaaagagctgagcacgtgcctggctcatagtaagtgtccaacaagtgatagctactggggctgctgctgttattattatgcttaacaggtggttaatgaataaagagatatattatgcaaaattatcagaatctggcaaacagctgataaggcaatgaggaaagaggttttttgttttttgtttttgagacagggtctctctctgttgcccaggctggaatgcaatggcgcgatctcagctcgctgcaacctccacctcccgggttcaagcgattcttgtgcctcagcctcccgcgtagctgggattacaggcatgtgccaccacaccctgctaatttttgtatttttagtagagacatggtttcaccacgttggtcaggctggtctcgaactcctgacctgaagtgatgagcccacctcagcctcccaaagtgctgggattgcaggggtgagccactatgtccagccgaggaaagaggtttaaaataacttctaggtttctggtttggatgtctgcatagacggttccatttgcgtagagagaatctgcaggagaagcagacttggatgggaatttttttttttttttgagttgcagtgtccacagggccagtgggtgatttcttttttccttctttctttttttttttttttggagacagtcttgctttgtcactcaggctggagtggtggcgcgatcacggcttgctgcacactgcagcctcaacctcccgggcccatgtagtcctcccaccgcagcctcccaagtaactgggactacaggcatgtgcaaccacgcctggcttattttttaattttttgtagagatggggtttggctatgctgcccaggctggtttctaactcctggcatcaagcgatcctttggcctcccaaagtgctgagattacaggcgtgcgccaccacacccggcctcaccaggcgctggctgcatggccagttctggagcccgggagcaggttctgtgttgagggagtcactctgggagtcatttgcttgtgggtgatcatcagagccctttgtttggagtcaaaatcccaggaagagtgcatagactgagcagagaagagggccagccacctccatagaggcagggagagcagccgagctggagccggaggattcctggacatggagaaggcctgcagttttgtcaaggaagcaagcaaagggtctctttctactcgatgaaggtagtcggcaccgccacagggtggacagggctcaggtccaaggaggaggaggaaggcacactggagccgctctggggcccagagcgtgggtgggtggtcccccaggatgaccaggcaggtgtcagattttggggttcaaggagaggatgggaggtgaaaaagtgacacatcacgtgagttgctgtgaaggagaaggagctgtgaagccgagtagacacatgagcgtcgccagctctttgatggaaagtgccggttgaggaggaggggttgaagatgggagagggagggaatgggctggaggtgaaggctcggggtcagtggtgggacttggggcgctccagggcaggggtgtgcccacttggcatcacgtttgtgggtaggtggcctggaagatgagcgtatccaagcatgggtggcccctggttcctttgaggtaggaggtgagatgctgagtgtgagggccatgtgtattgagggcccaggacagcctggaagccccagggcgctgtgacctccccagtcagcagtgagctgtctccaggccggggctcactggctgggactgggattgagaggaaggcggagaaaacaggcaggagaaactgaaagggtctcagctggcgggacaggaagtgtgggcccagggcttggcccgggaggagacaaggggaccaagggcttggcaatggggatgagatcagagagctgcagcttccaccccgggtgccttcctcgccctgcccagagcggcggccacactgctctttcttggaagccctgtaactttgcgtgccctgctccatccagttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggtgaggcggatggaggaggaagcgggggatgggactgagaggagggcgggagagtccgcccaactcaggctgtgggaggacccaggagctcctggtgcctctgccagtgactggctcccatggctgtgagcaaccacaccccctttctgtgcctcagtttcctctcgtgtatgtgaaataaacaagagagactggataagctctgacacgaagccttaggcttgggggcatggaggtgactgtcagctgggattggagaattggggtggagggcagaggctggtagcgaggggccgacttagagccaggagggcagggccaggtgtggtggctcacgcctgtaatcccagcatttgggaggctgaggtgggcggatcacttgaggtcaggagttcaagaccagcctggccaacatggtgaaaccccatctctactaaaaatacaaaaacaaaattagccaggcatggtggtggacacctgtaatcccagctactcaggaggccaaggcaagaaaatcacttgaacccaggagatggaggttgcagtgagtcaagatcgcaccactgcactccagcctgggtgacagagtgagactgtctcaaaaagaaccaggagggcacatgggcatggggagtgatgaaccagagaaagctgctgtctttctgggcaagtgccaagcaacggatcacccttgacccctaggaaagaaaaagaagaaaacccgaggtgatcattttaaacttcgcttccgaaaaaactttcaggccctgttggaggagcaggtgagaggagggtcggcctgggaggaccccacagggaaggggtgagcctggcccgggcaggtgttcgctgcgtgggtgggcggaggagttctagagccggccccttgtctctgcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgagcatgagacctgctgtccactcccactccctccttcccacagcctccccagacctctctcccctcatcctggcttcccctctgtctgcaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaagccttcctgtttggtcgtggtgtgtttgaggtgatggtaatgggtcacccgtctctcctgctcacggctctgtctctcttcctcctgcctcccactcacccctgccaccgtccgcccctctgtgtccctgatcgcgagagattctgtcccattttcctgccacccccgagcccctgccctccttggctgcttctttaagtctttttggttattgatttagttgtttaaactattttatttatttattagagacagggtctcgcactgtaacccaggctggagtgcagtggtgcggtctcagctcactgcaacctctgcctcccaggttcaagggattctcctgcctcagcctcccaagtaactgggattacaggtggccaccaccacgcccaactaatttttttatatttttagtagagttggggttttgatgtgttggccaggctggtcttgagctcccaacctcaggtaatccacccgcctcggcctaccaaagtgctgggattataggcgtgggccactgcgcccggccatgtttttcctttttatttctccagttgctatattttcaaagtacagctaggttccagggatgggtgacagggaggtggcgggaggactgtggaacatgtgcagaatggtaccgcggagggaccttggcctgtcttcctctcaaggtacttaggcaaaggggagtggtccttgtccttggtgctgccagactgagggagcagttgtccttaggaagcccctgttaccaggggctgcagtgtgtgaagttattagcagtacggaaaacccagaagtttctgggaaacatgggggaattcatggtatagagcaaatttgtccaacctgcagcctgcatgtggcccaggatgactttgaatgcagcccaacacaaattcataaactttcttaaaacattatgagattcttttgcgatttttttttcttttagctcatcagctatcgttaatgttagtgaattttatatgtctcctaagacaattcttcttccaatgtggcccagagaagccaaaagagtggacacccctggattagaggcccctggtctgggtggccctgggtgctgtgactcatgtgaacttcttatacccataccttgtctaaatgaattgcaagctgtaatctcgtaaggtccttttggttgctgtattaaggcccagaaccctgttaacctcatagcaaagcaagtgcttagtaagtatccattgaacagatggcctcattaagatattagagagatccagcaaagtcaacgttaggcaccattttttttttttctgagatgcagtctcgctctgttgcccaggctggagtgcagtggcgccatctcagctcactgcaacctccacctcccaggttcaagtgaccctcatgcctcagccttctgagtagctgggattacaggcgcctaccactatgcccagctaatttttgtattttttgtagagatggggtttcaccttgttggccaggctggtttcgaacttctgacctcagatgatccacccgcctcggcctccaaagtggtgggattacaggtgagagccaccgtgcctggccagtcaccatgttaggccttcacttttgggtactttcctgggggttggctcaagtattccccagggttttcttgaggaactgcctccctttctctgaagacttgcagctgggcaggcagtactggttttggtgtcagcttcatgttggggggctgatgtcaggattcagagacaatccaggtgaggtggtttttcaagatggctcaaaaatctttgtcctcccattaaaaagtggagtgttacggccaggcaaggtggctcacgcctgtaatcccagcactttgggaggctgaggtgggcagatcacttgaggtcaggagtttgagaccagcctggccaacatggtgaaaccctgtctctactaaaaatacaaaaattagctgggcatggtggcgtgtgcgtgtagtcccagctactctggaggctgaggcagcagaatcgcttgaacctgggaggcggaggttgcagtgagccgagatcacgtcattgcactccagcttgggcaacagaatgagaccccggctaagaaaaaaaaaaaggccgggtgcagtggctcacgcctgtaatcctaacactttgggaggccaaggcaggtggatcacctgaggtcgggagtttgagaccagcctggccaacatggtgaaaccccatctctattgaaagtacaaaaattagccgggcgtggtggtgggcacctgtaatcccagctacctgggaggctgaggcaagagaatcgcttgaacccgggaggtggaggttgcagtgagctgagatctcaccattgcactccagcctgggcaacagagtaagactccatctcaaaaaaaaaaaacaaaaaaaacaaaattagccaggcatggtggcatgtgcctgtaatcccagctactcaggaggctgaggcaggagaatcgcttgaacccgggaggcagaggttgcagtgagctgagatcgcgccattgcattccagcctgggcaacagagtgagactccgtctccaaaaagaaaagaaaagactatttcggggctgaacaacaccatctgtgcttctccgtggcatcctaggctgggattcccgtccagcttgcactgtcagcacaatctctttggattctttcctaacttagctgactgtttcatattttgtggttataaaaagaggcacactggttctgttcaatgtaagatttctctccccagtgacgtactccgccttccaaaatgaccttgagaggacagggctggaccctgaaggcctctggttgctctctgatgccatccatgacattctctaggaagctgagtccagggactttggacccccattgaaaaaccataattcggccaggcaggtggctcacgcctgtaatcccaacactttgggagcccgaagcaggcggatcacttgaggtcaggagttcgagaccagcctggccaacatggtgaaacccagtctatactaaaattacaaaaatcagctaggtgtggtggcacacgcctgtaatcccagctatttgggaggctgaggcaggagaattgctggaacccaggaggcagaggttgcagtgagctgagatcacgccattgcactccagcctgggtgacagagcaagactcagtctcaaaaaaaaaaagaaaaaagaaagaaaaccataattccccaaggacagcctgaaacaattttgccagcttccttcatgctagggagattttttcctaccttgggagacacctggtctttgggaaatgtatactctgctctaaggttctagaaggtaaacctagtgtcatgtgataagggcagcacccccctttcctgggagcacagaggaggaagaggttggtgccagggtttggaagtgtggacacgggtggttactcctaaaaacttcaatgaggctgggtgctgtggctcaggcctgtaatcccaacgctttgggaggctgaggcaggagggtctcttgatcctagtagtttgagaccagcttgggcaacacagggagaccccatctctacaaaaaatttaaaaattggccgggcacggtgactcatgcctgtaatctcagcactttgggaggccgaggcaggcagatcacgaggtcaggagatcgagaccatcctggctaacacggtgaaactccgtctctactaaaaatacaaaaaattagccggcctggtggcgggcacctgtagtcccagctactcgggaggctgaggcaggagaatggcgtgaacccgggaggcggagcttgcagtgagccgagattgcgccactgcactccagcctgtgcgacagatcaagactccgtctcaaaaaaaaaaaaaaaaaaaaaattaaaaattagccaggtatggtggcgcacacctttagtcccagctactcagggaaggatggcttgggcctgggaggttgaggctgtggtgggcagcaatcactttactgcagtccaacctgggcaacagagcaagaccctgtctcaaaacaaaacaaaaaaaagatcttgattttaattgatgtgagttaggagagccaagaattctgggaagcagggcaattgtgtcttcagtcttggagaaatcctggtctgagtactaactagtggtgtagctcggacaggtcacttcacctctctgatgctgttggagccatgctgcagctattgcaagaattcaatacacctagcccgagacctgacttctagtgagtacgcagcaaatgagagcgcttgatgatactgccaagacctaaagcatgttgttgagtttttcacagccagctccctggggactaaacccagcacctggcccaattgtcaggtagccagcagtttgcatttacatttctttttttgagacagagtgtcactctgtcgctcaggctggagtgcagtggcatgatcttggctcactgcaacctccacctcccaggttcaagtgattctcgtgcctcagcctcctgagtagttagaattacaggtgcccaccaccatgccccgctagtttttggatgttttttattttttcttttaatttttttgagacagggtctcactctgtcacccaagctggagtgcagtggcacgatctcagctcactgcaacctctgcctccctggttgttcaagcgattctcctgctgcagcctcctaagtagctgggataacaggcacccgccacctcgcctggctaataattttgtatttttattagagatggagtttcattatgttggccaggctggtctcgaactcctgacctcaggtgatccgccaaccccggcctcccaaagtgctgggattacaggtgtgagcctctgcgcccggccagtggtttacatttgtgtttgctcctaggctgtgggttctttgagggcacaggcccactccagcttctagcagggaagcagctcagtatgtgttctgaaaaagggcaaatgtctccataaccctttgtagtcacatgtccacccgggaagaaatcaaaactcaacctggtgaccatattaaggcacacacttaaatgccgagttgtaaaactgggcacaggttgtttttcctgaagggggaagaagtgagaagaggcaggctggtgttgggaaaaggaggtagacatgtgggggtggcacactgaagacttttggaagtgcctggaggtgtcagcagttgtaattgacttttgtcttccttcactatagggagcactctcatggcctttcaggattgtaagacactttttgtttgtttttcaagacggagtctcgctctgtcgcccaggctggagtgcagtggcacaatctcagctcactgcaatatccatttcccaagttcaagcaattttcctgcctcagcctcctgagtagctgggattataggtgtgtgccaccactcctggctaatttttgtatttttagtagagttggggttttgccatgttggccaggctgctcttgaactcctgacctcaggtgatccgcccaccttagtctcccaaagtgctgggattacaggtgtgagccactgctcctggccctaatttttatttttttagtagagatggggtctcgctacgttgcccaggttggtcttgaattcctgggcttaagggattctcctgccttggcctcccaaagtgctgggattatggccatgatccactgagcctggcctgtaaaagacacttctactgagcctggcctgtaaaagacagaagacggtgtggaaggagaggattgcagttggtcacagacttgttggccacaggaccctttatgtagggagcagctcaaaaggcaccagggcatctggccaggcgcagcggctcacacttgtaattccagcactttgggaggctgaggcaggcggattacctgaggtcaggagtttgagaccagcctggccaacatggtgaaaccctgtctctactaaaaatacaaaaaaattagctgggcatggtggcgcacgcctgtagtcccagctacttgggaggctgaggcaggagaatctcttgaacctgggaggccgaggttgcagtgagccaacatcgcaccactgcactccagcctgggtgacagagcaagactctgtctcaaaaaaaaaaaaaaaaaaaaaaaaaaaagcaccagtgtttctggctggagcccagccaaaaggatcccaaggatcccagccccaaggtgaaggtgtgtccagggcccaggaagcagcctggtgtgatggtggagcacggtttatccggaggaaagggagcaatggggatggagaggtgggccaggcccaggcagcatgtcaagttcataactgtctggggctttcttctggcggggccaggagctgccaaggcagggcggtcggtggttctccaggagtgcattaggaagaccgtgcttgagacgcccagttgggggaaccctgtagttgtgggggggcaggagagtatgagggcctgccccaggaccagcagtgg

SEQ ID NO: 1985 - DNA, 11029 bp, Homo sapiens
tctatattcagagtgatagtttcttatgtatttaaaatgttttctattcatggctaagaattatgtacaatagcagggagacaactgctcttagctgtatggtgaactagatattctgaattgtaaccgccccctcccacctcctccatacaacatccacatgctggataaattacagcaatcatactttatttatttagagatggcgtttcactcttgttgcccaggctgaagtgcaatggtgtgatctcagctcactgcaacctccgcctcccgggttcaaggaattcttctgcctcagcgtcccgagtagctgagattgcaggcatgcaccaccacgcccagctaattttttgtatttttagtagagacagggtttcaccatattggccagactggtcttgaactcctgatctcaggtgacccgcccatctcggcctcccagagtgctgggattacaggcgtgagccactgcactcagccagcaatcatacttttacatgcactgatgagactgcaagacagggaaattcctcatgactcacaaatatattaacaaaatggtaaacaggccactagccaggatgcccttgcctgcacagctggggactaaggacttcaggtcacagtgatgagggatatttataaagacaaggctttggacctaaaagagaactgggaagctgagcctaagatcttcacatgaagccaggagactataatagaagagctcacctaaaacaagttcgtcagagaaagactgggctaggaaaaaaaccactaaggctgggcacggtggctcacggctgtaattccagcactgtgggaggccgaggcgggcggatcacaaggtcaggagttcgagaccagcctggccaatatggtgaaaccccatctctactaaaaacacaaaaattagccaggcgtggtggcaggcacctgtagtcccagctactcaggaggctgaggcaggagaatcgcttgaacccgggaggtggaggcggaggttgcaatgagctgagatcgcaccactgcactccagcctgggtgacagagcaagactccatctcaaaaaaacaaaaaacaaaaaaacaacacctgcgttttacccagttctgcaatgatgggggtatagatgggagatcttaatgctagatatgttttccctgatactttgtcaactttcatcaaggtctagggttcaaaaatacattatgcttgcacatggaaattccaagccacaaatgaaagtggccccaagtgattgcatcacctggagtctgaaaggtaaatatgcatcctctctggagaaaagcatcttcattttaggtaccttaggagtcccaaagtatgtcctcccaatttaaggggaaaaaaatctgaaacacacaaggaaataagccagtacgcacaagggtcagcaggaaaacttttttaattcttaagaaattaagatactggaattatcagaaacaatataattatgtaaataaaacagagtggaaataaatgagcaaagaacaacagaaaatcaaaaataaccaggaaaattcaagaaagaatcaaacagaactccaaaaacaaaaaattactgaaattaaaaattcagtggatgggttaaataagagactgggcttatgtgaaaaagagtgggtgacctggaatatagacctgaaacaattattcagaataaactatctggataatatgagttaagatacaaagaacaagaggagaaagccttacataaaactgactaagattacaaaaggaaataatagatagaatgtggagagagactatttgaagaaaaaatggcagagaagtttccagaataataaaaaacattaagccatcagacacaggatataacaagaaagataaaggaaatccctatctagacacattatagtggaatattctagaataccgaagacaaaggtaaaccttaaaagcagccagagacctttttcaacaaatagtcccagtacaagtggatgttcataagtcaaaaaaaaaaaaaaaaaaatctcaaaatggatcacagacttaaatgtaaaactagagaatttttttaaaaaaattaaaagtatgagaaaaatttcggaagctagtgctcggcagagttcttacttttgacaccaaaagcacaatccataaaaggaaaaactgataaactgcagaaaaattaaaatcttgtactctacaaaactctattaaaagacaggccatacattggaggctaggcatggtgactcatacctgtaatcccagcattttgggaggccaaagcgggagaactgcttgagaccaggagtttgagaccagcctgggcaacatagggacctcgtttccactaataataaaaaaaaaaaattagctggctgtggtggcaggcacctgtagtcccagctactaagaggctgaggtgggaggattgcttgagccctggaggttgaggctgcagtgaactgtgatctcaccactgtactccagcctgagtgacagagcgagactgtcttaaaaaagaaaaaaaaagaaagacaagctatatattgggaggaaacagctgcaagcaacatatctgacaaagaactagtatgtagaatacataaagaactctcaaaactcaaaaataaaaaaaaacctaaaaatccaattagatataaagtaacatttcacctaacaggatatgcagatggcaaaatgagtacatgaaaagatactcaacaacattaccaattaaagaaataaaaattaaaaccagagtaagttatatatctatcactatatacctaccagaatgcctaaaataaaacacagagacacaactaaatgttgttgagaatgcggatgaagtggatcgcccatatgttcttggtgggaatgtaaagcagtctgactcacccaggaaaacagttcagcagtttctttaaatatgcaattatcatatgacctaacaactgcactactgggcagttatccagaagaaatgaagactgtgttcacaaagaaactaacagcagctttactcattacggtcccaaactgtaaacaacccagatgtccttcaatgggtgaatggttaaacaaactacagtatattcataccatgaaatactactcaacaataaaagtgaactattggccaggtacagtggctcacacctgtaatcctagcactttgggaggctgaggcgggtggatcacctgaggtcaggagttcgagaccagcctggccaacatggcgacactccgtctctactaaaaatacaaaaattagccaggcatagtggtgtgcgcctgtaatcccagctactagggagaccgaggcagaagaattgcttgaacccaggaggcagaggctgcagtgagctgagatggcgccactgcactccagcctgggcaacgagactccatcccaaataaataaataaaacaaaataaaataaaagtgaactattgatacagcaacaaactggaagaatctctgaagaataaggctgactggggcaaaacaaacccaatcccaaaaagggatttggtttataatcctgtaagacacaatctcgaacaccttaatcctgaatggtgaaatcccaaaagatcaaaatgcctaatctaaaatccataatgtctaaaatcccaaaaatcacaatcagaggatactggcatcatgataggtagaactacaactttctcattgtctttatttggaaattaagtacggtttaaggaggtatgtatgggtgctgagttgataagaggtgttctttgggacttaattttaggtgtcaagttgattggattaaggaacacctagaaacttattagtgttttgagtgtgtctgtgcaagtgtttccagagattagcatctgagtgaagccagtggaagacactggttgttcttaaagtatttcaaatgactgcagttataaagctgagcatacacaattaccaaccacagggctatgcattgatacatttccctttttgacctatttctttataaataccactcatctgttcataactgtcatacccatgtgactgtcattagtagagctgagaactgcttatgcttgcaaacatacgtatgttattgttgcctattttattgtgtaaagtggcctgtgtttgtatttctcaaatcctcttttaaaaatgtgaataatcagccaggtgcagtggctcatgcctgtaatcccagcactttgggaggctgaagcaggcagatcacgaggtcaggagatcgagaccatcctggctaacacagtgaaaccccgtctctactaaaaatacaaaaaaaattagctgggcatggtggcgggtgcctgtagtcccagctactcgggaggctgaggcaggagaatggcgtgaacccgggaggcagagcttgcagtgagccaagatcgtgccactgcactccagcctgggtgacagagcaagactccatctcaaaaaaaaaaaaaaaaaaaaaaaagttaataacctgaagtcaggggtttgagaccagcctggccaacatggtgaaaccccatctctactaaaaatacaaaaattagccgggcatggtggcgcacacctgtagtcccagctacttgggaggctgaggcaggagaatcactcgaacctgggaggtagatgttgcagtgagctgagactgtgccactgcactacagcctgggcaacagagtaagactccatctcaaaacaaacaaacaaacaaaatgtaaataaatatcttttaaaggtttttaaaattattctttccagaattacatatttgggattatgattatcagggtttcaaccttcatgatcatggcatttgggattatgtatttccggattatgagtggctccccaaaaggctacataatacagaattccacttatataaaatccttgaaatgacataattataggaatggagaacatatcagtggttgacagaggtgaaggagaaaacagaagtggcagggaagtagacgtggctataaaaggacagcaagaggggtccttgtagtgatggaaattttctgtatctccactgtgtccatgtcagcatcttggttgtgataccatactagaatcttacaagatggtatcactggaagaaactaggcaaagggtacacaggttctctctgtattatttcttatgattgcatgccaatctacaactgatttcaaaattgaaagtttaaccacagcaaaaaagcaatcagaaagaaaagtcacattatatccaaaagaatgacatttggaatgacaaaagatttctccccagtagtaacaaaagtaaaaagatagtagactaattcttcaaagtactgggggaaaaaaagacacacctcaacttagaattatgtacatataaaatcaactttatagaatgaattgaaaatacttttgataaatgtaaactaagagtttgccatcaacagatgtcactagaggaacatcaaaagatgtgcttcagaaagaaggaaaattatcctaggtgaaaggtctgagatgtgagaataataatgaataaacaaacacttctaacatataaagtaaatctaaaccaacaattatctgtacaaaaacagtaataatcacaaggtctaattttttttctaacagatggtgtctcactatgttgcccaggctggagtacagaggctagtcacaggcacaatcgcagtgcactgcagcctctaactcctggcctcaagggatcctccggcctcagccattcaggagccagaactacaggtgtgcaccactgagtccagctcaaggtctaattttaaggtgaaaaatcacaagctataactaaaatactgaatgattttaacacgaaagttgcaagaggggtgacttggagagttccaagactctcaattagagaggaagataaagatataacattatactttttaagtacggatgtaatattccaaggaaattcccccaaaacaaagaagagggggcagaggggtgagggtggaattaaaaaacatttttgattccaaaagaaaaaaaaagagtggaagaaaaaaacataaaaagcacaaaataaggtggtaaggaataaatgcaaatacatcagtacacataaaaatgcactcaactaaccagttaaagttcagattagatttaaaaataattggccgggtgcagtggctcatacctgtaaccccagcactttgggaggctgaggtgggcagatcagaaggtcaggagttccagaccagcctggccaatatggtgaaaaccctgttactaaaaaaaagaaaaaaaaattagccaggcctggtggcaagcacctgtagtcccagctactcaggaggctgaggcagtagaatcgcttgaacccaggaggtggaggttgcagtaagctgagattgcgccactgcactccagcctgggtgacagagtgagactccgtctcaaaatagtaataataatcatcatcatcatcatctagctatatgctgtttatgagacacactaaaacataaggacattcatcaacaaagcaggatagaaaaatctagctaaactatgcgcaatgctatcaaaaaataaaaacgtcaatgaaaacaaattcccagaaaaatgtaataaaaatgactaacattaaagaaatagaaaggctaataattctataatttttgaaacctaatcaatagttaagaaattttctcacaaaaaaatgcaaagttcagacaattttataggcaagctctatccagcttttaaggaacagattaatttaaatgtttttcttttcttccaagagaacagacagagggaaggagagagagacagcactccttaacttattcttagtatccacaatctattaagtataaaaagacaacaatctactactatataaatgggcaaaagacatgaaacaagcttttcagagagcaataaggaatgaataataaacatgggaaaagatgctcagcctcattaacatttaggaaatacaaagttaacttccactctagtcaaaatggagtagcagaggcacgatttaccttctccaccttaaattaaaacctatataaaatgtatacaaggaagtttttcagatgttagacaaaagccagtgcaggacagtgactcctgagagatggaaaacaaagaaagccctataattgcgcaagcttctacatggggtttctaagctgtggcactaaggctagggaagggaacctccctgggtagagaatttaggggagccaaggtaagatttgcagggcagaatattgggtttcccttaagtcttcagctaaacaccaagcagtgtatgcatgtgaggtaaggaacaggagatacaactgggagctcaatagggttcagaatatttcatgttcccaacagacagaatgcagaaaccgtgtaaccaggaagattattcagaacggtattaccttcgtagtgggtcaaattagccctaaactaaaggctgtcccagtcctgtcttattaagcttaaaagcaagctataaaatgatcggattgtttccaagtaactttatgtccccaaacagagttcaagatacttaaaagaactccagcacccaatattaaaaacagaaattaccaggcatgtaatgaaggaagttacaatccaatatgggcagggtgggggttggggtagggtgggaatcaatcaatagaaacagaccagaaatgatgcagatgacagaatgggcaagcacactgaaagagctattatcaatacactccagatgttgaaaaaaaaaaaaatagaggaaggcatgagcatgtgaaggagacacatgggagataaagacccagacagaaattctaaagactaaaaatatgtcggaggtgaaaaatacctggatacgattaaaaggaaattagatactttagacagaaagattaataaacaatgaggacacagcactggaaagtacccaacatgaaacacagagagaaaaaggctttttaaaaagctgcacagaatcagcacactgggagaaaattctgaggggcctaacgtacatccaagtcatcagagccccaggagaagcatgagaggagcagagagaaaaccataacagaagaaaaaatgccccccaatttccaaattctatgaaaaccataaacccacaggtaaaatagctgcagcagcagaaacgtgaaaaaaaaactacagcaagcacatcataatcaaacttcttacaaccagtgacagaaaaccttaaaagcagccaggaaaaaaatgacatcttacacatggaagagcagagataacagtaatcttgctggaaatcacaggtagataccacttaacatccactaggttggcaaatttttaagtctgaacttaagtgttggagatgctatgaaacaaaggtaactcacagtgccaagagaggtataaactagtacagtcacttcagaacacaaatttggcattattttatcaatatatcaagcaatataactgctagatacaatgttcacagcagcattgtttcaacagcaaaaacaaataaacaaaactcaaatgtccatcaagaatgaataagttgtagtatatttatataatactatatagcaataaaaatgaaagaaagtcacagaagtaaacattttgccatttatataaaattcagaaacatacaaaattaacatttcacttacagatacatacgtatgttgtaaaactataatagacaaatgacaaacacaaaattccaaataattatttgagagggagagggccttagggaacttctaaaatgtcgacaacatctgtatcttaagctggctgatgagtacacagatatttacatttattatccctttatatatacgtttatgtatttttgtagtatgaaatacttcattaaaaaaagagtgaaaatgtaagacttcaaaaatgaagactaccatttatgtataacaataaaattagtgtaaaaaagtatacaaagaaaatgttcaattctttatctttccgtgctctatataatcagtattaatctaaagaccataatcctagtatgaaaaaaataacaagctttgacacaaaatctaagcatctgctttcctggcactcttaagttagacaagagtaaatatgttagcctctcaattctgcctcttcatctttcatctatacttagatttttctttatctttggacttctttggacttctgcttcggtctctctttttactcctttctctttcataaagatctgtttggtattttgatttatgactattactataatggccatccctctctcgagatcggctacgacttcggttctgagttcggtctctcttttcactcttttgtttctcccaacagctttcttcttcttcatagtgaccaaaccccatttctctatagatatcctgtcaaaggaagggggaattacaagtgaatcagtaaaataatcattttgtgggcattttcaattaataaaacttagaaaagtctaccattagaaggctgttataacagcttaaatgtgaacactaccactaatgtcaagaatcttgtaaattacaaagcaataaaataattcagaaaaaggtttaacaacgtcattgatttgtatctactattttggctgaaacgaaggatcagcttcaaaaatatggaactgaaatagctcaactgaaatcagaacatgtctctagagcaatctgcaaaatcaaaaattctgattatgtatagtcttattcccagctccccacccttcactcccccaaaacgtggtcccattattgatctgcaatgaaactactaaaattcccataagaatcctataagaagatatcattgaaataacttagcaggaagagatcttagacaagtcagtaagtcttaaataagaaaatggaggctggatgcggtggctcacgtctgtaatcccagcactttgggaggttgaggtggatggatcacctgaggtcaggagttcaagaccagcctgaccaacatggagaaactctactaaaaatacaaaattagccaggtgtggggacgcatgcctgtaatcccagctactcgggaggctgaggcaggagaattgcttgaacctgggaggcagaggttgcggtgagccaagattgccccactgcactccagcctgggcaacaagagcgaaactccatctcgaaaaaagaaaatggataatgtatacttgggtctgagcaattaatttttaaagtgttttattttataacagctcctctctagatgttcaaatacatcttccatgtttagaaagacagaagttagagaggagaattttttttgagacaaggtcttgctgtctcccaggcaggaatgcagtggcacgatcatggctcactgtagcttcaacctcccaggctcaaccgatccttcccacctcagtctcctaagtagctgagaccacaggcatgtgccatcacacctggctaatttttgtatttttttgtagagacggggtttccccatgttgcccagggtggtctcaaactcctgggttcaagtgatcccctcccacctcggcctcccaaagtactgggattacaggcatgagccacctcactcagctgattaggcttatgtcaaaattattatatttctttaaaatgagtttttaaacactggtagaatcctttgccccaaagataataaaattgctacatttaattctactcttagaccacagccaatgctctttcaagagatactttgtaaaatttaactttcttaagactgcccaaaggaaaggaaaattctaaggactaaactcccaagggtctcaactctatcaccagataccactgtagcagacataaatgtcaaggcttaaaattcagagtgatgaatacccatggttaaggactgggttttaagcaaattattagttattccatatactgtctagatactgtacaccttgagtttgacagtgtgtgaaaacagatgtaacaggattgttatagtaataatcacactgtgtaatacagtattataaact

SEQ ID NO: 1986 - DNA, 5513 bp, Homo sapiens
actgttcttcttgtctgtttcttactgattctcatgttgcctttttatggactagacactgtagttttaaaattatttatagaaatgacctgagacctatgatatatttttcaagagaggatttacgtttgtttctagctttgcctaggagtcttcaatcattttaattcagtttcagggactgatttgcttttaagcagggctgtagtccctacaggggtggtcaacttcatttcactacctaatatacctattatgtgtggagtactttgctagatgttgggtaggtcttgtgagcagagcagacctctctttggtctgtatggagcacggagcttgattataattggcaggtgtgtgtgtgtgtgtgtgtgtgtgtgtgtaaataaataaatatttatttatttatttattataggccgggtacagtggcttacacctgtaatcccagcactttatgaagtcaaggcaggtggatcacttgaggtcaggagtttgaggccagccttgccaacatggtgaaaccctgtctcttctgaaaatacaaaaattagccagacgtggtggcaggtgcctgtaatcccagctactcgagaggctgcggcatgacagtcactcaagcccgggaggtagaggttgcagtgagctgagattgtgccactgtaatccagcctgggtgacagagtgagactccatctcaatatatatatgcgtgtgtgtatatatatatatctatatctttaagatagatatatttatatagctaagtaattaataaatatattaagttctatgaaagcaatgagtaggctgctatggttgtgaatatttggactacacaggggataagaatgggtctaccataattagcagggacaggttttgtttaagccaaaaactaagagggcttagaacagaaaccgccaggcagaagcagttaccagtgtgaagactagatgacaaccaaaaaagtatgtgggaggagggaggggaggttgcgcagtggggagttgagattgacttagaactgtattaatgagctttccccccaacccccatttttctcccatttaccttcagaaaaattagtgatttggctaccagtgaatctaggctccaggtgtagctctgtagttttggactagttacctaattcttcattcacaacaaaacagaaggagagaggaaaaagagagcaaacatggaattgggatgggaagtaagagagcacatgaggagagagactatgtcaagtttcttcgtattccttttttaattacagaagaaaagatgggataaaaatattccatcttatttctctgtttaaaagaaagagtaggccgggcatggtggctcacacctgtaatcccagcactttgggaggctgaggcaggcggatcacaaggtcaggagtttgacaccagcctgaccaacatggtgaaaccccatctctactaaaattacaaaaattagccgggcgtggtggcgcatgcctgtaatcccagctacttgggaggctgaggcaggagaatcgcttgaacccgggaggcagaggttgcagtgagccgagatcacgccactgcactccagcctgggcaacagagcgagactccttctcagaaaaaaaaaaaataataataataaaataaataaaagaaagagtaaatgaatcaaaatgaagagaagccattttatctgcctcctggatgaagagtttcattgatgaacctgaaatgttttggttaacatgagaaaggagggtgagaagatgcctgagatgtgagctccttgaggacaggagctgctttctctctccagcctggcacaagacaaggaacttagttgaatgaatgagcaaataagtggttctctgctttgaaggaacttggactgtcattaccttgcaaatcaggtttaccatttatttgctttatataagttccagaaagaaactatttcctctcataatattactaccctaaacttctggtctgatctatggattgtagagcttaaatttcctcaaaccccaacagtcagagattgttacaccaagataaatagcatatttctcagcgccttgtattttctgtctttggccacagaccttaggacttaggctgatatttgagaaggaaaaactggaatttagtagaattatacttcctgtatcttaattttccaactcttatataaggtttgctttttctagagagagactaatctggaatgagaatgaattctcatcagtaaaggcaaagctttaagtgggtcatctgactttgcttttgtgctctacattcaccctgctcataaaaggtcctttcatgagttttctaggctttcatcactgccagcgtctccacaggcattgtgaaagtattaaacttcctaccctcccccatgcttgtctcatggactctttcgtagagtgcacagtggactgtgtttagctcagcaggaactctttgcaaacactgaatacatgaacaacccccctggaaagataagagatttcagtattgcttggtgtcatagccgcagaagttagtgtctgccagtatctgatgaatatggtgacttgcagcctaatttttgtgaaattatgaggccaaagtttaagaagtgttcatgttaaagttacttatatataaaatttgcctatcgataatttctgtcaataggaggttgatgaatgcttcacataacctagatactcctaattaactgttttttatttctttttttctaggacacatgttcaaagagcataattaactttttaaaagaagctagtaagtactgaaatagttttttaagttttttctacaagaatagaggaagaaaggaaacatggaattctgaagggctacttagcaagctgcttatggcataatctggggtgggggtgcatagtaaaggatttgcattttactgagaccgatacatgtcaagggaatggtatttaaaattagtgatatgtgttgatttttcaaggactatagcccatcaactacaataggctccaaaaaattctggtgaaattagcttcttggagccttccagtttacctactatgttattcccactataaaatattctcaacttttggggttttagccacttaagttttttattttctctaatgtctctagtatctgctttagtttcctgtcaatgctagactctgtggttcagcagttcatccattctcttcccagtactcaacctcgttgcttatagtttcattacattcatctagcaaaaccttaattctgtatgtttgccataccattagtgcttagagcattttttcagaaaagaatcctggaaaaatggatcttatctcacctgggccctcaggactgctgggctgcctggtgtcagcacttcccgccattttctatagcaccagtattattcttaatactttaaaaaaccaccaggcacggtggctcacgcctggaatcccagcactttgggaggccaaggtgggcggatcacaaggtcaggagatcaagaccatcctggctaacacagtgaaaccctgtctgtactaaaaatagaaaaaaattagctgggcgtggtggcgggcacctgtagtcccagctgctggggaggctgaggcaggagaatggcgtgaacccgggaggcggagcttgcagtgagccgagattgcaccactgcactccagcctgggtgacagagcgagactccgtctcaaaaaaaaaaagtaaataaaaataaaaaaccatatcccactatctcccccttctctctttgcctgtgatcttgctgcatacttatggggaaatctttaagatgtcagatttcagttctctcacttttctacaacttctcccacttttgcctttcttatgtaccttcccttccttcccatctgattccttatcagtatttacacatgattagttcttgcctaacctaatagaccctttcttgagtgcaaatcagtggctatttttgctagggtataaaaattacctatctaatcaccttgacaaagttaccctgttatttccaataacttacttcctatggattcttgtagattttcttttttttttttttaatttttttattttcagatgttttctcgctttgtcaccatgcctggcctaaattctcgtaggttttctatgtaaacaatcagattttctgcaagtattagtctcctttctaattgttataattttaatttctttttctttttaaaatttttcgtagagacaaggttttgctatgttgtccagcctggtcttgaactcctgggctcaagcaatcctcccatctcagcctcccaaagtgccattacagtggcatgagccactgtgcctggccaaatttcttttcttgttgcgaaggcagacttttcatacaatactgaatagaagtgatagtagattactttatttctgattttcaaaggaatgctttccgtttctctctgttgaagataattgcgtattgtttttttttttaaatagtaacttttatcaggttaaggaaggtttcttctatttctatttaaaaggattttttaaaatcttgaattcatatgtttttatctaatgcattttctacatcagttgaaatggttgtatgaactcttttaatatgggtgaattatatttatagattttatgttaaaatatccttgtatatcttggataaactcaactggatcatgatttatcttttttatatgctagattcaatttgttgatactttgttatgatttttgaatatatattattgtgtaaaagtgagcctgtgattttctttcttgtaatgtttctgtccagttttggtgcctggttttgctctctccttagaatgagctgggaactagtcactcttgttttctcacctataatagcatctgggtccagtgttttttatgtgggacaaatttgaacttgtggtcaacctctttaattgtaagaatattcaggtcttttgttcttcctgggctagttttttattctttttctagagattcgttcatttttcttagttttatttgcctataattgtggataatctgttttttatctgctacttctgtaattatttccacatttgatttataatattaacttgtgggccaggcgtcgtggctcacacctgtaatcccagcactttgggaggccgaggcgggcggatcacgaggtcaagagatcgagaccatcctggccatcatggtgaaaccccgtctctactaaaaatacaaaaaaaaaaattagccgggcgtggtggcaggcacctgtagtcccagctactcagaaggctgaggcaggagaatggcgtgaacccaggaggcggaggttgcagtgagccgagatcgcaccactgcactccagcctgggcgacagagcgagactccatctcaaaaaaaaaaaaaatttacttgtgtcttctctttttacctgtttgttaatttatcaaataactacttttggctttgtttcatttttattatacaataaaa

SEQ ID NO: 1987 - DNA, 22810 bp, Homo sapiens
aatgaaaccatttttgtctcttagtgaatggattttacacctcagtgaacaggtaagagggtttatctttgtgaagtagaagtctttctcatccccttaagaggctacccacttctgcatataaagttaaactatatgagtttgtctccaaaatttataataactggattacctccttgatcccttcaaaatgaagtgtctgataaaaaaagagaattaaatttaaatgtgtcttatgaaagaacattatttaatcaaaagaaagataattattcttctattcttactctccttaaatataaaatgttttcattggttcagaacaatatagccaaaatcacagaattagaaatttattgtatttgaccttattctaaaatgtttattttttaaaacctcacaataaatttaaaaatattaaaatataaatactttggaggtgattattcaaccagtctagcaagttatttgacaatcgttctctgaatgtattatttttcatttctagataattctaaggcactgatagcatttctggcatttctgattattgtgacatcaatagccctgcttgttgttctctacaaaatctatgatctacataagaaaagatcctggtaagagttgattttaaatttttaaataataatggtattagtaatggtgcaaacgcatatccatatggcagtgatggaaccagttaaatgaaatatgtgaactagagagaagacagcatacagcccacttcatgacacaacttttaatcaaaaacttttagtatggttttattggtttgaattaaacattaatattattttctaaatttactaataatgttgtggacttgtttaataataaccagtgaaaagaatgtgtgtggtttttagtacaaagtgggtcagagggatctaggagtgtcaaaagaaaaagaaaggagggagatgtctggggaagttaatgtgtttctttggtcagaaacaaccacatcttatgaaaaacagaagatttaaaataaaatcatttagctacttatgtgagtttagcagacaattcttggttgttttctttcctccctcaccctcctctctcctctctgactctgctttctcccatccttctgtcctccctctgctcaaggctcttcctcccttccctcctttcctcttctcctctcctctcttccccttttcttatccctgacttccttcctttgttccttcaatatattcattaaatataagtaaaataccaattgaattttgtgcttcttgagaatatagaaacttatttttcctattttcacagcaatttagatgaacagcaggagcttgttgaaaggggtaagtatgtatatttttgctgatgactattccttcccctgcatttgaatccattcattttatttatttatttatttatatttattttaagacagagtctcattctgtctcccaggctgaagtgtggtggtgcaatctctgcttattgcagcctccgcctccctgttgaagcaattctcatgtgcctcagcttcccaagtatctgggattacagacacacatcaccaggcccagctaatttttgtatttttagtagagatgggatatcaccatgctgcccaagctggtcttgaactgctggtctcaagtaatccacccaccttggcctcccaaagtgctgggattataggcatgaaccattgcgcccgtccccattcattttaaataagaattgggcatttttagtttaacttggacttttgttgatacagtgataaaacttaaattcctttactcactcagcacctgtgaagttcccagtgtacgccaagcattgtgccaggtactgagagtactacagtgacaggcacagactctgcccttaaagggtttagaatctaatagaggaaagcagatatctcaacaaatatgacggtaatttgatacatgccctagtagttgaatgtgtatagttctatagatatatggaagatagaaaactgtgtgcaagggcagaaatctggtctgttaagattgtggggaaccaatggacaaatgagggagtggtggagggacgagtggatggaagtcacagagatggggagatgggatgtctcctcaagtccctgccagggtggaatggtggctgctcccactaaagacacatttatggattggacaaagaacagcaatttgacttgggagaagaaaacacatttgtttatcttttttttcaacatttatattctttaattttttaaaaatgtgatttctgatccagtaaaaggggacaaagtttcagaaattgaacctttgtttacaataaagaaatgtacttgctttctcatgcttaagacaggaataatttcagaactcctttgtctgtgttaatctgtgttggaagtgtttccctctggtaatagcaggtaccaggtctctatgcagaaactttagggctgaatctttggagctccttaaaaggctttatttttctttgcagaatgtaacactatctgatcccttattacatatttattcatttggtcattgactatcctctcctaactagaatgtaagctttgtgaaagcgtggaggcttttttcttattcactgctttatgcccagtaccaaagtgagtacctaggatttgataaatattagtgaataaataacactgacatagggtatcgtgaggattcattttgataggctgagggaggaatgaagagtacaatcagtaataaacacctgagcagaacaggaaaatccatctcaaggagttaaggtggacttggaaagtgtcaatgaaatattttatctcaaaattggtaccgattgcaccttggaacgcagtagaatttactcactcagaccccatgaaaccctgaatgtggccctcagttcagaatgaatgaataccaggcattcccaacaacctaaagaaacaattgcacatagccagtttgagagctgtgattgtatagaaagtttccatgggcaataagataaatgggtcaccctcatggataacttctttctttatctgataaactggtaaaattaatatgattactgaaagaaacactatcagtagtacatggaagagtaggagaaacataattttacatatgcgacagcttaaattctcttacctttctaaagctgttggttttcaagttccatatgcaattgtagctttttatggttagtatactttttaatcttcagtaagttatttcacaaacatggtatataatgtgtttcatatacttgaagcataacaaattaatacaacttgtttcaccatttagtgtaaacagatgatcaaattaagctgagtcatgggtataagggtattaatcatattgtcttatttcatttgcatgtttacagtatttcacaagttgaaaatgaaaatacaaagaaaaataatattgtattataaataaataattatagtaattgctataaaatgcatatagtcaaacgtgaatgtccttataatggtgatgtttggtctgggatcccttctcttaagcatagaaaatggggaagaacattctagtagagagaacaatataaagcccagaagagatctgaagtacaagattgaaaagtcattgatttataggtaaatgtttgtatgtgagtgagatttctcagatgaaatgtgtacgaggaggaaagaagctaaaggattgagtacacggtgtaaatttaatgaaatgtgtatgcccacctgaaagacacatgtaactagtattgaatctttaatatgtttccagatgatgaaaaacaactgatgaatgtggagccaatccatgcagatattttgttggaaacttataagaggaagattgctgatgaaggaagactttttctggctgaatttcaggtgtgtgttgcttttgttatatgatgataaattcgacatcaagacagttccactttaagtgtatttatattgccatttgcctttataatttatcccacttgatattgcaacataagcaaagtagatattattagcagatctctatgaaccagaagagagactcatagaggttgacgggattatagtgtagagctagtaaatattttaatgtagtgctttattgtattatgaagttgtgtcacaaaatgtatttggctgattttgtagttgtactctagatactcatccaagtatctgtttttaaatgaatttgatagtgacacaacaactaatcctaaatttgtccccactcaagagatttgttctgaaagttgtcaatcattaatttgtaagaaaaaagttttttttttaacataattcctgatcttaattttgattactctaagcaaatttttttatcaatatgaagaaaatattttacaggatatctcatttactcaaaacggtcattggtaagggggaaattatttttcctgaatctgctgtgatccaagaaatcgttgtttctttcagagcatcccgcgggtgttcagcaagtttcctataaaggaagctcgaaagccctttaaccagaataaaaaccgttatgttgacattcttccttgtgagtatttattgagtgctgaattcccatatattaggctacttgattattcactatttcacttgtttatttttcttttccttaaacagatgattataaccgtgttgaactctctgagataaacggagatgcagggtcaaactacataaatgccagctatattgatgtgagtaaaaatttgcatttttcttatacctacatatttcattcagctccttgtttgtcttggtaaaattttagaaatattattaaaaatattttgaagtgagcccatatgtcactgatataaacaaaaaattatcaatattagcaaggatagttatttattatgtgactattggtattaggtataacatagaattttcctctacaaacaaaattatattaagaattaatttaatatactctggtgtctattatgtgctagatattagactaaatattctatgcatatatttctcacaagaagtccacatttgcctcagccatgtgccgtataggtgaggactgggaggctcagtttagttaattaccttgttgttgttcacacaattggtaaatatttgagttgaaattcaaccagagtctgactgactccaaaatgttatgctttaatttcatcacactaaatttcagcagacattcctcatcaacatgatcatctatccattggatttatgcagaaatgtaaatgtccgtacgtggttaatttatttaaaatattttaaaatttaatttattatacaaatgttaattaatgtattacataggttaaataattttaaacagtataaaaatatatacagactgaaaaaattctttttgtctccccaaatctgccattttcccagtgtcctcacctaccagaaataactatattttctattcaaatatatatggtaattatggtatcaggttacttatgtttccccaatggaacttagagctccctgaaagcatgtgtcttctgcttttagataggtgattgacatattgtagctattcaataaatacttattaaataaatgaatgtatgcgcaataatgtgtcatgagatagaagtttcaggaagttacttaaattaatgttgaattcttgtgacccatgtttcaaatttaatccaatggcaaaggtcatccctctctgaagagctcctttagttactgaggtgaatttaggagtctgagataattctggaagaagccagtataatattttatctgcctctgtactcctttatcttggtaacaggagcagagaaagcagacatagtaggtaatgaaatgaaagttattatatctcttatctgaaatggcaaagaagtctagggaatcatattccagcagaagttaagaggtgaaaatgcgggtaaaatctaagaatgatttgtttaaagaaattgagtaaaaatcccaaaagtaactacatggctggtgagcttgtttaaatagtggtagatgatcctataagagttggcaggatataaaatgttgaaatgtctagagcactcttgtaaattaccacagcatcgcagatgaagatgaaacctagtattaaaattgtttgaagtttacagcaaagatacatgaaagtcatgaatattctttgcaaatgctaacatgtttagcacaattaaatgcctgaccaccaattaataagattcccttaatactttgaaactgcccagagaaattcacaatcacaaaatgatggatctgaagcaattcctctaactcacaatttttcctgttaatgagtaattgaatgttcagcaaatgacatatctctgcatgtgttttcaatagggtttcaaagaacccaggaaatacattgctgcacaaggtaatttctttgataatccaatattctttttgaaaaatttttatagcacttttaagaaaatttttcttatcagcttttatttgtttacctcctaggtcccagggatgaaactgttgatgatttctggaggatgatttgggaacagaaagccacagttattgtcatggtcactcgatgtgaagaaggaaacagggtaagaaccaagaagattcatagtgtgggtcttggggttaggaaaacaaggtgttgaatggcattttgaaaagccacatgtatctgcctgatgactaaaacagagagttctctattttaatcagtgttaacatttaatttaaaattttcatacatgtagaaaactaaaacttttaacatacaaatatatgtctatatgcataaaatttcaatgcttctgattaattgctagactcttaacttgattcctgtttctttgcagtattgttataagttcagtatatttcactgttttaacttcacaagaccttaatactcgaaacaaaactgaccttgggcagataggtggtgagtcatgtaatgtgactttaggaataaaagcctctctgtccccctacctaaaattaaccacaagcaatcatatcctttttgctgacaactgattatgtcctctcttaacatgcatctaagcctggaaagatcatcctgctaaaaagtatgaaggaaattcttcaggacacattagtgggaaatagaatatatttcaagcatcacagcttaaggtttatatgtgcttaaactatacaactgttttgagaatttcaaatgagtataggttttgttttcactgtttaaagaaagtttgataaaaaattggcttaaattaaaaattaaaatacttaataattttttaaaatgtagaacaagtgtgcagaatactggccgtcaatggaagagggcactcgggcttttggagatgttgttgtaaagatcaaccagcacaaaagatgtccagattacatcattcagaaattgaacattgtaaatgtgagtttgctttttacataatttttgttttgatacttttttataaaaatataattatggaatattaaaagtgagaaaataaaatatatcaggaaaaattatttttgataacctttaggatgaaagctgtggttagaacaatgacaaaaatcaatagggtcaaatttaagtcactggtcaagacgtttttgtccaactcaaatcgaaagaattatactgtattaattaattatctgttttaattattaaaaaaagagggaaggtccattaaatgtgttgaaaatataatcaaattattaaaagaataagcaatttgtcttcattgtcagtgagttcctacttttatgaaaaaaaattatattatttccataagagaaatgacagcattagagaacactgtaagaagtataaagttctaactatgcagcagagatagaatgtttagttcagaaaataaggaggtcattgtggccttagataatagttaaaatagagatcgtcatgcatgttatataattccattatatgaaaaatccacaataggcaagtcaataaagacagaaagtagatcagtggttgcctggagctgaggaggtcaaacagaaatggggagtggctgcaaataagaacaggctttcattttgtgatggtgaaaatgttctataattagatattggtgatggttgtactatttagtgaatgtaatatgaataccaaattgtacattttaaactggtgaactttatggtatgtaaaatgtgtatctcttatttccaacaaatgaattttatttttaattttttggggtacatggtaggtgtgtatattcatggggtaaatgagatgttttgattgaggcatacaatgcataacaatcacatcagggtaaatggggcatccatcatcccaagcatttatcttttctttgtgttacaaacaacccagttatactcttttggttattttgaaatgtataataaattattgttgaatagtcaccctgttgtgctatcaaatacaaggtcttattcattttatctaattatatttttgtacacattaaccatcaccatttccacccctgccatacccttccaatcctttggtaaccatcattctactctgtatatccaagagttcagttattttaaattttggctcccacaaataagtaacaacatatgaagtttgtatttctgtgtctggcttatttcacttaacgtaagtcctccaggtccatccatgttgttgcaaatgactagatcttacccctttttatggctgaataatacttcattgtatatatgtactacattttgtttatccattcatcagtcaactgatgcttaggttgtttccaaaagttgactactatgaatagtgctccaataaacgtgggagtgcagattatctcttcaatctactgtttcctttctttgcggtatatacctagcagtgggattgctggatcatatggtagtgctatttttagtttttttgagaaacctccaaacagttctacatagttgttgtactaatttactttctcaccaacattgtctgagggttttctttccttcacatccttgcaagcattcattcttggctatcttttatatataagttgttataactggagcatagtgataacttaatgtagttttgatttgcatttctctgatagtaaataatgttgaccacctttttatttatctgtttaccatttgtatgtcttcttttgagaaatgtctattcagatcttttgcctatttaaaaatcagattattagatttttcattataaagttctgtaagcttcttatgtattctggatattaatgctttgtcagatggatagttggcaaatattttccctcattctgtggcttgtctcttcactttgttgattgttttctttgctatacagaagctttctaacttgatgtaattctacttgttcatttttgctatggttgcctgtgcttgtggggtattgttgaataaaactttgcacaaaccaatgccctggagagtttccccaacattttcttttagtagtttcatagattaaggtcttagatctaagtctaatccattttttttatttaatgtttgtatacagcaagagatagggctttagtttcattcttccacatatgaatatccagttttcacagtacaatctattgtggagactgtcctttccccaatgcatattctgggtacctgtatcaaaaatgagtccactgtagagttgtttcattgctctatgtatgtttttatgccagtaccatgctgttctggttactatagctctgaagtataatttcaaattaggtattgtgattcctctagttttgttcttttcactcaggatggctttggctattctgggtcttttgtggtttcatataaatattaggattattttttctatttgtaaagaacattattggtattttgatagatattgcattgaatctgtagatagttttgagtagtatggacattttaataatactgagtctttcaattcatgaacatggaatagctttccattttttatgtcctcttcaatttcttgcatcaatgtttcatagttttcattgtagagatctttcacttctttggttaagtttattcctaggtatttatgttgtttttatctattgcaaacgagattactttcttgatttctttttcagattgttcaatgttagcatataaaaacactgcttgttttaatgttgattttatatctcatgaccttactgaatttgttaatcagttctaatagttttttggtggagtatttaggtttttccaaatataagataatggaatgtgcaaacaagtataattggacttcttcctttccaatttggatgccttgtgtttctttctcttgtctgatggctctagctgggacttccagttgaacaacagtggtgaaagtgggcatccttgtctttatccagatcttagaagaaaggctttcagttttttctcatttaatatgatgctagctgtgggtgtgtcatatatgactttcattctgttgaggtatattccttcgttaccctgttttttgaggtttcttattatgaagagatgttgaattttatggcataatttttcagcatcaattgaaatgatcatgtcttttgtccttcattctgttgatataatgtatcacaataattgatttgtgtatgttgaaccatccttgcatcccttggataaatgccacttgatcaggatgaatgatctttttaaagtgttgttgaattcagtttgctagtattttgttgaggatttttgcatcagtattcatcagggatattgaccggtagttttcttttttttgatgtgtctttgtctggttttggtatcagagtaatactggccttgcagaatgagtttggaagaattcctttctcttccattttttggaatagttagagtagaattggtactagttcttctttaaatgtttggtaaaatgtggtagtgaagccattaggtcccgggcttttctttgctgggaaacttttcatgacaacctccgtttcattacttgttgtctgttcaggttttgggtaccaaaaataatggcaacaacaacttttcaagacatggagagcaaaataacacatgaattgaaacaagaaaatggcaaaatgtggaggaatgaagttaaaatatagcattttcattatattacactttgcttgttagtttgtttacacaatgtctgttgtcttcagtgtaaaataatgcattataagatatgataaccccaaatccaaaagcattcaacagatacataaaaataaaaagcaagaaattaaaacagaccaccagagaaaatcaccttcacttaaaggaagacaggaagaaaagaaagaaggaagaggaggccacaaaacaaccataaaagacataacaaaatggcaggagtaagtctttatttatcagtaataacattgaatatcagtagactaaactctctaaacaaaatacatagagtggctgaatagatattaataaaacaagacccaacaatctgttgcttacaagaaacattcttcacctgtaaagacacaaatagacttaaaataagagatggaaaattatattctttgtaaatggaaacctaaaaagagaaggagtacctatacttatataacacaggtatatttcaacacaaaaactaataaaagagacaccgattgtctctacataatgataaaggagtcaattcagcaagaggatataacaattgtaaatatatatgcaactaatactggagcacacagatatataaagcaaatattgttagagctaaagagagagatagactccaatacaataatagttggagacttcaacactctactttcagcattaggcagatcacccaggaagaaaatcaacaaagaaacattggtcttaatgtgcattgtagaccaaatgaacctaatagacatttatagaacacttcaaccaatggctgaagaatacacattcttctcctcagcccatggatcattctcagggacataccttatgttatgctacaaaacaagtcttacaaaattaaaaaaaaattatataaacttttctttgactacagtagaactagaaatcaataacaagaataagtttggaaactatacaaactcatggagagtgaacaatatattcctcaatgaccactgattcaatgaggaaatcactaaggaaattttaaaatttttcaaaacaaatgaaaatggaaacacaacaaaccaaatcctgtgtgatacagtgaaagcagtactaagagaaaagtttgtaagagtaagcacctacattaaaaaagaaaaatttcaaataaacaacataatgatacatttcaaagaactagaaaagcaagagcaaactgaactgtaaattagaagaaaaaataataaagatcaaagtagaaataaatgaaactgaaataaaaaaatacaaagcatcaatgaaataaaatgttgtttttaaaaagagaaaattgacaggccaggtgcagtggctcatgcctgtaatcccagtactttaagaggacaagtcgggtgtatcatttgaggtcaggagtttgagaccagcctggccaatatggtgaaaccccgtctctactaaaaatacaaaaaaatattagccaggtgtggtggcatgcacctgtaatcccagttacttgggagactgaggcagtagaatcacttgaacctgggaagccgaggttgcagtgagccaagattgcatcattacactcaagcctgggctttgcagtgagactttatctcaaaaaaaaagataaaattgacaaacctttagtcagactaaggaaaaaagagtggagactcaaatgcgtacagtcagagatgaaaaaagagacattgccactgatacttcagaaatttaaaagattatgagatgctactatgagcagttatatgctaatgaattggaaaacttagaagaaatggataaattcctagatacatgcaacctatcaagattgtaaaatgtctcttgatagagctgtttaaaaaactacaagtctttacatgggggttaagattttctcttaatttcatttattgtagggcttttagtaatctaaattttatttttgtatagtctagctatattttctacaggagaaacagacttagtctatatatctccgtaggtcttcttaggtttccatggtattactaattgttatgtctatagagtgctgtgaaacaatcctatcaatagtttctggccaaacacttgtttgactaagccacaaaggcacctgctccatagatatgaggatatatttctagattgatgcctatctggctacattctgtagtctgggtttactggtgttaattaactcagtttgtgtgtttcttttgttatctaaatgtagatggttctttatacctggccatagaattatgacttatgcatcttatggtggttaccttgaaattagaacaaacctgagctctaatctggggctgactttcctcagtcgtctctctacattctgtgttgacaatgctaccatgtgaaggcctaaggaatacaatgttcatcaaataattaatcagactttgctcacatatgaattagttctgtttgctggcctatcaagcagaagtattttaaacagttgtgagaatgacctttaccaaatcattttaaacacaaatccaaaaagcttccacccatgcaccccacttttatggtgtatgtttattttgggttttttttgcttgacagcatgcaagttcctagaaattttggttatacttttaaagaaagtattaccttacttaccttactgttaagttattgcttacagggtagtacatgcaagtcctgcacaatatcttaactactagttattgattagaaaggaaaacacaaccatggttgagaaaatatataagacacctgaggaaactatgaactcttttgagtagtttatgtttacacgaggagactttgtactggtactcccttccacttatttatgtttcatagtttgctttaaaaaaatcatctcaaagaaaatattatctcttgactagaaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcaggtaggaaaaacgaacaaaaaaaaaaaacaacaacaaaaaaactccaacagaatccacctgcctagggctgttagagacatctttccctttggcaattgctattttgggaaacaacctatgggagaagcttagattcttatattggcttcacacctgacagcttttccatgatcatgcctctgcttttttttgcttggtttgccagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggtatgttctaacctttagtgattattctcactttggttttttggacttaaatcttttccaagtgataataatgatattttttaaaaatccaaattcttcacaacctcaaacagtagatgatttcctgaaaactaaaacgtggtaatcaccagaaatacttagaagcatttttcattagtgcctaaaagtactgtggaagaaagatgaccacaaaatatataatttttaaaataatgaactactgttaacatatatcagattggcaaaaaaagtaaaaatgctgaaaatagatttggcatcatctcataaaattaaactgaagagacagaatagtatagtaatcaacagctggttttagaaactacacttacaggtttcaaatcttgcttttaattattaatacgagggtgagtggtattgtttattaagtaattttagtctgactgcacctcagttaagtcatctgtaaaatggagacaatgataatacctcacagacttataaccacaaaagtaatacaaataaagcacttaaacaagtccctggcccatgctatgcatttggtgattgtaagtgatggtaattactgaaaatgtctgtatttgacccagcaaaatcacatatatgcatatacccaagagaagcatcaactagaaacatttgcaagaatgtgcattgcattcagcattgtcaaaatagcaaaaaaaaaaaaaaaaaaaaagtgaaatacatatcaatgaaagaatggaaacaccgtaaatatgtatcaataggggaataggaagacaaaatgtggacatgtgaactctctgtacaacaaatgctatgttgtggtagaaagcaatgatctaggtttgtgtctgtctgtttggagagatgctcagatgaaaacaatgagtgagtaaagctgccatacgaaacattcaagatataatttatgtgatttaaaaaaaacatgaaaatgtacaatgcttgtgattacagatacatagatagcagtgtagaaacataaaaacaaattgttaaccaggtaaaaagaaattatttacagtggaaaataaagtacagtggaaagacagtgccaaactcagggaactaaaggtggcggttaaagaggattatcagaagtataccatttccttgaaaatactggattcaaacaaaataagcagtaaagagtagttaaatctgggtttggcccattggattacaaaaaaataattttcttattaaaagaatacttttcttattttaagttctaaaaactataaaaaaaggttttctaaggaataacaacttgcttttttatctcttgaatatactgtgaaatttattatagttttacattcagtaatttggcttactgacccaataatcactaaaggaagtaacatacaatgttctttagtttttaggaataaaagttgtgcaatacagagtacatggataatctatttgcaaagtaattcttttctgaaaaaataatctgaaaatagaatttgctcatattccagaaaactctgagagtgaacttccagaatatttaaatattatagatatcaatttactttgccatgaattgttccaatatgagcaaatttatggggaatgtatattttatttaaatatgacttggaggactctagattatcagttaactatctgtatttgttcttgaaattgtaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccaggtaatgatagtgacaacaataataataattacagataacttttattcagtgtcatctactttctaggtgtttgctatgcacttgacatagtgcttgcatttagtcttcaccagaaccaaaggagcacagatgagaaaactaggacacagtgagttaagagaaatgcctgaatctacacaactattacataggagatttctttagacccagaaatctgattctattgctaatacttttagccattcctcattaagctggtataaaatgaagtgtcaaaataatagtatatagccacaaaactggtctgccaaaggcaatacagcatatcacctttaaaaatcgtatctggttttggtttgtaaaggaaatcattagaagagtttatgactgcttaggaagttgaactggctggagctggtagacacacagtaaaggataagtacatgtgtcttaacctatttattaggcaattattctcacagctaacctagcatgtagttcactataatttcagagagtttgcatagctgtcctcaaattgctcagttgtcaaaaaaatgttttgtgttttttttgttccacctatgatttccaggttactgagtcattccataatctaccaaactggtaaattcagagtttctaaagaccaggagtgtgcttttaatcacatgcagaaccatttaatgtttaggatcaaagtggggttaaggtgggggtggaggtggagcatgcaataatgaccaagtgactcaatcccccagaagacctgtacttataatggaagaactagcagacacagggtagtctcaaacagagtagtgttttattgttgttttcttgcttttctagctgataaattaaccttattcaatatacctgccctactaatccacataaacacataagctgttagagacagttatacatttaagttaaacattcttatgaatgtttatttactatagaaaagacagacaatttttttcactaaataaatgtgcttgagtttctgctatgtgccaagtacaattctaggcacaagagtcaaaatgatctgcaagtggacatgggaagaaggatgagaggatgtgatccagatcacagatggaagctgtgaaattattccatttaagcagacagtaagacagaagatgagagtagaaatgcaagtcggttggtaaatttggtattgggaagttgaggcagctcttgcctgatgatctttcatttttcaagaaaatgtgaggctaggtcatcagttgagagttgagagatacaagggcgagtagggcaaagaagagctcaatgcttgaagggtataaactagttacctcaaagtataaaaacaatctccctaggcagaggcagtaagattgccagaagttatcatttgatcacctgaaatttatgattataagtttaaagaggaattagtcagttggttgtattgttttctatggcagcattgagctctttgggggtagaggctgtgtatgcagatagttgagttaaacctatctaggttttgaaaagtgactatttgaaaatagtgaggcaaacgagttgagggtgtttacaaatgaatgatgactgaggtggaaaataaaaagcaaattggccacatgagggaggtgagagaaagtagtaaggataataagttggagactttgatagaattacagattgctaggttgaacatatcagaataaatgactaggaataataggggtaattttcaatagcacagatagttgaacttatgattttagaggtgatgtaatatttggaatgaaacctacaaaggtggaatgatgaaagtggatgactgggaagtggagggaaagtcatgggaggtgaagaagctaagaaatgaagagactagagtcttggatagattattcttgtcaatgttgaattaaccaaaaatgatgacagaccttggaaagaagagaatatacttagccaagcctaaaactaaatgaggtggagtgattcagaaatcaatacctgacacttcccagtgaagccggtggatagaagctagtatagtatgatggcaggaatatcaaagtgcttggttgatttgaaagcaaatgagtagaaatggtttgcaagtagaatcagggatcaaggagaacacgtatcttttcttgaagctgtgaggtaaatggggtgtgaggaggaaagtcaactttttcttaaaagggctgctgagttattggtggtgtccttagctgacatccaggttttaattggtggaaagaaaaaaaaaagggtgaagtgactgttgggagaagatgattaagataaatgggagttcacagatgacagacgatgggcatcagagggcagggaggaaggcactgatgggttagatgtaagagactgggttgtatctgaggatacaaataaccattcaggaataaaaatctggggaatgtggatgcactgggaagcttagacttgtgatggcaagtgaaacaggtagagatttaagagtgacagatcctttgtgtcttagatgaaggtgagccattaattccacctataatcctgagtattgctacagggcataggctgcctcggtgactacactcacaagagcacaaggtgttgtaacagtttccaaaacatctggtccttcatgcagctcatggtggtgttcaagtggcctaaaattcagtgatgatattttctttcactcaattacgtagcaaagaatgaggtttgaaacagggtgccataattagtttgaatgagggtactatgctgaaaaaatatatgtctatatacacacacgtatctacatgcgtgtgtgtgtatataaaatcttaccgaattgtacatgaggagccttctcagtttcagttatttgtaacattatctattatcattaaatattattcacttgacaaatacttatttaaggactagtggaaagactgtaggcaggggtgtcttccagaagaaattggtatttaaactgatacctagagggtaagaaaagttattagagcaaccaaaaggggaaagggtagttcaagcaagaaaaaaaaaaaaaagtgtttatgtgccaagagttgaagaacagcttggcccttccaagaattgaggaagctggtttggtagaagtattgagggacccagtaaggtgtaaggctggagaaacagtcaggggcgtatcaataaagactttttatgctattttgaggaggtttgttgtcctcttatagtgatggaaagctgttcatcttcagaagagcatcttctgttttgtgttttagaaggattagagcaggcgagattgaagacaaagaggccagttaggaaattgttgatgttttacaagcgagaaatgaaggcagactggattaagtaggaagaaagaaaactaaaaggatttgtgtatagaaatgatggatcttttctgactaattaggaactgtgggtgagaggaaagcaatctggaaggtgtaaacaaattaagaatgaactttcaaaacatgtgccaagtctcctaagaatgtgttgtctccaaagtttatttctgatcatttaaaataacttaccattgcttttgcaatatagatcaacatcggtctagtggtttcaatttatataagaacaaactatattatttttctatcaagcagctctgaagaaggagacatagtctgttacatatatatctttagtgcatactagccctgtcaaaaggactaaatgcctgagcaatttaaagaaaaaaaatcagaggcaaaccgaaaaattatggcctatagggagcatatgcaaatttcacaaaaattaatgaaatgcttttccttagggagcatcttatgatgcaataagccaatatttacattttaaaggagtttttctgttttttttttttttttcagagacttccttcatataggagctggaggacacagcacattggaaatcaagaagaaaataaaagtaaaaacaggaattctaatgtcatcccatgtatgtagtttatttttttattttttgtatcagataaagttaagctcttttggatttgtttaatgtgggacacacagtcatataaattatcttgaagcaagttttcaacatttggttgttaatagggaagaagttactaggtattaaaatactagttattgcaagaacttataatcctgaacatttacaatgggctttggagggtagactgtattcagtgttttctttttaccaattatttcagaaatgggttgtcataaaagagaaatatataaagctgggagaaaaaagagcaagtctcttttacccattttctttcatttttagtttatttcagttatttactccagggtaattgacaaatagtaaaaattacatccatttgttctctatatgtttcctttttatcccttataactgggaggttgaaagtaaggggaaaatactctataaattctaaatcttcaaatttaacagatcaaaatatgcacagtttcaatacttgaattctactatttaagcatattaaaatgatcacatatggtaattttattcagctgcataaactaaaattagcatggataaaatataacacaagttgataaattagatgaccaaataaatcagatcagtgcatggttgacctagttaattttcataggagtccttatgaatgtagtttaaaatatggaattgatggtgatatggttaatcaaatcatttgaccaagttattataaattatagaaattaagaaacagtgagaaattataggtcaaataattttctgggctaaataattaatcaaagctacccatataagattgttaatttaatattactggagtataattgagggaaaaaatctacgctatgtattttgtaaacttatatcaagcagaattataatagtccatgggaaattaaagtatatgtatcaaagattaaataatcatatataatgatatgatatctctttgttgtttgacatggaattatgttccatgttttttcctggaatcctttttcttagacttttgttgtataatttgtttatcgacaagtactgaattttatataggatcttatttcatgtagatcagtaagttttcataatacaatctgtccctttttaaatactttcaaatttccacatgacaatgaagaagaaatttaattttttcaaggaagacttactactgatttatttcacatagatgactataacagagtgccacttaaacatgagctggaaatgagtaaagagagtgagcatgattcagatgaatcctctgatgatgacagtgattcagaggaaccaagcaaatacatcaatgcatcttttataatggtaggtacttaaattgccaaaacccaagatccaaacattttaaaataatatctatgttattagggccattcattaagcgattttataaaagaataatgagcttggtcataactacatatagattgacatgagagtttcaatttcaatgctacaatttaacttaatgaaagatttaaaaatactataacctaataacctgagacaaaataagataatgctattggttatattttatgacaaatatagctataatcacatcaattttaaaaatagtaaaatttgagcaaatacaagtatttgaaaatgtttatacatactcagatacccaaattgtaggcaatgacaaatttgtatatttgtatggttagaaacttttcattcagataaactgaattattaggtgagtctgtgtcatatccccccacttttttaattaactgagaattcaaacaatgaaactttagtcatttattaaatatttattatttatacactgttggatttacttattttccaaagtttcctaaagcacacattcatagaatattagtttaattaggaaatataataagaatgtaaagacactaattaaaattagtatagacacgatgaaggtaatttgaaatgcttaagtaattcctttttacaatcacattaacctttatagagaaacaaaaatgtgtgtcttttgtggaaaggaaaatttgtttcgcaagatatgttgtaatcttgatttcacattattagctaagaattactattatctgtataattattttacatatagctattacattgtttcttgtaagaaacataagaatattactatttgtatgtaacagcattgatatcaaactgactatatttccaaatggttactttaagaatctactgagctctcttctgtagtaacgaagtcccaccctttttttgtctaaaaagagctactggaaacctgaagtgatgattgctgctcagggaccactgaaggagaccattggtgacttttggcagatgatcttccaaagaaaagtcaaagttattgttatgctgacagaactgaaacatggagaccaggtttgtacttttgag

SEQ ID NO: 1988 - DNA, 179399 bp, Homo sapiens
gtggattatattctcatcctcaaatcaaagacctttatactcagtcctgcattcttcctgcatggccgtttgtgtatgtcaggatgccatttgggaaacaaaatccactctaattattcctaagcttagtggattttaacatggaaggagaagcctaaatcagcagtgtctgggctgggtctccaggaataactcttgacctcgaagcattgacccacctagggagctgctgtgtctgctccatgaagaaggtctggaggcggcatccaccccctgcactcatatctttgggttcgtgtagacagtactgcagaccctttctagggaggagaggcctgggctcaagacatagcagcctctgccagaagtgtttcttcaggatgcagctgtgcctgccagtgccaacaccctcagcagctcaaatcggcctccatcccctgccctgccagtagcatgagtgtgtctgtttgagggaactcggttcacgtctaggatcctggctgcacgggagtcagagtagaggattagagcttcttgtcactgtagggcaggatgtcctgcccaggggacaggcagggtgaggtgagcagtagggctttggtggtgagaactttcctgaaacagcccctcctacgtgctcagcaagagggaaagggcgttccactggcccccctagatgggtaagagcacttggccagaaggtgggaggaaccacgtttgaaactgttggagcagaaattgtctagatgtaagttctgagctggcaggtgagaggcttgtcaggttcttaggcccccaggacagagaattggattgtgttcaatccttggtgtgtgtcacacgcattggtcatgcatagcctgcttttctctgttagttacttgtaacaacctactgagcaatgcaaatcctcctccacatgaaggctccaccttggcagtggcctacattggtcgcgtcagcttgagagagcatcatgcccctagtgctgtctaaatgttcactgcctcacgtaaccctcacaacagcacagtcagatgtgggctctggtgactctgcttcagaagagaaagctgcagcccccagatagtaagtaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggctgtgttcacgctccaggagactccactaaacacccagcagggagagacacagcacatcagctgggaggtggagtgacttgggaagtgggcttgactgactgggagaggtgcacagatcctctgtgggtgggaggagggtggggcctctgctgctcaccagagggttccacagagggtgtcacacgtcagaaaaaagaaatggcttcgtttatcacttatatcaaactgattgcttctttctcttttgtttttctccttctgtttacaagattgttgacggtgagtggtttcgtttcctttttcactgggtttggagaggaaactggcataggtgagagccgcggtgctgcaggtcttgccagaccatccccaagggcttggagcgctccaagcaggaagatgccttcgcagatgctgtggtcagacccacacagccagtcccccttgtgcctgctgaagaaacttcaccactatcattgagcactgagctatagtcctttcttgtggcctaccagattttggagaaggctggtagctcacagcaggggttggggggtttctcctgggaagataagatagtggcctccagagctgggcagaaccttctgggttatagctgagcatggcagcagtttgtctctgggggtcccaggcagggaaggaagagggtcttaagaggcgtcaggatgggagtggtgaggatggtaagagtagagagcctccaacctgaaaatgtgacctcttaccttagaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggtaccaacgtgcccccagctctgctgccgccatgctaggatgtggggccagggcatgggaatacttttcagcaaatctgtgagcccttggccctggaagggcttgcccaagcctctacccagcatctggatacagttggaactgggtccagaactgagtccagctattcccactgtaaccagaggatgccaagcgctgacacagtgtgtgcagacagtcccagtggccccagacagggatcctggggctggtaggggcctgggggagggcagggtgactcaggttgtgtgcaccttctcatgttcaccctcccacatgcccttggggcagttggctttcctgaaagtctctcggatgcccgcgctaaggcagagtcaggaggccagggacgggactcttgtaggggataggggccactcacgtgacagggtataataaaatgtttgcgttgactgagaaactaacgtgaagcactgtgctcttaggccctcaggtactgtcagttgtcccatctgcatggacggatactcagaggtaagtaaaccaagctgtatcttccaggcttctggtttctaaacttcactgaaagaattggatgagacaggatcttccccctcggtgggattggacacccctactcacagtcatgcctgggccgtcacttattgcagatctgcctgtgaggggagaatgtgccagtttctccttggaccctacaactttcaccttcagcccctatactcctgtatgccctgagcttccgggtgcaaatgcgtcctccttttttgtgccccatcctggctctaactgaaagctgctagtgtttactggggtccctcataaccctcttgggctgtcacactgttgagatgccatggcccctgcctcctgctctccagctgagagagaccacagcagacacagttagctctccagacccctccctgttgtagcctggcccttgctttcctttaattagtcatcttaggcataggtgggtgggattctctggccccatggctgctctgggacaagggcaaactcggaggctcttctttttaatgccttctagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaaccaaatatcttttacacattcatttgctctttggaatcaatttcccccctttttgccaaggtgcggggttcttatctgcctcacgttgagtgtattttgcattggtgtgtgttcaggaagtttccatgtcctaaatccagcaagcatgtgagaggctgttcttggagcacagccacaagcccaagccctggagtccctaagagagcagagtctactctgagaggcaaggttgaccaaggagctgtctgctcagctcggccagtctctcagaggtgctgggggtgctgctctgagtgggatggactgagattgccctggaaaccttgcactgcagcacccccctttgcccctgaccacctagatacaaaatttgccctctgagtgggagtcagcactgggagtgcatggatatgccagccactgccacaggcgagcagtgccagcaaagccacaaggagggaatgggcttggcagtgtggccaagctctccctttgcctctgccctctgtacctatccagctgtccccagggactagaaaggctaacatgctggctgcctgggtcccaaaggcctaccatccagtgcagtttgcttaccatgctcctggcactgcacttttggctctgtgggcagtgagacagacatcatggaacatgtttacagaggagacagtcccccaggccactggaaaattgaaactgatgagggtggggtacgggaaaccaggagatccagcaggaagaagttgaagctgtccagaaagctctctctgaataagggctgctaagttgccatcttcaaggtccagaaagctctctagggaaagaggaaagaattccagagaccccaggccaggcctgtgaaagttatgagaaagagcttcttgctggcatacagtagggtctgcaggctccccgatacctaaaggcattggaccagacacttctggtggctacccagggcctggcagttctttaccccaggagcaagcctaggggaggcagggagcagtgtatccctaagactggtactgctggagtgggtctggtcctggaaaggagggagcccccaaggctggctatagaaactcaaaagatgtctgtattaactttttcggtgggggggtggttttgttttgttttggcagcatagaaacaattgattctctatattgtgtatccagaatccttgctatttttttttttttcctaagacggagtctggctctgtcgcccaggctggagtgcagtggctcgatctcagctcactgcaacctccgcctcccaggttcaagcgattctcctgcctcagccacccaaccagctgggattacagggacgtgccaccatgtccagctaatttttgtagttttcgtagatacgggctttcaccatgttggccaggctggtctcaaactcctgatctcaagtgatccgcccgcctcggcctcccaaagtgttgggattacaggcgtgagtcaccactcccagccccaactctattttttttttcttttttctttttttctatttttgtagagacgggggtctcatcacgttgcccatcctggtctttaactcctcgcctcaggcgatactcctacctcagcctcccaaaggtgctggaattaaaagtgtgcgccaccgcgcccagcctagcccagtacattattattacacacaaatggtgtttgtgttttagtgtttcatcaagaaagatgtttgctgtaggttctagttagataactgtcagatgagggaggttcattttcctaccatgagataagcatttatctttttttttttttttttgagacggagtttcactcatcgcccaggctggagtgcagtggtgcaatctctgctcactgcagtctccgcctcctgggttcaagcaattctccagcctcagcctcccgagtagctgggattacaggcatgcaccaccatgcccggctaatttttgtatttttagtagaaacgggattttaccatgttggccaggctgccctcaaactcctgacctcaggtgatccgcctgcctcggcctcctcaaaagtgctgggattacaggcatgagccatgacacctagtggcatttgtcttcaatttctgttttttgtttttgtttttttttaacgagacagattcttgctctgttgccaaggctggagtgcagtggcacaatctcggcttactgcaacctccacctcggggttcaagcgattctcctgcctcagcctcctgagtagctaggcatgcaccagcacgcctggctagtttttgtatttttagtagagacagggtttctctatttttgtttttggtcacaagtgaatgttcaatcttaccagtcctttttctgcttctattgagacaagatttgtttgcctctctaatcagttaatgtattgggtaacatagttatatgttgtttaactacagggatatgttctttttttttttttttttttttttttttttttttttttccagagacagattttcactctgtcacccaggctggaatgcagtggcatgatctcagctcactgcagccttcacctcccacatacaagcgattctcctgcctcagcctccagagtatagctaggattacaggtgtgcaccaccatgcccagctaattttttctgtttctagtagagacagagtttcaccatgttggccaggctggtctcgaactcctgactgcaagtgatccacccacctcagcctgccaaagtgctgggattacaagcgtgagccactgcgccccaccttacagggatatgttctgagaaatgtgttgttaagctgggctctgtggctcacgcctgtaatcccagcacttggggaggccgaggtgggtggatcacgaggtcaggagttcaagaccagcctggccaagatggtgaaacccgtctctactaaaaatacaaaagtagctgggtacggtggcaggcgcctgtaatcccagctacttgggaggctgaggcaggagaatctgttgaacctgggcagcagaggttgcagtgaggcaatattgcgccactgcactccagcctgagtgatagagtgagactccatctcaaaaaaaaaaaaaaaaagacaaaaagaaatgtattgttaggcaattctgctgttgtatgaacattgtacagtgtaatgtgtaattaaacctagattgcagagcctactacacatctaggctatgtgatatagcctactgctctgggctacaaacctgtacatgttactgtactgaatactgaaggcagttgtaacacgatggtaagtatttgtgtatctaaacatagaaaaggtacagaaaaggcagggcgtggtggctcatgcctgtattcccagcactttgggaggccaaggcaggcagatcacctgaggtcaggagttcgagaccagcctgaccaacatggagaaaccccatctctactaaaaatacaaaattagccaggcgtggcggcacatgcctgtaatcccagctactcaggaggttgaggcaggagaatcgcttgaatctaggaggcagaggttgcagtgagccgaaatcatgccattgcactccagcctgggcaacagagactccatctaaacaaaaaaagagaaaaaatggaggctgagtgcaggggctcacacctgtagtcccaacactttgagaggcagatgtgggaggatggcttgagctcaggagttcaagaccagcctgagccacatagtgagaccctgtctctattattattattattattatttttttttttttgagatggagtctcgctctgttgcccaggctggagtgcagtgggcgatcttggcttactgcaagctccacctcccaggttcacgccattctcctgcctcagcctcccaaatagctgggactacaggcgcccgccaccacacctggctaattttttgtatttttagtagagacggggtttcaccatgttagccaggatggtctcgatcttccgacctcgtgagccgcctgtctcggcctcccaaagtgctgggattacaggcgtgagccactgcgcccagccatgtctctattatttttaaaaaataacaattaaaaacaaaaaccgtgtacattagcctaagtctacacagggtcggggtcatcatcatcactgttttccacctcttcctcttgtcccaccagaaggtctgtagggccgataacacgtggagctctcatctgcggtgacggtgcctctggaatacctcctgaagaacctgtgagactgttttgcaattgacttcttttttttttttttttttttttttttggaacagcatcttgctttgtcacctgtgttggagtgtggtggcacaatcatggttcattgtcattgcagctttgacctcccgggctcaagtgatcctcccaccccagcctctcaagtagctgggactataggcaccaggcctagctaattttgtttatattttacagaggcaaggtctcactgtgttgcccacgctggtctcaaagcaatcctcctgtcttggcctccccaaagtgctgaaacacaggtgtgagccactgtgccaagcctaaccttttttttttttctttttttttttttttttaataatagaagggccgggtgcagtggctcacgcctgtaatcccagcactttcggaggccgaggcacgtggatcacctgaagtcaggagtttgagacctgcctggccaacatggtgaaaacccatctctactgaaaatacaaaaattagccaggtgtggtggtgcacacctgtaatcccagctactcgggaggctgaggcaggagaataggagaatagcttgaacccgggaggcaggggttgcaatgagccaagatcacaccactgcactccagcctgggcgacaagagcaaaaccccatctcaaaaaaaaaaaaaaaaaaaataataataataataataataataatagagtacaatcttaaaatataatgactaagccagtaacatagtcacttattaagtatgtactgcacataaattatatgtgctataactttatacaactggtggcaccgcatgtaacaatgtactacaacatgacagctaagctgtcactaggcaataggcatttttcagctccattatactcaacgggaccaccattgtgtatgtggtctgctgactaaggtctacagcagcacatgactgtatttgattttctagcagacactatacttgcatttctctgataacttcaccctattcatgatactttgtccttctatatgtttgtttgtttgtttttgttttgtttgtttgttttttttgagatggagtagctgggattacaagcacccgccaccatgcccggctaatttttgtattttcagtagaaacggggtttcaccatgttggccaggctactcttgaactcctgacctcagatgatctgctgtccttggcctcccaaagtgctgggcttacaggcgtgagccaccatgcctggtcactactgtacatttcaagacccccagtggatgcctgaaacctcagtaccaaattgtatatatattggttttttcttatacgtatgtacttacacatgataaagtttaatttacaaattaggcacagtaagaggttagcaactaataaaatattgtatatgtagtactttttttttttttttgagatggagtcttgctctgtcacccaggctggagtgcagtggcatgatctctgctcactgcaaactccgcctcctgggttccagcaattctcctgtctcagcctcctgagtagctgggattacaggcgtgcaccaccgtgcccggctaatttttgtatttatagtagagatagggttcaccatgttggtcaggctggtctcgaacccctgacctcgtgatccacctgcctcggcctcccaaagtgctaggattacaggcgtgagtcactgtgcccagcgcagtactttcttttccagtgttttgtgtgtgttttgtagagacagggtctcactatgttgcccaggctggtattgagctcctggcctccagcaatcctcctgaatatggtctgaaaatatttcattgtagtgtgtgctatgagtaactgtgttctcaaagcaaaaacatagaaagcggtgtactgctgtattatattttaagattcattaatgtttgtagttcatttttctcactgtatattattttattagatggatatgcttcaatttatccactatttgggtcatttaagttttggggctaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctacttgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagttttggggctaatagccaaaaaatgagcgttctgtgtgtctcttttggtgcagttttgctcgcatatctaatggatatatacttaaaagtgaaattactggactatagagtacgaacatactgaaaagctcacaaatatatggaaattaaatagaacacttaaccaatgggtcaaagaagaaatcacaagagaaattagaaaataccttgaaaagggtgaaaataaaaagaaaacataccaaaatttatgcagcagaagctctgctcaggggaatatttgtagatataaacaactacattaaaacatctcagccaggcgcggtggctcacgcctgtaatcccagcactttgggaggccaaggcgggcagatcacgaggtcaggagatcgagaccatcctggctaacatggtgaaaccccgtctctactaaaaatacaaaaaagttagccgggcatggtggtgagcgcctgtagtcccagctactccggaggctgaggcaggagaatggcgtgaacccaggaggtggagcttgcagtgagcctaggtcgtgccactgcactccagcttgggtgacagagcgagactccgtctcaaaaaaaaaaactcaaaccaatacataattgtataccttaagaaacaaacaaacaaaaaactaaataaaaagttagcagaaggaaggccataataaagattagagtcaagataggcccggcgcggtggctcacacctgtaatcccagcgttttgagaggcggaggcaggtggatcacctgaggtcaggagttcaagaccagtgtggccaatatggtgaaaccccatctctactaaaactacagaaattagctgggcgtggtgatgcacacctgtaatcctagctactagggaggctgaagcatgagaatcgcttgaacccgggaggtggaggttgcagtgacccaagatcacaccattgcactgtagcctgggcaacagagtgagactccatctctaaatacataaattggctgggcgtggtggctcacgcctgtaatcccagcactttgggaggccaaggtgggcagatcacctgaggtcaggattttgagaccagcctggccaacatggtgaaaccccgtctctactaaaaatacaaaaattagctgggcatggtggtgggtgcctgtaagcccagctacttgggagactgaggcagaagaatcgcttgaacctgggaggtggaggttgcagtgagccaagattgcaccattgcactccagcttgggtgacagagtgagactccatctcaaaaaaaatagataaagaaaccgggcggcatggtggctcacgcctgtaatcccagcactttggggggccgaggcaggcagatcatctgaggtcgggagttcaagaccagctcttgaccaacatggagaaaccccatctctactaaaaatacaaaattagccaggcgtggtggtacatgcctgtaatcccagctactcaggaaggctgaggtgggagaatcacttgaacccgggaggcagaggttgcggtgagctgagatcccgccactgcactccagcctgggcaactagagcaaaactcggtctcaaataaataaataaaagaaaaaattaaaaagttaaggatggctgggcacggtagctcacgcttgtgatcccagcactttgggaggccaaagcaggtggatcacaagatcaggagacccagatcatccaagtaacacagtgaaacaccatctgtactaaaaatacaaaaaattagctgggcgtggtggcgggcgcctgtagtcccagctacttgggagggtgaggcaggagactcgcttgaacctgggaggcagaggttgcagtgagccgagactgcagcactgcactcccgcctggcaacagagcgagacttcgtctcaaaaaaaaaaaaaaaaaaagttaaggataggacatgactaccgactttacagaagtaaggattatcacacactactgtgagcaactgtttgccaaaaaatgggataatatagatgaattcctagaaacacactaccaaaactgattcataaagaaacagaattaaatagtcctgcagcaagtgaaactgcaacaatcgaaaacttcccaacaaagaaaagcccaggaccagatgacttcactggtgaattattttttatttatttttttaattttttgagatggagtctcactctgtcccccaggctggagtgcagtggtgcaatctcagctcattgcaagctccgcctcccgggttcaagcgattctactgcctcagcctcccaagtagctgggactacaggtgcccgccactatgcctggctaattttttttttttttgtatttttagtagagacggggtttcaccgtgttagccaggatggtctcgatctcctgacctcgtgatccacccacctcagcctcccaaagtgctggaattacaggcgtgagccactgcgcccggccttttttttttttttttttttgagatggagtctcactttgtcacccacgctggagtgcagtggcacgatctcggctcactgcaacctccgcctcccaggttcaagcaattctccagcctcagcctcccgagtagctgggattacaggcgcccaccactacgcccagctaattgtttgtatttttagtacagacgaggtttcatcatgttggtcaggctggtctcaaactcctgacctcatgatttgcccaactcggcctcccaaagtgctgggatttttttttcttttttctttttcttttttttgacagagttttgctattgttgcccaggctggagtgcaatggcgtgatctcggctaactgcaacctctgcctcccaggttcaagtgattctcctgcctcagcctcccgagtagctgggactacaggcacctgccaccatgcccggctaattttttgtatttttagtagagatggggtttcaccatgttagccaggatggtctcaatctcctgacctcgtgatctacccacctcagcctcccaaagtgctgggattgcaggcatgagccactgcacccgaccttcactggtgaattctaacaaacgtaaaagaaaataaagactaatctttctgaggccaggcacggtggctcatgcctgtaattccagcactttaggaggccaaggcaggcggatcacctgaggtcaggagttcgagacaaaccttgctgaggtggtaaaaacccatcattactaaaagcacaaaaattagccaagaacagtggtgggcgcctgtaatcccaggtactcaggaggctgaaaccggagaatcgcttgaacctgggaggcggaggttgcagtaagccgagatcgtgccattgcactccagctggggtgacaagagcaaaactctgtctcaaaaaaaaaaaaaaaaaaaaaaaaaaggccaggcgtggtggctcacgcctgtaatcccagcactttgggaggccaaggcaggtggatcacgaggtcaggagatagagaccatcctggctaacacggtgaaatcctgtctctactaaaaaaaaaattagcagggcgtggtggcaggcgcctgtagtcccagctattcaggaggctgaggcaggagaatggcatggaggcaggagaatggcatgaactcaggaggcggagcttgcagtgagccgagattgcgccactgcactccagcctgggcgacagggcgagactccgtctcaacaacaacaaaaaaaagactaatctttctcaaacttcattgtaaaatgaacgggaaagaaaactttctcactcattttgtgaggtcaatagtaccctaatactgaagccacctaaagacgttgcaagaaaataaaactgcagaactggccaggcgcggtggctcacgcctgtaatcctaccactttgggaggctgaggcagatggattacctgaggtcaggagttcgagaccagcctggccaatgtggtgaagaaaccctgtctctactaaaaatataaaacttagctgggcgtggtggtgggtgcctataatcccagctactcgagaggctgaggcaggagaatcgcttgaactcaggaggcagcagttgcagtgagctgagatcacgccattgcactccagcctgggtaacaagagtgaaactctgtctcaaaaaaaaattgtagaacaatgtattttattaatatagatgcaaaaatcctaaacaaaacaccttttcatgataaaaacccaagtgcagaagaaaactatctcaacattataagggccatattaaaaggccacatttcgccaggcgtggtggctgatgcctgtaatcccagcctcagcctttgggaggcctaggcgggtggatcacttaaggtcaggagttcgagaccagcctggccgagaaggtgaaaccccatctcaccgtgtgtacaaacactcattttgtatttctaaaactataaaaattagccgggcatggtggtgcacgcatgtagtcccagttacttgggaggctgacgcaggagaatggcttgaattaaggaggcagaggttgcagtgagctgagatcatgccactgcgctccagcctgggcgacagagtgagattctgtctaaaaaaaaaaaaaaaagaaacccacattaatattatattcagtggtgaaagactgaaagcttgaaagcttgtcaccttagatccagaaacaagacaagaacgcttgctgttgccgcttctactgaaccaaatactggaagttctagtcagagcaattaagcaagaaagaaacaggctgcatccaaattggaagtgaagaagtagaactatctctgttcacaaatgacatattatatatagaaaaccggccaggcatgggggctcacgcctgtaatcccagcattttgggaggcccaggtgggcggatcacttgaggtcagaattttgagaccagcctgaccaacatggtgaaaccctgtctctactaaaaatacaaaaattagccgggcatggtggcgggcacctgtaatcccagctacctgggaggctgaggcaggagaattgctggaacccgggaggcggaggctgcagtgagccaagattgcgccactgcactccagcttgggtgacagagcgagacgccatcttaaaaaaaaaaaaaagaagaagaaaagaaataaaaagaacttgtgtatcaaaggatgctatcaagagtaaatggcatatttgcacataatttacaaaataaaattttttaaatatgaaaagacaacctgcaggatgggagaacatttgcaagtcatctgatattggattaatactcagaatatataaagtactacaactcaacaacagaaacagacaacctgccaggtgcggtggctcacgcctgtaatcccagcactttgggaggctgagccgggtggatcacgaggttaggagtttgagaccacgctggctaacatggtgaaaccccgtctctactaaaaatacaaaaaattagccgggcgtggtggtgggcgcctgtagtcccagctactcgggaggcggaggcaggagaatggcgtgaacctggaaggcggagcttgcagtgagccaagatcgcgccactgcactccagcctgggcaacagagcaagattccatctcaaaaaacaaacaaacaaacaaaaaaaccacagacaacccaatttgaaaatggacaaaggacttaaatagatatttctccaaagaaggtatataaatggcctacgtactccaggggttcacatgggaagattgcttgagcccagggggtcaaggctgctgtgagccatgaacggtgccactgcattccaacctgaatgacagagcaagacgctctctctaaaaaacaataaatgaaaaatttaaacagtagaggttaccacagcctgagggtagggggaatgtaaagttactgtttaatggctacagaatttctgtctgagatgataaaaaaaagttctgaaaatagtggtaaaagttgcccaacattctgaatatagataatgccacggagttgtacacttaatgattaaaatagtcagttttggctgggcacgatggctcatgcctgaaatgccagcactttggagggctgaggtgggtggatcacaaggtcaggagatagagaccagcctggccaacatggtgaaaccctgtctctactaaaactacaaaaattagggaggccgaagcgggcggatcacctgaggtcaggagttcaaaaccagcctgactaacatgaggaaaccccgtatctaccaaaaatacaaaattagccgggcgtggtggtgcatgcctgtaatcccagctacacgggaggctgaggtaggagaattgcttgaactcaggaggtgaaggttgcggtgagccaagatcacgccattgcactccagcctgtggcaacaagagcgaaacaccatctcaacaaaaaaaaaagaaagaaaaagaaaaagccaggcactgtggctcacacctgtaatcccagcactttgggaggccaaggtgggtggatcacgagctcaggagatcgagaccatcttagttaatgcggtgaaatcccatctctactaaaaatacaaaaacttagccaggcatggtggcacgagcctgtagtcccagctacttggcagactgtggtggcgtgcacctgtaatcccagctgctagggaggctgaggcaggagaatcgcttgaatccgggaggcggaggttgcagtgagtagagattgcgctgctgcactgcagtgtgggcaacagaggaagcctccagctcaaaaaaaaaaaaaagttttggctcgatgtggtggctcacacctgtaatcccagcactttgggaggccgaagcgggcggatcacctgaggtcaggaatttgagaccagcctggccaacatggtgaaacccggtctctgctaaaaatacaaaaattagccgggcgtggtggcaggtgcctgtaatcccagctacttgggaggctgaggcaggagaattgcttgaacccaggaggtggaggttgcagtgagctgagatcgcaccattgcactccagcctgggggacaagagtgagacttcgtctcaaaaagaaaaaaagtaagttttgtattatacatattttatagcaatttctttttttttcttttttttttttagacggtttctcactctgttgccaggctggagtgcagtggcttgatcttggctcactgcaacctccacctcccaggttcaagtgattctcctgcctcagccttctgagtagctgggactacaggtgcgcgccaccatatccagctaattttttgtatttttagtagagacggggtttcaccatgttggccaggatggtctctatctcttgaccttgtgatctgccagcctcagcctcccaaagtgctggaattacaggtgtcagccactgtacctggccaacaatttcttaaaatgcaaaactaaacaaaaggagagtttagcataaaataatatgaaatacataggaataagtctgacaaaagatgtgtcaggcaagtacactaaacctcaaaacattgctaagactaaataaatgtatataaatatagctcacgaactggaagatgcaataatgtttagatatcactatctacaaattcatctgtacattaccacaatctttgttaaaattgaccagatttttttaaagaaattgacaagctgattctcaaattcacatgaaattcacaggaatttcatatgaatatgaatatgcaaaacaacattggaaagaatagtctggatgaagtggctcacgcctgcaatcccagcactttgggaggccatagcagaggatcacttgagcccaggagttcgtgaccagcttgggcaacatagtgagaccccatctctacaaaaataaaaataaaaaaatagctgggcatagtgataggtgcctgtggtcccagctactcagaaggctgagatgggagggtcacttgagcctgggaggtccaggctgcagtaagctgtgattgagccactgcactccagcctgggtggtagagtgagatcccatttcaaaataaacaataaaataataaagttggaccgggtgcagtggctcacgcctgtaataccagcactttgggaggccgaggccggcggatcacaaggtcaggagatcgagaccatcctggctaacagagtgaaaccccgtctctactaaaaatacaaaaaaattagccaggtgcggtggcaggcacctgtagtcccagctactcgggaggctgaggcaggagaacggcatgaacctgggaggcagagctggcagtgagccgagatagcgccactgcactctagcctggacgacagagcgagactccatctcaagaaaaaaaaaaaaaaaaaggctcatgcctgtaattccagcactttgggaggccgaggtgggtggatcacgaggtcaggagttgaagaccagcctggccaagacagtgaaaccccatctctactaaaaatacaaaaaaattagcctggtgtggtggcaggtgcctgtaatcccagctactcagaaggctgaggcaagagaatcccttgaacccaggtggcagaggttgcagtgagctgagattgtgccattgcactccagctgggtgacagagtgagactctttctcagaaaaaaaaaaaaaaggtaagcatatctcttccatatgaccactcttaggtgtttacttaagagaaatgaaaacgtgtttatatgatgacttgtacatgaatgttctggtgtttttgtttgtttgtttttcggtttttttaatttatgaatgttgatagtaactgtaataaccaaaaactggaaacaaccaaaatattcatcaacagataaatgtataaacaaactatgagacatccatgcagtggaataccactgagcaatgaaaaggaattttttttttttgagatggagtctcactctgtcgcccaggctggagtgccgtggtgcgctctcggctctctgcaacctccgcgtcctgggttcaagcgattctcctgcctcagcctcccaagtagctgagactacaggcgcctgccaccacacctggctaaatttttgtatttttagtagagacggggtttcaccatgttggccaggatggtcttgatctcctgacctcatgatccgcccacctcagcctcccaaagtgttgggattacaggcgtgagccactgtgcctggccaaagaatgcattattttaaaaacgtttttgttatataaattctttttattttgcccttattatgtttcattgacatataattgtacatatttatgaagtacagtgtgataatttgatacatgtatagaatgtgtaatgatcagagtagcatatccatcaccacaaacatttattatttccttgtgttgcgaacattcataatctactcttctgcctatttgaaaatatacagtaaatttttgttaattacagtcaccctatagtgccagccatagaacactaaactcatttcttttacaaagctgtactgttttttttttttttttttttgagacagagtcttgctctcttgggcaggctatagtggcacaatctcagctcactgcaaccttcatatcccaggctcaagtggttctcctgcctcagcctcccaagtagctgggagtacaggcgtgtgccaccatgtccaggtaattttcgtatttttagtagagacggggtttcaccatgttggccaggctggtctcaaactcctgacctcaggtgatccgcccgcctcggtctccctaagtgctggattacaggagtgagccaaggcgcccagcctcaagctgtacttttgtatccattaaccaacctttggctatctccctctccccactactcttccctacctctagaaaccactattctaagctgggcacagtggctcacgcctgtaatcccagcactttgggaagcctaggcaggcggatcacaaggtcagtagttcgagatcagcctggccaacatggtgaaaccctgtctgtactaaaaacttagccggacatggtggtgcacctgtaatcccggctatttgggaggcagaggtgggagaattgcttggacctgggaggcagaggctgcagtgagccgagatcatgccctgcactctatcctgggcaacagagtgagaccctgactcaaaaaaaacaaaaacaaaaacaaaaacaaaaattacccaggtgtaggccaggcgcggtggcccacgcctgtaatcccagcactttgggaggtcgaggcaggcgggtcacgaggtcaggagatcgagaccatcctggctaacatggtgaaaccccgtctctactaaaaatacaaaaaatgagccgggcatggtggcgggcgcctgtagtcccagatactcaggaggctgaggcaggagaatggcgtgaacctggtaggcggagcttgcagtgagccgagatcgcgccactgcactccagcctgagcgacagagcgagactccatctcaaaaaaaaaaaaaaaaaaaattacccaggtgtggtggcgcgtgcctgtagtcccagctagttgagaggctgaggcgaagaatcacttgaacccaggaggcggggaggttgcagtgagccaagatcaggccattgcactcctgcctgggcaacaaaagcaaaactctgtctcaaaatacataaataaataaacaaaaaataaagaaatcactgttctactctcttacttctatgagatcaactttttcttttttttgcttgcttgcttttttgagacagttttgctcttgtcatccagattggagtgcagtgggatgatctcagctcactgcaacctccgcctcccgggctcaagtgattctcctgtttcagcctcctgagtagctgggattataagtgcccgccaccgtgcctggctaatttttgtagctttagtagagacggggtttcaccacgttggccaggcttgtcttgaactcctgacctcaagtgatccacctgcctcaccctcccaaagtgctgggattacaggtgtgagccaccgcacccagccaagataaacttttttagcttgcacacatgagtgataaagtggtacttatctggccaggcccagtggctcacgcctgtaatcccagcactttgggaggccaaggcgggtggatcaagaggtcaggagttcgagaccagcctgatcaacatagtgaaagccccatctctaataaaaatacaaaaaaaattagccgggcatggtggcggctgcctatagtcccagctactcgagaagctgaggcaggagaatggcgtgaacccgggaggcggaggttgcagtgagccacgtcgcgccacttcactgcagcctgagtgacagagcaagactctgtctcaaaaataaataaataaaataaaaataaaaaaaataaagtggtacttatctttctgtgcctggctttttcacatcacataatgtcctgcaagctcatctatgttgcagcaaatgacagaaatctgggggttttaatggctaaatagcattccaaaaaattgtgctcccttgtgtatatagcattttatcagttcatctgtttttttttttttttttttgaggcagagtctcactcgatcttggctcactgcaaccaccaccttccaggttcaagcaattttcccgcctctgcctcccaagtagctgggattataggtgcttgccaccacgcccggctaatttttgtatttttagtagagatggggtttctccatgttggccaggctggtcccaaactcctgacctcaggtgattcgcccacctcggcctcccaaagtgctaggattacaggcatgagccaccaggcccggcctgtcattatttttattcttttctttctttcgttttgttttgagtttttgagacggagtctcgctctgtggcccaggctggagtgcagtggcttgatctgggctcaccgaaagctccgcctcccaggttcacgccattctcctgcctcagcctcctgagtagctgggactacaggcatccgccaccaggcccggctaattttttgtattttcagtagagacggggtttcaccgtgttagccaggatggtctcaatctcctgacctcatgacccgccccacctcggcctcccaaagtgctgggattacaggcgagagccacactgtgcccggcctcttttttttttgacggagttttgctcgttgcccaagctggagtgcaatggcactatttcggctcactgcaacccttgcctcccgggttcaagcgattctcctgcctcagcctcccgagtagctgggattacaagtgtgtgccaccatgcccagctaatttttgtatttgtagtagagacggggtttcgctttgctggccaggctgtcttgaactcccggcctcaggtgatccgcccacctcggcctcccaaactgctgggattacaggcatgagccaaggcacccaggcctaatggtcattattgtcattcattgattcagcaaatagtagagtgctgggtgctcagcctcttgctttgcagtagcttgggtgtcagaggtgtgtgaggcaggcattctcaggttctctcctgcccaataaaaccttttgtctttggggatactggtgacatcatgaatcccaatcctgtgcaatgtgctatgacaaaggaaaggacaggggttgaggcaaggggcagggacagcctatgacactgaaaaagaggccagaaacgcattcctacccgctctctcaaaatccatgttcagtggcaggatcatccaagaccctgatggggcggggggccttttttcgtctaggatggtatctgaatggctttaagggtagctttcttctgatcacatgagatttctgcttgtgtcatgaagaatgggtcagaggatcaggaggctgtggctgcagctggggcgggttgcggggacccaggacgaacagtagagctcggttaacgctgcaaggggagcctggcaggccgtacatcccaatgccaagcccgccgcctctcggcctgacaccaccggtggaaccaaaaaggggaaatcatgtcctttgtgcctctgtgtctgtggtaagcggggccctccagggggcggagccgccggcagggtccccccgtggcccgggtctcagggcagagctctgcctggggctcgcagatgtctgcaaggccgcggagggaggagggtccagacgcaagcccttatttctgatctggacgtctgcgagggtctgacccggctagtcgtccccgaggtgcgtgagtgcgagggtgtgggacacggccggatcgtcctagggccccgtggattagcaaggcaccgggaccactggagagggcttaacgggatagcagggagagggcgggctcgggaagagcaccctttaggcgaggggttctcggggaaccgaccggcgtgtcccagccccaggcccggtccaagattcgccggctccgccgctgcctccgcacccaggcggaccccaccgcaccgcgcccggctttccagcgctgcccgaacccccgcccagcccacgaggcagggattctgtggtcctcactgagtcatctggaccagaactagactagcccaaggtcaccgggcgttcctggcgaggccagggccgcgccgcgccgcccctggtgcatcccgggagccgcgccggtctgcggcacctgggcggcggacaggggcgcgggcgaggcgggcggggcgggcgggcagcggacaccggtcagagaggcggaactccctgccgccagccgtgtagtttgcctcgcgggcggcggcgcggcctcctgccggcctagccctacgcccgaccacaacgcccagaaggccgcgcggcgcgggcgggacctgcggcgacgagcgaggcggtgacatcaccgccgcatccagctccctggccccagctcctcccagcgcccgggccctcggcctcgcaaggcctgacgggaatcgtggtccacccccgggtacccccagctgctgcacgggcagcacggacttcagttcccggcgtgtcctgcgcgccgaggcacgttaacggcaggagggggtgggcaagcaaagggaaaagcagagccggggggcggagtaaggcggggtgggggtggggggtgggggcccacacccctccccctccccgctgctccttccccctcccccgacgtaaactgggatccctttccccttgtgtccgccatattggactctaactctggtcagccgcggcgccgggactgtggactcgcggttcctcccgcccagcggcctgccccgcagctcccgcccgccccagccctccccgacccggacgcgaccccgcgcagcgccccccggctggccggagcgcccgccgccgcggccgcctcagcctccccgccttccccgccctccgccgccgcccgcggcccccgcgcccgctctgcgcccctctccccgcccgccatgagcccagccgacgccaagcgcggggccaagcgccggaagaacaagcggggcggcggcggcggctcgggcgggggtaacggcggcgcgagcagcggcaaggccggcccggcggcggcgctgcgcggttcccaggccgcgggcctggcggccccgggcagcgcggcaggcctggtgggcggcgcggcggcggccaacgggcctctcggcgcgggcgcgagcgcgggcggcgccgcccccggaggctacttcgaggtaagcggcggcagcgggcaggggtcgatggcggtacgcggttgccgttccctcgcgccttggcggagctcggcctcccgctgtcggccccgggcctgggagcgggatgctgcgggcgggcggataacgggtcctgcggcgctgcgcttgccgaggtcccggggcagggcggcaggtgggccgtgctcggcgtgacgcggcctctgtcagcctcttgagaggagaacctgagcagaggcggcgggagggctacaccggggccgccgctcacggcgacgggctggtccgcaggctggagcagcccctcaacgggcggggacgtctccggggtgcagctccgcgcacggcgcttcgccttccgctggacccggcgggtgatacccgcgaggcccgggcttctgtcgtggcgcctcgcccgctgcggcggttccagagcgactgcgattccgggagtgagcaaagctgccctttcgctcccagggctttgaaatgtttctctggccaccttcgttattccgtgcgcgtgatgattgagaagggcctcccggaagttttcctttggtcctcctatgtggttatttgaaatctacctgacagccacctggagctggcagccctggcccctcctcccccgctttgttaagttttcaggggtatttagtggtttggttactcaggtatgtatttagggttcgaacttaaggaatttgaaaggtgatttttttcagttttgtttatgaagacagctagcacacattgcacctaccaattatggattcctgccacttttattcaaccgttggtcacaacatttcagagggtacactatttataagtgggtatgcaattggcgcagtcatttccagttatcccattgtctgctgaaagagaatagattttttttgaaaagttgcgttcttataatgttatttaaactcttaaattatgtagttttaaagatattgcaattaaaaaatgaaagaagcgttgggagtatttttgtgctaaatcatgacacaaattgttctttttttttttttcttttgagaacggagtctcgctctgtcgcccaggctggagtgcaataatggcgcgatcttggctcactgtaacctccgcctcccgggttcaagcgattctcctgcctcagcctctcgagtagctgggactacaggcatgcgccaccatgcccggctaatttttgtagagacagggtttcaccatgttggccaggctggtctcgaactcgtgatctcaggtgatccgcccaccttggcgtcccaaagtgctgggattacaggtgtgagccaccgcgcccggccgtttttattattattatattgttacattagggtcttgggctgtagtcctggacttcagtctcccgagattgccctcatccagtatcctggagatcaaaacaggccgcagttcttgggatcaaggatgagtcttgagcgtttggatctttggggtttttaagggcagtgtttgctgctgtcgggtaggggagggcggggggggtttgcctgtgcatatccttacacaaaatattgataatttttggtgtagctggatgtggaatatattcatttctattgattcaataaaaaccagttggtggcacaataaaattcttagttttagcctttcataccatttcaagttttaataatttacatttgctttgcaatacttaggtaaaatataactttattatttttatttatttttttttgagacagagtctcactctgtcgcccaggctggagtgcagtggtgcgatcttggcgcaccgtaacctctgtctcccgggttcaagcgattctcctgcctaaccctctcaagtagctgggactacaggtacctgccaccatgcctggctaattttttttgtatttttagtagagacagggattcactatgttgggcaggctggtcttgaagtcctgacctcctgatccacctgctttggcctctcaaagtcctggaattacaggcgtgagccaccgtgcccagccctgcctttattatttttgtcgcgttattcaaaatcagataactgtatgcctattattattaagatagggtcttgctatgttgcctaggctggccttgagcttgtgggctcaagggatccctctcatcttagttttactaattactaagggcacagacccttgccactgtgcccacctgagtattatttttgacaggactgtgatattctgttaaactagtatgcatcagggttttgttgttttaaaagagacacggtctctctctgttgcataggctagagtacagttgcctggtcatagctcactgtaacctccaatttctgggctaagcagtccttccatgtagctaggcctctaggtatgtgccaccatgcctggctaatttgttcttttaatatagatacagggtctcactatgttacccaggcttgtcttgaactcttgacctcaagtgatcctcccatctctgcctcccaaagtgctgggattacaggcctgagccactgcacctggcctatcaaggtttttgaccatgacccactcttatgacccactccaagaaataaaatccgttaagatctaggaaacatacacataaacacaaaaatttcacaaaacattttagggccgggcaccgtggctcatgcctgtaattccagcacttcgggaggccgaggtgggtggatcacctgaggtcaggagttcgaaaccagcctggttgacagatgatgaaaccccagagatggtgaaaccccgtctctactaaaaatacaaaaattagccaggtgtggtggtatgcacttgtaatcccagctactcgggagactgaggcaggagaattgcttgaacctgggagatgtaggttgcagtgagctgagatctaaccattgcactactgcctgggcaacaagagtgaaactctgtctcaaaaaaaaaaaaaaaatcccatccttgttgacacggtgagacctcatctctgctaaaaatacaaaaaatggccgggcgcagtggctcacgcctgtaatcccagcactgtgggaggccgaggcaggcggatcacgaggtcaggagatcgagaccatcctggctaacacagtgaaacccgtctctagtaaaaatacaaaaaattagccgggcgtggtggcgggcacctgtagtcccagctactccggaggctgaggcaggagaatagtgtgaacctgggaggcggagcttgcagtgagccgagatggcgccactgcactccagcctgggcgacagagcgagactccgtctcaaaacaaacaaacaaacaaaccccaaaaaattagccaggcgtggtggcgggcgccctgtagtcccagctactccggaggctgaggcaggagaatggcatgaacccaggaggctgagcttgcagtgagccgagatggcgccactgcactccagcctgggtgacagagtgagactccgtctcaaaaaaacaaacgaacaaaaacgaaaaaacaggccgagtgcggtggctcacacctgtaatcccagcactttgggaggctgaggcaggtggatcacctgaggttaggagttccagaccagcctggccaatgtgatgaaaccccatctctactaaaaatacaaagaatagccgggaatagtggtggatgcctgtaatcccagctactccggacgctgaggctggagaatcacttgaacctgggagacggaggttgcagtgagcccagatcacatcactacactctagcctgggcgacagtgcaagactgtgtctcaaaatccgtctcaaaaaaaaaaaaaaaagggcaggcgcagtggctgacacctataatcctagcactttgggaagccgaggcaggaggatcagctgaggtcaggagtttgagaccagcctgagaaacatggagaaaccctgtctctactaaaaatacaaaattaactgggtgtggtggcgcatgcctgtaatcctagctactcaggaggctgaggcaggagaatcgcttgaacctgggaggtggagattgtcatgccagctactctggaggctgaggcaggagaattgcttgaacctgggaggtggagattgtcatgagctgagattgtgccattgcactccagcctgggcaacaaaagcgaaactctgtctcaaaaaataacaaaaaacaaacaaaatattttaatacttttctgatcttttctgttccatgtaatctcattaataaaatctgggttatagtccacagaattagttcattgtgtacttttttttttttttttttgagacagagtctcgctctgtcaccaggctggagagcagtggcgtgatcttgactcactgcaacctccacctcctgggttcaagcgattctcctgcctcagcctcctgagtagctgggactacaggcgcgtgccaccacgcccagctaatttttgtatttttagtagagacagggtttcaccatgttggctaggatggtttctctttcttgaccttgtaatccacccaccttggcctcccaaagtgctgggattacgggtgtgacccactgcagcctctctattgtgtactattgagttgtgtgctgcaccttgacagttgcttttactgtattttaagcttttaaaatatgccaccatcttttatggtattttattttatttttgagacagagtcttgctctgtcgcccaggctggagtgcagtggcgccatctcggctcactgcaacttctgcctcctgagttcaagtgattcctcctgagttcaagtgattctcctgcctcagcctcccgagtagctgagactacaggagtgcaccaccacacctggcaaatttttttttttttttcaagacagagtctcactgcgtcaccccagctggcgtacagtggggtgatcttagctcactgcaacctccgcctcctgggttcaagtgattcttttgcctcagcctcctgagtagctgggattacaggcatgtgccaccacacttgggtaatttttgtatttttagtagagacggggcttcaccatgttggtctagaactcctgaccttgtgatccacatgccttggcctcccaaagtgctgggattacaggcgtgagcaaccacgcccggccattttttgtatttttagtagagacggggtttcaccttgttggccaagctggtctcgaactcctgacctcaagtgatctatctacctgcctgggcctccaaaagtgctggaattacaggcgtgagccactgcacctggccgatattttaagcttttaaagctgtctttagtttttaagtttctttgtaagtattttaataattgttcattaaagaaactctttatggtaactggggtaaaatattcttgacacagatcacagaaagtcttaatgtaattctgaagcctctgaattgtttccccacagatggtgagctttttggagtaccttgtatggtgcaaaatggcacccaaaacagtatcaaccagaaacagtgagtggtttctggccctatggttcccagggaggctttctgagtcctggcaagcagcctctacactccgtagtcaccaggccaggaggtggataagagagaaggccgagtggaaggactgtcttgattttcaggagtggtcacagtcccactgtcctgtgtgcgggacacagcactatgtgttatacccaggaccaccttcatcgaggtggctgctgagccaaagagggtgtttctgcatgtgggtagcttcaacaaaggaggaggaccatgggagaagtaggaaaacataacttagcttatagggtctttgactcaaaacagaattcttatacacaaagcttggggaaccacaaatttgttaggctctgttccatgggcaaggtatcaaccttgcgctacctcagttttcttttcttttttttttttaaatggagtctcgctctgtcacccaggctggagtgccctggcgcaatcttggctcactgcaacctccgcctcccgggttcaagtgattctcctgcctcagcctcccaggtcgctggggctactggtgtgtgccactatgcccagcttattttttgtatttttagtagagacagggtttcatcatgttagccaggatggtctcgatctcctgacctcgtgatgtacccgcctcggcctctcaaagtgctaggattacggtgtgagccactgcatttggccactaccttgggtttcttaatgatagggcaccacaggcttggtagctcatacctataatcccagcatttagggaggccagggtgggaggatcacttgagtccaggagtttgagatcagcctgggtgacgtggagagaccctccccgccactgctctacaaaaaattaaaataaaaattagccaccatagggaccgggcatagtggctcacgcctgtaatcttagcactttgggaggctgaggtgggcagatcacttgatgtcaggagtttgagaccagcctggccaacatggagaaaccccatctctactaaaaaatgcaaaaattagccaggcatggtgacgagcgcctgtaatctcagctactcaggaggctgagacatgagaatcgcctgaacccggggtggggggtgcagggctgaggttgcagtgagcagagatcacaccattgcacttcagcctgcacaaaagaatgagacattgtctcaaaaaaaaaaaaaaaaaaaaaaaaaaccaaaaaattagccaccatacagcgtatcctctgctttgatggtatgatcgttgtataaacatgctggtatgattattatggatctttggggtacatgagggtgcacttagaagccttccctgtattgtagaaattgcgaccacggtgaaattaggttatcattaactctagttcatatttgcctagtgacctgaggaaataggttgaagaaaaatgtagaacttcctgtgtcttaactaaaattaacaattttaacttttaaaagtttaaatggttaccatacacgctttagaaatggtgtacctgcagagagcatgtctgtgattcagtattttttctatgtgtacacctatgtaataaatatatcaagataaagaatataggttggcacagtggcccatagccatgatcccagcactttggaaggccgaggtgggagaatcacttgaggccaggagttcaggaccagcttgagctatgtagtgagactctgtctcaacaaaaaacttaattctaattagcctggccaggcgctgtggctcacacctgtaatcccagcactttgggaggccgaggtggaaggatcacgaggtcaggagtttgagcccagcctggccaacatggtaaaaccccattctctactaaaaatacaaaaaaattagctgggtgtggtggtgggcgcctgtaatcctagctactcgggaggctgaggcaggagaattgcttgaacccaggaggcagaggttgcagtgagcccagatcgggccactgcactccagactgggtgacagagcaagactctgtctctgaaagaaaaaaagaattagcctggtgtggtggtgtatacctgtaatcccagttatgtaggaggctcaggctagagaattgcttgagctcaggagtctgagggttacagtgagctgtggttgtaccacaacagcacttcaacctgggtgacagggagacctcatcttaaaaaaaaacaaaaaagactatagatagaacaattttccggatgttccctcatctccttcatggtcgtttctactactgatctcatctgtatcctttaaaaggattttgactttgaatttctttctttctttttttttttgagacggagtctccctctgtcacccaggctggagtgcagtggcgtgatctcggctcactgcaacctctgcctcctgggttcaagtgattctcctgcctcagcctcccgagtagctgggattacaggcatgcgccgccatgcccagctaattttcgtatttttagtagagatggggtttcaccatgttggccaggctggccttgaactcctgacctcaggtgatctgccagcctcagcctcccaaagtgctgggatttcaggcgtgagccaccacgccaggccctctctttgaatttcatagaacaagaatttttgtgctagggctctttggctcaacattatatttgagatgcatctgtgttgttgtcctagcagtggatcattttttttttcatggcatgtaaacttactgttgtgttaatattccacaattcatctcaccattctaatggacatttggattgttttatggctgctatgagtcaactgatgtgtctattcctttctgtacatgtgttttggtggacatgagcactcagttggtcatatggctgggggtagaattgctgggtgtacttcgatttgactttagtgggtactgcctgatagttttcctaaatggtactgttatatgctaatttttagaaattaacatgtagcaaaattgatactaattaaaaaaattttttgaaacagactctgactctgttgccttggctggaatgcagtgttatgacaatggctcattgtagcctcagcctgtcctgctcaagcagtgctcccacctcagcctcccaggtagctgggactacaggtgtgcaccaccatgcctggctaattaaaaaacaaaaatttaaggccaggtgcggtggctcacgcctgttatcccagcactttgggaggctgaggcgggcggattatgaggtcaggagtttgagaccagcctgaccaacatggtgaaatcgtgtctctactaaaaatacaaaaattagcggggtgtggtagcaggcgcctgtaatcatagctactcgggaggctgaggcaggagaattgcttgaacccaggaagcagaggttgcagtgagccgagattgtgccactgcactccagcctgggggacagagcaagactccgcctcaaaaaaaaaaaatttttttttttttgtaaagatggggtcccactgtgtttcccaagctgatctcaaactcctgggctcaagcagtcctcctaccttggcctcccaaagttttgggattacaggtgtaggctactgtcccagccaaaattgaatgtttaaaatgtgcattttgcatttgaattttaacaactgtagattcatatatctactaccacaatcaggatacagaacagtttaattgttcacaaaaactccctcatgttatagttacactctccccaactcctaaagtcttggcagccattactgtgttgcttggtatgattttatcttttggataagtcctgtaaatggactcatacagtccatttatgactgtgtagtcttttcaggaaggtttatttcactcagcataatgactttgagattcatccaagttgttgcatgtatcagtagcttgttcttttttactgctgtgtagtattctgttgtataaatgtaccacagtttgtccatttttccattggtggacattggggttgttttgaggttttggtgattataaatagagttgccataaacatgtctatacaggatttttgtgtgaaagtaaatttcaattttctaggtaaataccaaggagtaggagctggtcatatggtaacattatgtgaaaccgctgaactgttatccagagtggataataccattttgcctactcacgcaatgtctgagagttctggttgctctgcatccttgctagcacttgagattttcagtggtttttgtttacactattattattaatatttttttagtagagatggggttttgccatgttgcccaagctggtctcaaactcctgagctcaggcagtctactggtctggcctcccgaagtgctaggattacaggtataagccctggcctaaactgttttttaaaaaaccctttttgtgggctgggcgtggtggctcacgcctgtaattccagcacgttgggaggccgaggcaggcggatcactggaggtcaggagtttgagaccagcctggccaaggtggtgaaaccccgtctctactaaaaatacaaaaagtagctggttgcggtggcacacacctgtaattccagctactcgggaggttgagttgaggcaagagacttgcttgaacctgggaggtgaaggttgctatgagccaagatcacactactgcactccagcctgggcaacaagagcgagattcttgtctcaaaaaataataataacaataataataataattctttttgtggaaatggggtctcactatgttgcccaggctggtgtctatctccagggctccagcgatcctcccaccttggcttcccagtgttaggattacaggcgtgagccaccgcacccagcctaaaactagacagacagtttataattcctgaccttagtatgtgtgtgtgtgtgtctgtgtgtgtgtgtgtgtgtgtatgtattttttttttttggaagtggagtctcaccctttcgcccaggctggagtgcagtggcgcgatcttggctccctgcaacgtctgcctccttggttcaagcaattctcctgcctcagcctccccagtagctaggattacagatgtgcgtcaccacacctggctaattttgtagtttcagtagagatgggatttcaccatgttggccaggctggtctcgaactcttgaacttaagtgatctgcccaccttggcctcccaaagtgctggggttgcaggcgtgagccactgagcctggcctcttaatattttaataaataggtctgtagtggtatcatagttttaatttgcatctccctggtgcctaataatattaaacatgtttcctgtgtttatttgccattcctgtatcctcttgggagcagtgttttatcaagactttgcctattttttttttttttttttgagacaaagtcttgctcttgtccccaggctggagtgcagtggcacgatctcggctcactgctacctctgcctcctgggttcaagtgattctcctgcctcagcctcccgagtagctgggattacaggcgccttccaccatgcctgactaatttggtatttttagtagagatggggcttcaccatgttggccagactggtcttgaactcctgacctcagattatccgcccgcctcggcctcccaaagtactgggatttcaggggtgagccaccatgcccggcctactttgcctattttttgaaagttctccatgattctgaattcaaatcctttgtcatatataatttgccaacattttcttcaactgtgtagcttatctttttgttgagacagtgtctcattccgtcacccaggctggagtgtggtggcatgatctcggctcactgcagcctccgcctcccagattcaagtgattctcatgcctcagccttctgagtagctggagttatagggatgtgccaccgcgcctggctaatttttgtatttttagtagagatggggtttcaccatattggccatgctggtcttgaacttctgacctcaagtgatctaccggcctcagcctcccaaagtgctgggattataggtgtgagccaccggacccaacctgttaactggttttttgcagagaaaaaaaaatgtgaatgaagttccgtttaccaattttttcttttgtggatcatggttttggtgtcatttctaacatctctgttttagctcaaggttatgaagatttttttccttctatgttttcttctaaaaactttttagtttacttttttgttttttttgtttgtttgtttttggtcagacagagtctcattctgtcgcccaggctggagtgtagtggtgtgatctcgactcactgcaacctccgcctcccggtttaggtgattcttgtgcctcagcctcctgagtagctggaattaacaggcgtgtgccatcatgcctggctaatttttgtatatttagtagagatggtgtttcaccatgttggccatgctcgtcttgaactcctgaccttaagtgatgggcccacctcagcctcccaaagtgctgggatacaggtgtgagccactgcacccaggctgtaaaccggttttttgcagaggaaaaaatattaatgtgaatgaagttcagtttatcaatttttttctgtgtggatcatggttttggtgtcatttctaagatctccattttagctccaggttatgacgatttttttccctctatgttttctttttttctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgctcggctaattttttgtatttttagtagagacggggtttcaccgttttagccaggatggtctcgatctcctgacctcgtgatccgcccgcctcagcctcccaaagtgctgggattacaggcgtgagccaccgcgcccggccccctctgttttcttctaaaaattttatagttttacttttttgttttctttgagatggagtctcactctgtctcccaggctggggtgcagtgacaccatctcggctcactgcaacctctgcctcctgagttcaagtgatttttctgcctcaccctcccaagtagctgggactacaggcatgcaccactgcacctggctaattttttgtatttttagtaaagatgggatttcaccatattggccaggctgatctcgaactcctgacctcgtgatctgccctccttggcttcccaaagtgcggggattacaggcatgagccaccgcacctggcttttttttttttttttaattttaatttttgagacagagtgtcgctctgtggcccaagctgaagtttagtgccatgatttctgctcactgcaacctctgccacctgagttcatgtgattcttgtgcctcagcctcacaggttgctgagactgtggtggtgccaggtgtgcaccaccactcctggctaatttttgtacttttagtagagacggggtttcgtcacgttggccaggctgatctcgaactcctggcctctagtcatctacctgccttggcctctcaaagtgctggtattacaggcgtgagccaccacacccagcctagactgtttaagtcgtaggtgacattattgattttggatattgaaccagctttacattcctagaatgaacccctcttggtcgtttgtttgtttgtttgtttatttttgaggcagagtttcgctcttggtgcccaggctgcagtgtaatggcacgatcttggctcactgcaacctctgcctcccgggttcaagcgattctcctgccccagcctcccgagtagctgggattacaggcataagccaccacacccagctaattttgtatttttagtacagacggggtttctccatgttggtcaggctggtcttgaactcccaacctgaggtgatctgcccacctcggcctcccaaagtgctgggattacaggcatgagccaccacgcctgttggttgttttttttgtttttgttttttcaatttatatttttatttatttatttatttatttatttatttatttatttatttatttagagatgagtcttgctctgtctcccaggctggagtgcagtggcgccatctcggctcactgcaagctctgcctcccgggttcacgccattctcctgcctcagcctcccaagtagctgggactgcaggcgtccgccaccacacctgggtaattttttatatttttagtagagatggggtttcaccatgttagccaggatggtcttgatctcttgacctcgtgatccgcctgccttggcctcctaaagtgctgggatcacaggtgtaagccctgcctggtcatttattttttaattgctagacttaaattcactaaattttattaagcattattggtctgttttcatgagggatgtttgtcactagctttcttaaattgtttttgcctgattttggttttacaggttgaatatcccttatctcaaatgtttggaaccagaagtcttttggatttcagataatttcacatttgggaatatttgcattatgctgatttagcacaccaaatctgaaaatctgaaatcagaaatgttccagtgaatttttccattgagtgtcatgtcagtgctgaaaaagtttcagattttgaagcatttcagattttggatttttgcatttggaatgcttaatctgtagtattaatgctggcttcattaaagtaagatgggaattatttctttctctatgttagtatctgattttcaaggaattggttcatttcatctaagtatttgaatttatgtgtatagagttgtctgcagtattgctttattatccttttaatgtctgtgggagtctgtagtgatgtctgccctttcattcctgatattagtaacttgtttttaccttttattcttccttgccagtcttaatagaggtttcatcattttttaaacctttttgaagaaccagctgttggttttactgatttttctctgtttttccgttttcagtgtgtttgatttttttttttaaacactttgccttattatttgctttgggtttgttttttatttttatttttatgttttattttattttaagaggcagggtcttgtacggtctcctagtctggagtgctgtggcttgatcatagctcactgtaaccttgaactcctggactcaagggatccttccacctcagcctcctgagcggctgggactacaggtgcaagccatcatgtctgggtaaattttttttttttttttttttcgagacagagtcttgctctgtcgcccagcctggagtgcagtggctggatctcggctcactgcaagctccgcctcctgggtttacgccattctcctgcctcagcctccggagtagctgggactacaggtgcccaccaccacgcccgactaattttttgtatttttagtagagacggggtttcatcgtgttagctaggatgatctcgacctcctgacctcatgatccgcccgcctcggcctcccaaagtgctgggattacaggcgtgagccaccgcgcccggctgatttttttttggtattttttgtagagacggggttttgccatgttgctcacgctggtgtttaactcctgagtttaagcaatctgcccacctctgcctcccaaagtgctgggattataggcgtgagccaccgtgcctgggcttttctaatgtgaatatttaatgctataaacgtctctctgagccatacttaagctgtatcccacaaattttggtatgttgaactttcttttcttttctttttttttgagacggagtctcgctctgtccccatgctggagtgcagtgacacgatttctgctcactgcaagctccgcctcctgggttcatgccattctcctgcctcagcctcctgagtagctgggactacaggcgcccaccaccattcctggctaattttttgtatttttagtagagacggggtttcaccgtgttagccaggatggtcttgatctcatgacctcgggatccgcctgccttggcctcccagagtgctgggattacaggtgtgagccaccgcgcccggccacagaactttcttttttttttttttttttttgagacagtcttgttccatcgtccaggctggagtgcagtggtgcagtcttggctcactgcaacctctgcctcccagcctcaagcaattctcttgcctcagtctcttaagtagctgggattacaggcgcccgccaccatgctcagttaattttttgtattttagtggagtcagggttttgccatgttggtcaggctgttgtcaaactcctgatctcaagtgatccaccggcctcggtctcccagcgtgctgggattacgggcttgagccactgtgcctggccgaagtttcattttcattcagtttaaaacactttctagctgggtatggtgttgtatgctgtagctccagctactcagtaggctgaggcaggaggaccacttgagctcaggggttccaggctgtaatgcgcgatgataggacctgtgaatagccagccattgcactcaagctaggtccacatagcaagatcccgtctctaaaataattaagtaaagttctaatttcccttctttttgtttttttttttttttttgaggcggagtctcacactgtcgccaggttagagtgcagtggtgcgatttcggctcaccgcaacctctgcctcccgggttcaagagattctcctgcctcagccccctgagtagctgggactacaggcgcgcaccaccatgcctggctaatttttgtatttttagtagagatggggtttccccatgttggccaggttggtctccatctctttacctcgtgatctgcccgccttggccttccaaagtgctgggattacaggcgtgacttctcctttgacttacagtttatttagaagttggtatggtttggctatgttcccacccaaatcttgtcttgaattgtggctcccacaattctcgtgtgttgtgggagggacctggtggcaggtaattgaatcatgcatgtaggtctttcccgtgctgttctccgtgatggtaaataagtctcacgagatctgatggttctgtgagtgggagtttccctgggcaagctctctctttttgcctgccaccatccatgtaagacctgacttgttcctctttgccttccaccgtgattgtgaggcctccccaggcatgtggaactctttttaaacttttttttcccagtcttgggtatgtcttcatcagcagtgtgaaaatggattaatacagaagtgtgctgtttaattctgttatctctcccttttatttatttatttttttgagactaggtcttactctgtcacccaggctggagtgcagtggcacgatctcggctcactgcaacctctgcctcccgggttcaagtggttctcctgcctcagcctccctagtagctgggattacaggtgcccaccactgtgcccagctaagttttgtatttttagtagagacgggatttcaccacgttggccaggctggtcttgaactcctgacctcgtgatccaccccgctcagcctcccaaagtgctgggattacagtcttgaaaccaccgtgtccggccacctgtatctctctattactgaatttttgtctgatttttaccattgttaacatcagagatcattctttttatgattttaagtttttcaaaaaatttaaggttttatggtctgttttggtaaatgttacatatgaacttaaaaatgtatgtactactattattggatggtttctgaatgtcaattagatccagttggctgatagtttttttttggttgatggttttgttcgcttctgtattcttgctgagtttttgtctactagttcttttgattgctgaaagaggaatgttgaagtctctgcctaaaattgtagatttgttcacttttccttacagtttatttagcttttgcttcatgtatgtttgaagctgtgtttgatgcatatacatttaggattgttaggtcttggtgaattgaccctttgtcatttaagctgtatccctcatccttggtagtttgcttgtctctaaagtcgcttttgtctgatactactaatatagcctctccagctttctgctaattaatattggcatgttatattttttctatctttttgctttaaacctatctatattatttgaaatgaatttcctgtagatagctgcctgattattcttcattaattgtgcttattcatattttcatttttaattgtaatgtgtatgtgaaatatacttattggagaccttttttcctggcctaataactaatttaatatttatttggtgctattataggatgctgctttgcattgtatttgataaagttctctttactagactttttgaccttgtaggctttgtaaactgatttgctagattacatgaacatggtgacacaagccatcttcattttagagtttgaccagtatgagttcaaatcataggcctctatatgtcatgggcctgtataacatttattttgtttttactatggaagtaagttttagctgggctctatggctcacacctgtaatcccaataatttgggaggctagaggtaaatatataaatcccagaaccatctaaaaatctataacttggtgaccaaattctagataatattggggtccaaccgattttgaaaacttattatattttaatggaattaacagctgggtgcagtggtttacaaccataatcctaacactttgggaggccaaggcaggaggatcccttgagcccgggattttgagaccagcctgggcaacatagtgaaacactgttttttgtttgtttgttttttgtttttgagacagagtctcgctctgtcactcaggctggagtgcagtggcgcaatctcggctcgccgcaagctctgcctcccgggctcacgccgttctcctgcctcagcctccggagtagctgggactacaggcgcccaccaccacacccagagaattttttgtatttttagtagagacggggtttcaccgtgttagccgggtggtctcgatctcctgaccttgtgatccacctgcctcggcctcccaaagtgctgggattacaagcgtgagagacactgtttttttttttttgagatggaattttgcttttgttgcccaggctggagtgccatggcctgatctcggctccctgaacctccaggttcaggcgattcccctgtctcagcctcccgagtagctgggattacaggcatgtgccaccacgcctggataattttgtatgtttagtagaggtagggtttcaccatgttggtcgggctggtcttgaacgcctgatctcaggtgatccgtccgccttggcctcccaaagtgctgggattacaggcatgagccactgtgcccggccagtgagatactgtcctttttttgttgttgttgatggcgtctcgctctgttgccaggctggagtgcagtgacgcgatctcggctcgctgcaacctccacctcccgggttcaagcaattcccctgcctcagccttccgagtagctgggactacaggtacgcaccaccaaacctggctaattttttgtattttagtagagatggggtttcaccatgttggccaggatggtcttgatctcctgacctcatgatctgcctgccttggcctcccaaagtgctgggattacaggcgtgagccaccacgcccggctgagatactgtctttacaaaataaaagaagggagtcaggtgtggtagtgtgcacccacagttctagctactcaggaggctgatgtggggggatcacttgagcccgggaggtcgagactgcagtgagctgtgatcatgccacagcactcccgcctgagtgacagaacaagaccctgtctcaaaaaaggaaatgttttaatttctaaactaccttggagtaattccaataatgtttgtgggacagaattactgcttgttgttttcttgaggaaattgactttttcccttacgtaagttaatagagggtgatgtcaagtaaagaacattgttctcttgaatattttgagcaccatgttagatagagcttgaaactgaatgagaggttgtagaatctaattcttatggcacaggatttttaaaaataaactttttattttagaataattttagatttacagaaaagtcaccaagatagtacactggtcccccattacctgcaggggatccatcccaagacccctactggatgcctgaaattgcagataatactcaaccctaaaatatactatgtttttcctatatatagtacctttaccataggtaaagcttaatttgtaaattaggcacagtgagagattaacaacaataacagtaataggacaattatcacaatacattgtaataaaagttatgtgaatgtggtatctctctctcagaatatcttattatactgtgctcacctgtttttgaaccacagttgatcacaggtaactcaaaccactgagaagtgcagctgtggatgagggcgatgagggcatactattgagcctggagtttgtgcattctcttcagccagctctccctaatatggatattctagcgaaccttggtatatttgtcaaaactaagaaattagcattggtacaacattattaactacagattatttggatttttaaaatgtcctgtttctgttccaggatctaatccagtacaccacagtgcatttagcagcccagaattttcattctttttagttttctcacctatgaaatggtgaagctttttattttcttcaaaggattcctgagaagctaattaatattcagatttatagtatggtagtaatttcatgctcatgctaaaattcagtaaaatggttaacttttggctgggcacggtggctcacgcctgtaatctcagcactttgggaggctgggatggacggatcatgaggtcaggagatcaagaccatcctggctaacatggtgaaacactgtctctactaaaaatacaaaaaattagccaggtgtggtggtgcacgcctgtagtcccagctactcgggaggctgaggcagaagaatcgcttgaacccaggaggcagaagttgcagtgagccaagaacgtgccactgcactccagcctgggtgacagagtgagactccgtctcaaaaaaaaaaaaagttaaccatttaatagtgtactacaaggctgggcgctatggctcatgcctgtaatcccagcactttgggaggccgaggtgggtggatcagttgaggccaggagttcaagaccagtctggccaacacggtgaaaccccgtctctactaaaatatgaaagttagctgagtgtggtggcgcatgcctgtaatcttagctactgggaaggctgaagcaggagaatcgcttgaaccggggaggaggttgcagtgagcctagatcgtgctactgtatttcatcgtgtttgacagagcgagactgcatctcaaatgaaaaaaaaaaaaaaggaaagaaaaaaatagtgtactacaatctaattacttttcctaaaaatacttggtaattatttcacttaggtgaaagtagcccaccaaggcaaacattgtctacgagttactagttagagtacagtccctattgcccaggctggagtgcaattccgccgtcatagctcactgcagcctccaactcctaggctcaagagatcctcccacgtcaggctttcaagtacctgggactacaggcacgggccaccacacccagctaatcaaaatttttctgggggggatgagatcttgtatgttgcctagactggtctcaaactgttggcctcaagcaatcctcctgccttagcctcctgggtatttgggatgactgggatcacaggcgggagccactgtacctagctgtttctgtctttaaaagcacacaaaatcaggctgggtgcagtggctcacgcctgtaatcccagcacttcgtgaggccgaggtggacagatcacttgagggcagaggttcgagaccagcctggccaacatggtgaaaccccgtctctactaaaaatacaaaagttagctgttcatggtggcatgtacctgtaattccagctactcaggaggctaaggcaggagaattgcttgaacccagagggtggaagttgcatgaactgtgatcgtgccactgcactccagcctgggtgacacagtgagactccatctcaaacaaaaacagaaacaagaacagcataggaagacggctatagctattgttaatatttttccttcctttaaaagaataatgggagggtttggatcaatgatttcaattaaataccgctgcacaaactgaattgaactgttctttgtgtgtttgtacatttacagatgtccacacctgtattccactgggaatgctaagatggtcaaatcatagatgcatagaacttcagaactggaggggacaacgacagagcccctgtttattgccaagacagtatttgttagctgaggaaactgaggcccgaagacttgagtttgaaaaattcctctaattgttgtagtcggtgtcccctcacatacctttcaatttctgtggcttttgtcacttctcagtaccaactgagataaagaaaccaccttgctattctttttaaatttttatttatttcagagacagggtcttgctctgtcacccagtctggagtgtagtggcacaattatagctcattgtcaacttgacttcctgggctcaagcaatcctcccaccttggtctcccaaagtgctgggattacaggcgtgagccactttgcccagccctgtcctgctagtctggtcttccttactctcgccgtagtctactgcattttctcttctctgtgaacacactctgctgcttcctcctccctctggatgtcttccacctgcctttgtacgtgagcaccaggacgtcttgagctttctttgacggcccctctcttgttcctgccagactccggctgcacggacagctgagcgtccttgccgttcgcttccttttgccttgctgttccactgctgttgcggtgcctgttgggtgctgcggtgatcctgacctgcttgtgtagtgcggcctgcgtggcctgatcgggccgggtttttcttgcctctgcgcctttgtgcacgcttttcttttcttttcttttttccttttttttttgagatggagtttcactcttgttgcccaggctggagtgcagtggtgcgatcttggctcactgcaagctctgtctccctggttcaagcctgccgagtagctgggattacaggtgcctgccaccacacccagctaatcttttgtatgtttagtagagatggggtttcgccatgctggccaggctggtctcaaactcccgacctcaggtgatccacccgcctcggcctcccaaagtgttgggattacaggtgtgagccaccgcgcctggcctgtgcaggcttttctttccagtgagttcttctgtctttgcctgattcgcccctttctgagatggagaccatgcgctgtccccatgggaagcatttcttcaccgtccgaggccaggctgtaccttcccttctgagttcctgtggtgcctgtcctggctcggccacaccacttagactggattggaacatctaaactgcgctgtggcctgcttggcacatagtacataggcagaaacattgctcagggagccaggccatttgatgtgagcttctgcatttcttccctcttcacctttctttgggacgtcttttgtcttttgatttggaagaaagcatctatccatttttccaaagttaactgcgtgctccaggggttgttaactgatggtttttaatgagtctgttaattcatggaaactcagtgcagaatttatgtgtagtacgttatcttgaggcttctgcaaaacagctttgtcgtttctctcctgtgtcttgaatctttccacttctgttgggttattttcctttgtattcagattgtgtctttcttcccttcctcttcctcagtgtttttatttttagtttttgtggaggcaggagctcaccatgtttctcaggctggtctcgaactcctgggctcaagtgattcacctcacctgcctcagcctcccaaagtactgggattacaggcatgagctgctgcacctggctccctttgagcttttggcacatgactgtgatatccacctttctagaactttctttgccttcctgtgcatggcaccatgccattgtagttctcctcctgactcttgctttgcttactctccaggctttggtgaacttttatgtccttacaacaccttgctgtaggttattctatgttgagttcttcctctcaagttcacacttaatatgttaggcatatatgctggtagagatttcttttttcttttttgaacaggatctcgctctgttgcccaggctggagtgcagtggcgcagtctcagttcactgcagcctctgccttccgggttccaggcagttctcccatgtcagcctcctgagtagctgggagtacaggtgcgtacaaccatgcccggctaatttttatattttttggtagagacagagtttcaccatgttggccaggctgctctcaaactcctgcccttaagtgatgggcccgccttgatctcccaaagtgctgggattacaggcatgagccaccatgcctggctgcttgtagagatttctttttttttttttttttgagaccgagtctcactttgtcgcccaggctggagtgcagtggcgcaatctcggctcactgcaaccactgtctcccaggttcaggtgattctcctgcctcagcctgccgagtagctgggattacagctgcttgtcaccatacctggctaatttttgtatgtttagtacagacggggtttcaccgtgttggccaggctggtctcgaactcctgatctcaagtgatctgcctgcctcggcctcccaaagtgctgggattacaggcgtgagccaccgtacccggctgagatttctgatgacagaaactcaaatgggttatcagtaaccctctaacattgtggatatttattagaatgttgtttgaggccttttccccccatagctgtggcttgtgaactcaacttgtgtatgtttagatcaaactcttcttcccatattacaaaatagtgcttaggtattattggtttgtttgctaagtaacttatcaaaaggagttttgtctaaagatctcaggtcatctgtatgtggttgtgcactggacacagtttccacatctgtcaggtaagaagattgtgttagataatctcgaaggccttttataactttatgataattgtaattgtcactctttcggtcaaaagatttcagtgactaggccaggtgtagtggttcatccctataatcgcagcactttgggaggttgaggcaggaggattgcttgagcccaggagcttgagacaagcctgggcaacatagggagaccctcgtctctacaaaaaatatagaaaaaatcagctggctgcggtggtgcgtgcctgtagtcctagctacccaggagactgaggcagaaggatcgcttgagcttcggagttaaacactgcagtgagctgatggcaccactgcactacagcatggtggcaaagcgagaccctgcctttaagatcatttaaaatttcgacgactgctcttcacccctttcaagagtctcagaaactctaggatgtaaggagtgatgatcccttaggctgtaggaaaaacacattactacttatatttctaaataaggcattgaactttacaaaagtggcacccaccccccaacttgatctgcatttcctttttttgtttttttttttttagacggagtcttgctctgttgccaggctggagtgcaatggtgagatcttggctcaccgcaacctccgcctcccgggttcaagcgattctcgtgcctcatccttcccagtagctgggattacaggcgtccaccaccatgcccagctaatttttgtatttttagtagagacagggtttcaccttgttggccaggatggtctggaactcctgacctcatgatctgctcgccttggccttccaaagtgctgggattacaggcgtgagccaccacacctggcgatttgcatttctttctttcttttttttgtttttttgagacggagtcttgctctctcgcccaggctggagtgcagtggtgcaatcttagctcactgcaacctctgcctcccagattcaagcgattatcttgcctcagcctcccaagtaactgggattacaggcgcctgccaccatgcccagctaatttttgtatttttagtagagatgaggtttcaccatgttggccaggctggtcttgaactcctgacctcgtgatccgcctgcctctgcctcccaaagtgctgggattacaggcgtgagccactgcgcctggcctttgatctgcatttcagtcatgggtgagtcttaatctgttctgaggcaagagagacacttccaattcaggaatttgtatgcatgacacagctgtggaagccttggcatttaatgagcactcagtcagtacattcttgagttctgctaattttaattaaactggtcttcacaaaaacagagactgggcatggtggctcccacctataatcccagtacttttgggaggccgaggtgggaggattgcttgaggtcgggagttcaagaccaatctggtcatctctacaaaaaaaaacaaaaaaaaaaacctcccaaaaccaaaacaagtagtcttcaaagaaactctggatcagagataatgctaatagtgtgtgtggaacaacaaggacatttatggcagaaccaacacttccactttctgtgcaagctcttcattggccatgtatgaagtttaaaaaaatgatctcagcagaactgggaatcaaccctcaaagattatttgaaatctggatttacatccacttttattaatgacaagccatgcctgaagtgtttatcttgccttgagatgttagggaaggaaagtatatagagccttcacattcaccaaaatattttaagcattcataagagaaacatcacctataaattttcagctgtatttaaagtcatgcactacacaatctagtattttataaaattgtattaagctcagagaaactcctttttgagttttcttacttttatttctgtattgcttagggttcagatgcagaagcagctgtagttttcataggcaggcatttaatacggagaattagtagcatatggcatttaaaattatttattatatttgtttattttttgagacagggtgttgtctaggtgctggagtgcagtggcgtgatcatggctcactgcagcctcaaccacccaggctcaagtgattctttcatctcagcctcctgagtaggtgggaccataggcacctctaccaacctggctaattttttttttattttttgtagagacggggtctcactttgttgcccaggctggtctcaaactcctggggtcgagtaattctcctgccttggcctcaccaagtgctgggattacaggtgtgagccaccacccctggccaggagcatgtaactttttgaaaggtctagtggaaaaggctcttgtctgggcttccatgaatgacttccatcacaaaaggacagcattcagctgtggaggtggaggagccagtctgcacctctgccacaagtatctaatattggagacaaaatagccacctactatttgggaaaagtattttcgaacttttttgtactggaaaaagtgctatttttccaatagggggtgggggagtgagcagaatggcagaaataatacataggaaacaatatggcaacaaaagaaatatattattttgtcagcaaatatttttggagtattcatagaatcaattccaggagatttggaagagtaaatggttagaataaatgatggtgtgggggtttgctctgggatgatggaaacacttgtggttttttttgttcttgttttttatttttgagatagggactcactcttgtcgcccaggttggagggcagtggcaccatccgttgctcattgcagcctgaactcctgggctcaagagatcatcctgccccagagtagctgagactacagtcacatgccaccatgcctggttaattaaaaagaaattgcagagccaggggtcttgctgtgttacccaggctggtcttgaactcctggcctcaagttatcctcccaccatggcctcccaaagtactgggggagtataggagtgagccactgcacctggctacgtgggtatttttataggtgttagcctgtttttttttgatagattccagttgagtactcttttgatgagacgcaagcttgtggattctgaaatgatttcattagtaaacaaggttttgtgggaaaactggatatacacaatgatagagtagccttttttttttttttttttttttaaaagatgcagtctccctctgtcgccaggctggagtgcagtggtgcgatttcagtttactacatcctctgcctcccaggttcaagcaattctcctgcttcagcctccggagtagctgggactacaggcgtccaccaccacccggctaatttttgtatttttaatagagacaagttttcaccgtgttggccaggatgttctcgatctctggacttcgtgatctacctgcctcagcctcccagagtgctgggattacaggcgtgagccaccgtgctcagccagagtagccactttgtaataaaaaaaaaaaattcatgtagtccgtcaggtaagaaacaaaggtagaaagagattcttgggtagggcaggattgcagaaagagtaacatgagaaatgggttcaccacatgatgcatagggaactgcttacagcaaccagttgaagccagaagcactaatgggtcagcctgagacctttatagagtagtacatcttcacaatattttgtaatgacgggggagtaactgaaagtacttggcaagacacaggggtttgctggctatcttttggcaaaggtaaaagcattgcctattctgaaggtgaattgaatgtttttcttttacataaaggtaagtggtctaaatttacaaacctttgctgtaataagtggctgtcagtagaaagctatctagcaaatccagtatttttgagaaaaagaaacacgtaatctgtcccctcaaggtaaaggtgacattttaacaatgagtggaaaattgcttttttttttttttgagacggagtctcgctctgtcgcccagactggagtgcagtggcacaatcttggctgactgcaagctctgccttctgggttcacgccattctgctgcctcaacctgacgagtagctgggactacaggcgcccgccacctcgcccggctaattttttgtatttttagtagagatggggtttcaccgtgttagccagcatggtctcgatcttctgacctcgtgatctgcccaccttggcctcccaaagtgctgggattataggcgtgagccaccgcgcctggccaatggaaaattgctttttgatagaaggttgctgtgatgagcgttttgtaaatggacgtttaggccagttgcggtggctcacacctgtaatcccaacgctttgtgaggatgaggcggacggatcacttgaagtcagaagtttgagaccagcctggccaacatggtgaaaccctgtctctactaaaaacaaaaattagctggacgtggtggtgtgcgcctgtagtccccagctactcgggaggctgaggcaggagaatcacttgaacctgggaggcgaggttgcagtgagccaagatcacaccactgcattccagcctgggggacagagtgagactctgtctcaaaaaaagaaaatggatgtttagaattgtctccattgtgtgtgtgtgtatatttgctaagaataatgtaaatagtcattttactgcacacttaaacttggaaatgaaattttgcagcttgtttaaaagcttccttttgtaacaatagtgtcttgaacttattaaaaatacaaaaatgtgataccttctgattactatgtaagaacaaggaactctgatgaagaagatgtaaattgactagctgaatttctttttctttttttttttttttgagacggagtctcgctctgtcgcccaggctggaatgcagtggcacaatctcggctcactgcaagctccgcctcccaggttcacgccattctcctgcctcagcctcccgagtagccgggactacaggcgcccgccaccatgcccggctcatttttttttttttttgtatttttagtagagacggagttgcaccttgttagccaggatggtctcgatctcctgacctcgtgatccacccgcctttgcctcccaaagtgctgggattacaggcgtgagccaccacgcccggcctgagccaccacgcccggcctgactagctgaatttcaacagaaaccttgcataattgattgatgagattgaaaaccagttttcataatttagcaagtgcagccaatgatatacttctacttcgctatatgtatctttgagtgggacctttttcagcaaagactgccagtaaaactgactctctaaataattgaatttagagtactcctaagatctggttttaacacaaagtattcaaccaagatttttaaaataatgaggtacaatcatattgatctccataagtttttttgtcatgatttttggtgacacaacaagttttgtgttgttattaaaaagtatgtgagaagatgattttattttcatctcattgtatgtttttatattttgtgtatttttttaatgaacataaattacattcattaactgctgcagagtgccttctgcgttaccagtaggagttacagggtgatctcaaaagccgtgcaccttgtgccatgcccagatgaacaggcacggttgtgtagactcaggatatgtgtgctcaggccttactggccaggtgtccctgccgatgaagtctgctagtgactgaacagggacttcttgggcacctcaatcatctctccaggtgggtcccttcctcctttcttccattaccctgtgcctctgcaggggtgtggctgttgccctccagcacgtcctgttttcctgttggggtcatggcttctgccttcgcccttcagaagcctgttatctactacttctcgtctccatttcccaccccttcctcctggttctgcctctgagaatccttcagagctggcttgatgccgccttttctattccacttaccttccaaccacagcagcaacttctctagtgatactttacacctttgttttacctatacattgattatattttatgagattggatattttaaaaaatatgatgttagctgtgggcttgtaaaattttttttcaaaaagattggaagtttattgaatgcagaacaattttaaggcctagtacgttgttcatagccagtaagtgtttcttgactgaatcaagtaagatacagaattagggattttaaaaaattgtctaaaaatgttaatgtcagtggctggacatggtggtgcacacctgtagtaccagctgctcaggaggctgaggagggaggatcacctgagcccaggagttgcaggctacagtgagctgtgattgtgtcattgcacttcagcctgggcagcagcaagaccctgtctgtaaaaataaataaataattttaacatcatatttgggtctgtagaagttttctgccatgtgaatttagacagaggccagccaatttcgtctgattttcaaatgtacattctaagccagcattccccacagtgaggtgtgtgttgttaccaggtgtagtgaccaaagtataaagggaaaaaacgagaagcattccagtgaaaaaggaggagtgattatttggagaataataaatcttagtaacgattgcttgaatgtggctttttgtgtacaacacagttgattagaaatttagttacttctgattctagattatagaaggattctgttaagattgttcttttccttttcctttggcatggaacctcagaaggtacaggataaagactttagatcattctggatgtttaacactagtgtggttactcattcagatttcttttgttgttgttgttttgctttttttttttttttttttttgatcttgctctgttgcccaggctggagtgtaatggtatgatctcggctcactgcaacctctgcctcctgggttcaagcgattctcctgcctcagcctcctgagtaactgggactacaggtgtgcatcaccgcacctgggtaatttttttgtatattagtagagatgtggttttgccatgttggccaggctgatctcgaactcgtgagctcaggtaatccaccctggcctcccaaagtgctgggattacaggcatgagccactgcgcccggtccagattcttgtgtagagccagctgatcggaaacccacgtgaggggttgagaaagtgtcatggaaactctgttgctaacagtggtggaatataaccttccaaaaattggattttatttagcagtaatacaaaagcagcccaaaggtagtttatcgaatcctatttattttattgtcatatttaagcacagttgtgcagatgtgagtttggtgctatttgccatttttattattattaaaacaaattctttttgagacagggtcttctccgtcacccggtccggagtgcagtggccgatcatgactcactgcagcctcaatctcccaggctcaagctatcctcctgcctctgcctcccgagtagctgggaccacaggcatgcaccaccacacccggttaatttttaaaactttaaaaaatttttaaaagctggtcttgctgtgttgcccaggctggtcttgaactcctgggctcaagtgatcctcctgcctcggcctcccaaagtgttagaattatgattgtaatccactgcacccagctgctaattccattaaaataaaataagttttcataattggttggactccagtattacctggaatttggtcacaaagttacagatttttagattgttctgggatttatatatttatctctagaattttaggatggcaaattgttgagggggaccataatttgatttcgtctcattcagatgctcttgaagtttgaaccacactgttagggtcagatgctggataagtcaaatacatctggaggttttcacatctaataagttacagaaactgagagtatgacttttcttcacttttgggtatcttctgaaattgtgactgaactgctaaatagcccaaaagtacttcagaatccgggattctggacagtagtgaatgttcgtagtctccacatgccattagttaaactcattgggccggtttgaatctgtacttccttgaacaaatcatggtacccttatgtctccctgcagggttgaattcagtgtgttcagatatcttctgtttgtaagaaagcagtacattctatgagttactgtggatttggtaaccctaactctgaatctaagttcagagagtcattctgtgctaaagaagcaactctaaatcgctgcagtgagctttggtgacatggctcaggagatactgaaataaaccaaatctccttatgtttttttcctccatatatctttaacttttcccaaggttccatgaactgttaccctccttgcagaggtcatgccacatctttcgttataggacacagcagtaaagggccctctagcctgctctcttgactggaataatgggaactcatttctccccatcatagtgacacaggaaataagccttgccatgtctaggtgcaaggctgtgggcagtttaggagacagtgtctctgtagggggaccagttaccccatgggtacaggccttggtgagctcctcctcagatcagggctaggctagttttcaggccccactccccggcctgggagcttttgtgatttaggagaatgcgtatttactgcaagtctcactcacagatgggccttactcaggtggtcatgtatcctgggtagtaagtcaagcactttgagtaccgaacacacagggcctatttctcttctgccgtacacttcctcccctacctctgcctgttgtattcagggttcacacactcagtttcgcttacggagtgggtgggggtgtgggcagctgtctgtgctgtggctctctccctatgggggacttcgcagagcctctttcctgccttgtcaccttacccataggctctgctctttagtgactccctccgcggccccagcccttcctcctggcagcttccaatgatgtattactggcagtgttgctttgtctttagttcacatttcccgtaagtggaccaaattatgtttttatgacaggccttgttgtgggtcctgaagagaacagctgtattgtacaggctgccctgtaccccatggattaattatccattctgagccctggaggagagggcaggttctagagtaccaggcagatgtggcaccaccttgccagcagctcggagactggtacttgttggcacagtgaacttctgtttggttatgtataaaaaatttagatttgtactagggttttggaagtgaatggcttctgaggtagaagtcctattttatttaaagatgtctttgtggaaaagggttttgagaggtatgtgtagagtgaaattctagagcagaacttttttttttttgacacagagtttcgctctgtcctccaggctggagtgcagtggcatgatcttggctcactgcaaactctgcctccttggttcaagcgattctctcacctcagcttcccaagtagcgggattacaggagcgtgccaccaagcccagctaatttttgtatttttagtagagacagagtttcgccatgttggccaggctggtgttgaactcccgacctcaggtgatccaccggcctcagcctcccaaagagctgggattacaggtgtgagccacagcgctctgcctagaccagaactttttgtttactactttctaaatcttggtcaaaggccaggcgctgtggctcacgcctgtaatcccagcacttcgagaggctgaggctggtggatcatgaggtcaggagatcaagaccagcctggccaacatggtgaaaccccatctctactaaagatacaaaaaattagctgggcatggtggcatgtgcctgtaatcccagctacttaggaggctgaggcaggagaatcacttgaacccaggaggcggaggttgcagtgagccgagattacaccactgcagtccagcctgggcgacaaggccagcctctgtgtccaaaaaaaaaaaaaaaaaactgggtgtggttgtgtgtgccagtaatcccagctattggggaggctggggcaggagaatcgcttgaacctggcaggcagaggttgccgtgagccaagatcgcgccactggactgcagcctaggcgacagagtgagacttcatctcaaaaaaaaaaaaaaaagtccaaggtaacatttcaagttttctaataccgtttcccctgaaatgaggttgtgtacggtgcctaaatggaaaccagattgtctgaggttgtggccccacagtgctcgctgcagtggggacttgggcgttctccagtcttcctagggacactgtatgtcctcctgatttgtaaactgagagatggaaatgagattaaaggctgtagggtgagctgaggctgcagataggttggagttgtcagtcccaggtaagaggagccctgtgccacagcctggtgtgggaggcgacatgttgctggtagctggacatagaagaaggggcctagaggaagtgggggagctcacgtgggacctggagggctggggcgaggattttggtctttagattaagtgcagttgggaacagttgaagggctttgagcagaggaggaattttttttttttttttttttaaagacctggctgcagtgagaatagtggtttgctggataacaacggaaggcagatagaaggcttttctgtaatccaggtgagaggcgacagtggcgatgggggtgagagagagagatgggttgaacgtagcaggatcaaagctaattcttaggattctgacttcagaaatgatttcctctgcatagggaatactaaagaagggctagatttgaggaacagcttgtacattttgttatgtttctttattttgggtctcatgctcttgagttcttggttgactcagtgtcagataagcaggaatctcctttcttcttcttcctttttttcccgcctcactcttactcttgtgtctctccctctcctgaatgtgctctactctcagaggtttgtgtatctggacatgtgtgaatctgtgttttaagaagcccatgaggccaggtgcagtggctcacacctgtaatcccagcactttgggaggctgaggctggcagatcacctgaggtcaggagttcgagaccagcctggccaccatggtgaaacccgtctctactaaaaatgcaagaatcagccagtgcgtggtgacgggcacctgtaatcccagctactctggaggctggggcaggagaatcacttgaacccaggaggcggaggttgcagtgagctgagatcgtgccactgcattccagcctcagcgacagagtgaaactctgtcttcaaaaaaaaaaaaaaaaggtccgtgtgtggatgtgtgtttttattgccatgtgtgggacgtgggtccttctctgctttcaccactttgactgtctgctccgtggctgcggtccctcagtgctgctgcgccacccctcacttgtgcgtttgttccaggagtatctgctgggagcctacctgtcgggctctgttctagactccctactgcctggagctgactttccagctggggaggctgatggacaaagcctgtcccgtggcgggaagaggtagggaggggtggtcaggaaaggccttgccagtgtggtgatacttgaacaaggcctgagggagatgaggggtgcacccggctctttgttttatctgggggaagaagtttctagtcaaagggagacaaacagtacaaaggcctcgtctgggagcacccttaggtgtccaggtaacaaggagacctgtgaggctggagcagaatgagtcagagaggctcaggggacaaatatgaaagatttttattcaacaactttggtttttattgtgttatgaggggattgtgggagggtttttgcagaagagtggtattgtgtcagttctgaaagagatcctccagatgtctcgtgggtgtggggtaaaggctggagcaggaagaccagttagagatgtggtgtcagtgtggggtgtctgatgggggcatgtgctgcactctcttgacatgtgctgtggaacgtcgggagtggggcgaggggtctcttctgtggaacatggggagtggagcacaggtagagactgagagggccggcctgtctcacaccaaggctgctgcatttgctcaccttgtgttgtctttgcagtagacagtgcccaggcgtcctgtgctctcgttcactgctgctgcagatgccaccatacataaatttggcttgggacatgttgagttcagagtgcctttgagatatccaaggggatatgtgaattaggcaattgtactgtagacatttgacccctaaatccaacttctgggagtcgtgtgtattgacggtcatggatgtggttggcggaagaagagcatctagtggaaagtgactgagaagggagccctgaggatctctaatgctcagaagcaaaaccgtgctttccaggactgcagcctcttctgtagtatccacgtttatgtctaacctgccttaaataaatgtggagctgggggagggtaaataaatacttacatgcatggcatttttaaatgacatgaattaatcattttaaattaattaaaaagaaacatttaaaaattttatctttttagtgtttcttcaaaaacaacattaagtcattaattctggccttttggcgtattggaagcattgaaaagctgaatgaaatcaagaaaaagttctggagaatagaagcttccagccttttgggttcgtgacccgcctgtgggaaggaggcctgccatccctcccctctgttggctcacactcctctaacttcttcctcttcctctttctcccacacacaaatgcgtgccatgctcctctgcccaggccttgggttaaaggcagcactaggccttccaccaagagacatgagtgaatgatcaggccaggcagcagagtgcacagcaagcttcagggcgaaggtggccgcgacacttgccaagtgagatgtcagaggcctatgccccaagaaagcatagatcaggtcaggtgacgagacggtggaagagaatcccaggtggccgtggcagcatgtgcaaaagtgtggtacaccagggacttggacatggtgatcatggaaggtttgagaacaggaatagtggcgctcagtcagggccaggcttgaaggaggatcaggagcatggacttcatagggaaatcgttttgaagatgcagtttattaagcaaacaataatttgagtttttaaatgtgttgggtatttgttagatactgggatttttttttttttttttttgacgctgagtcttgttctgtcacccaggttggagtgcagtggcgcaatctcggctcgctgcaacctctgcttcccgggttcaagtgattctcctgccttagcctcctgagtagctgggattacaggcgcccaccactacacctagctaatttttgtatttttagtagagacggggattcaccatgttggccaggctggtcttgaactcctgacctcaggggatctgcctgcctcggcctcccaaagtgtgggattacagacgtgagccatcgcgcccggcgagatactgggattgtaacatttggaagaattatgctccctgcccttcacgagtacacaccatcgtccataaagatgggccctctgctcttcactggtggacactatcttccctaaatgttcttgtgtgttgcttgccatggtcaggttacaaggacatgtcacatggagtggtctctgccctcaggaggcttatgtctcaggtgagttagacaacaatgagggatgcaagtagcagcagtccaggaggtcagattccttatagttcttttggcactactgaatgatttaagcagtaataccgggtagctgtgccacatacccagttatttatttatttatttattttttgagatggagtcccacattgtcgcccgggctgcagtgcagtggcacgatctcggctcactgcaacctccacctcccaggttcaagtgattttccttgcctcagcctcccaagtagctgggattacaggtgccccccaccacgcctggctaattcttttgtaattttagtggagacggggtttcactatgttggccaggctggtcttgaactcctgacctcgtgatccgcctgcctcggcctcccagagtgtggggagtacaggtgtgagccactgtgcctggaacacccagttattaacattagagcgggatgcagtggcatgtacctataggtccagcttcagggggctgaggcaggaggatggcttgagcccaggggtttaaggctgtattgcacaatgattgtgcctgtgaatagccactgcaccccagtctgggtgacatagtgatacttgctcttgctctgcctctgtctcccaggctggagaacaatgatgctattgtgacagcctcttgagtagctgggattacaggtgtgcaccaccatgcctggtgagaccttatttcttagaggcaaacaaaatctatatatctaaacactggccaatgcttatcagacactgttctaaacatctatatatgtgtgtgcttctagtcctcaaagtgatttgaagtagtaggtgctgttgttaccccaattttatgctgtggtaataggcacagaaaggcaaaggccttgttcagcactttgggcttaaggggctcatggagatactgtagcagatacagaggcagcaggaatagagatgtacctattctctgaccagtctttgtagtttagagccagtaattgctgtaacatattcacaaagcagttttttgagattttcatttggttgcttggttttctcacaggtgttcgtcttctcaatgttaccttatctaaggttttagttgatatgaggactaaaacacctgaacttttttgagagtattatggggtccgtgtaatatttattccaggtagttattgttattactactttttttcttttttgagacgaagcctcgctctgtcacccaggtgacatatcataccttataagatatttttggtgttaaagcatttaattttcaacaccatgaagtaaaaacacattgttagtgcttgggactattgtgttccttggaagacccactaaactttctagacctggaaatttctttgtcgtcattggtctaggtttaatgtttcttgctaaatcaagtttgacaatctattcactcaattaaagtggttttttttttgttttttttttttttgagacagagtctcagtctgtcactcaagctggagtgcactggcacgatctcagctcactgcaacctctgcctcctgggttcaagcgattctactgcctcagcctcctgagtagctgcaattacaggcgcccgccaccacacccggctaattttttaatttttagtggaggtggagttttgccgtgttggccaggctggtcttgaactcctgacctcaagtgatccacctgcctgagcctcctgaagtgctgggattacaggtgtcagccaccacacctgacctctgattcattaacttctgttttaatatttagtaacaacttgttcccattctgtttagggcctttctgaattgatttctaatctcaagctgttcatttttttcttccctcaaaataatactagcaattagagctatgaactttaagtacaacattggccagacatctaaagttttgttatactgtataatcgttttcagttttgttgtttttctgaatctgttcattcaacaaacatccattagcacgtattatgtactggttactgtggtagctactgggaatataatgactatcccctattcctctcttcagatactaaatattcttaggactgtaattgtagatttattacttcttctgttttttgtttgcttttgagacagggtcttgctctatcacccagtgatgcagtgaagctcactgcagccttgacttcccgggcttaagcaattttcccacctcagcctccttgagtagctgagaccacaggcgcatgccaccctgcccattcctaataaagtactctgttacttataatatttttctgattttaatttgctacccgtgcattttttttgcattgcctgctttattttgcttgtgtttgaaatttcatcattttaataataaatagctgccattttgactaatgattactgtgcactagactctgtatcaagcacttgacataccgtatctcatttgattctgtggcaaccttcttggtaggttttttttttcccccctcaatcttccatttacaaaaaaggcaactgaggcttggaggggttaattcttgcttaagggtaaacagtgagtagttttcagtcattcttgtactgtctaagtacagttgacccttgaacgaaggggttagggatgctgaccccattgtggagtcagaaattcgcttatacctttcaactctccaaaaccttaactactaatagcctactgttgaccagaagtcttaccaatactataaacattcgatgaacaaatattttgcttcttatagatattatctactgtattcctacaataaagtaagctagagaaaataaaatgttatatttactatttattaagtggaagtggatcatgataaaggtcttcatcctcattctctttacattggctaggctgagagaggaggaggaggaggaggaggcggaagaggagaggttggtcttgctgtttcaggggtgtcagaggcagaggaggtagaggaaggcaggcacacagtgtaactttatttttgttgaggcagggtctcgctctgtcacccaggctggaatgcagtggcgtgatcacagtaaaagagatgggggtcttgcttttgttgcccagactggtcttgaactcctggcttcaagcaatcctcccatctcagcctcccaaagtgctgggattacaagtatgaatcaccactacgcctggccagcagtatacgttttaaattaatccagagcgtaccttcaaatgatatcatggctgggcgcggtggctcacgcctgtaatcccagcactttgggaggccgaggagggtggatcacttgaggtcaggagttcaagaccagcctggccaacatggtgaaaccccatctctactgaaaaatacaaaaaaaattagccaggtgtggtggtacgcgcctgtaatcctagcagttacaaagtgcaattaaaaataaggctggctggacgtggtggctcacacctgtaatcccagcactttgggaggctgaggcaggaggatcacttaaacccaggcgttggagaccaacctgggcaacataacaaggtcctttctctacaaaaaataaaaaatattagccagacataatggcactcgcctgtggtcccagttactcgggaggctgaggtggaaggattgcttaagcttggggagttgcagcggcagagaccagtgatcatgccactgtactccagcctaggtgacagagtgaggccctgtctcaaaaacaaaacaaaaaaaaacagtgaaaacattgatttttcagcagtgagaatggctgttattaaaaagttaaaaaataacagatggtggtgaggttgtagagaaaaaggaacgcttatacactgttggtgcgagtgtaaattagtttaaccattgtggaagatgatatggcaattccacaaagacctaaagtcagaaataccattcaacccagtaatcccattactgggtatatactcaaaggaatataaattgttgtgttacaaagacacatgcatgcgtgtgttcattgcagcactgttcacaatagcagagacatggaatcaacccaaatgcccatcaatgatagatagattgcataaagaaaacatggtacatatacaccatggaatactatgcagccataaaaaagaatgggatcctgttcagggacttggatggagctagaggccattatccttagcaaagtaacacagaaacagaaaaccagatactgctggttttctgcagattctcccttataagtgagaataagcagaacagaaaaccagataccgcatattctcgcttatagccgatgagaacacatggacacgtagaggggaacaacatacactgtggcctatcaaagggtggagggtgggaggagggagaggatcaggaaaaataacaagtgatggctactaagcttactacctgggtgaagaaataatcggtacaacaaacgcctgtgacacatgtttacctgtgtaacctgcacgtgctgcacatgtacccccaaatttaataaaaggaaatgtgacccccaccccccattttggagctagggtctgctgggaagtgttggatcatggaggtgggtcttcatgaatgacttcatgaatgtcctccccatggtaatgaatgagttcttgctctgttagttcacttgaaatctggttgttaaaaagagtctggggcctcccccctctatctctggctcctcactctcttgccatgtgatacatttgttccttctttgccttttgccatgagtaaaagcttcctgtggcctcactagaagtggagcagatgctggtgccatgcttgtatagcctacagaactgtaagccaaataaacctctgttctttataagttttttaaaacccactgatttggccgggctcacgcctgtaatcccagcactttgggaggccgaggcgggcagatcacaaggtcaggagatctagaccatcctggctaacacggtgaaaccccgtctctactaaaaatacaaaaaattagccgggtgtggtggcgggcacctgtagtcccagctactcgggaggctgaggcaggagaatggcgtgaacccgggaggcggaggttgcagtgagctgagattgcgccactgcactccaccctgggcgatagagcaagactccgtctcaaaaaacaacaacaaaaaaaaaaccactgatttattttattccatttttgggattgccatttcttttgtagatctaggttttgttctgataccatattctctcttcctgaaatattttctttctttctttttttttttttttggaggtggagtctcactctgtaacccaggctggaatgcaggggcacaatcttggctcactgcaacctccgcctcccaggtccaagtaattctcctgcctcagcctcccgagtagctgggattacaggtgcatgccaccacgcctggctgatttttttgtattttagtacagatggggtttcaccatgttgcccaggctgatctcgactcctgagctcaggcaatccgcctgtctgggcctcccaaagtgctgagattacaggcgtgagccaccatgcccagcttctgaaatacttcaacattttatgtgggttaggtatgctggcaataaatttcctgtttttgtttgagaaagtctttctcctttattttatttatttgtttttatttttttgagacggagtctcgctctgtcttgctccagcccgggctggagtgcagtggcgtgatctaggctcactgcaggctccgtttcctgggttcacaccattctcccgcctcagcctcccaagtagctgggactacaggcccccgccaccatgcacggctaattttttgtatttttagtagagacagggtttcgccatgttagccaggatggtctcagtctcctgacctcgtgatctgcctgcctcggcctcccaaagtgctgggattacaggcgtgagccaccgcacctggctcttctcctttacttttaaaagattctttttctgggtatggaagtcgtagttaaaagctgtttttttctttcaagattttagagaaattactctcttctggtttttatggcttctcacaagaatcctgctgtaattgtttttgttcttccatgtgtaatgtttcttttatcactagctgctttcagtctctcctctcctcctccagccccctttcttttcgagacaaggtcttgctcttttgcccaggctgaagtgcagtgacatgatcacagctcactgcagcttcgacctcccaggctcaagtgttctccacctcagcctcccaagtagctgagaccacaagtgtggtctaattttttaaacttttttgtagagatgaggtcttgctatgttgcccaggctactcctgaactcctgggttcaagcaatcctctcaccccaacaagtgctgggattacaggcacgagccccatcgtacttggtcagtgtttatttccttccttccttctccttccctcctctctctctttctttcttattttcatagtcttagttgcgcatgacttttgtcctaattagttgtgtatccagttgtcttttgttttcagaagtaaagaagtgataggaccaggtgtttttttgttgttgttttttaacgttctctgtgcttcttggatctgcagtttggtgtttgtcattaattttggaaaattctcaaccgttatttcttctgctgtttagagttggcctcagtttattatttgctgtgtgttatgcagcacaggctttgaatgtttgtagaggcggcttggatctaggatgaggagtgttttaccatggcagtgtttgaaattctgtcttaagtcttctttctttgttgtatttcacaggaggtttctttgcatattcttctcccagttgtattctgctgttggctgttgtttgaagctttttgacttggaagtgtgtagcggtagtgagatgctgcctccttttctggttaaggctcagttttttgttgttgttattttttgagacggagttttgctcttgtctcccaggctggagtgcagtggcacgatctcagctcactgcaacctccacctcccgggttcaagcgattctcctgcctcagcctccaaagtagctgcaggcacctgccaccatgcccagccaattattgtattttcagtagagacagaaccctgtctgtctttgaccacattggccaagctggtgccaaactcctgacctcaggtgatttgcctgcctcggccttccaaagtgctgggatcataggcgtgagccactgcgcccggccaagtctcagttttagacatgtctggtaaccctggatttcagaggtgcagctgtctcagttcttctgccttttccctggctataattttggactcagtgtgtaatcctgccccttttgcaggactaggtctctcctgtccctctcttcccttccccctgctgcccccaaattaggacttttgtttctgagtggagattgagaggaaggatttgagtggaatttctttcccctccttcctggcttctggtcccctccctgagttctgcgctactgtctttgcttcttcgggctctttcagatcttttcagtgattgcctcatgagtgccacggagaaagagcctgcaaagtaatgcaggctttcccagtttctgcagttgccagaaattgtcctgacagcctgtactcagcctttcgcaatttgtcttttattcttgctgaactcttcttactagtgtgtctgattgtgtctaccccaggtgagtgtatttgttttctttccctgaaggcacttaagattatgggccagtgtttgttctgtaaccacagctctccagcaggttcagaaacagtcatggatatgaagttagtctggctgttttgcactgtaaggttgagcattatgctgtcccaggtctcttcatcctagggcagaagacagaagcagccatgtcttgaggaacagaagttttttggtgtaagtccagtttaccaatttttttaatgattagtgcttttggggtctcaagagatctttgtctactccaaggttgggaaaaccttcttctttgttttcttctagaggttttataattttagctgttatatataggtctgtgatctatttcaacttaattttgggtatggtgtgaggtgaagttggaggtgtcccccactccatattcatatccagttgtgtaccatttattgagagatctctccctatggaatcaccttgttcatttgtcctttaacaatgttctttaaacaacatttcttaaaaaaattagcggtgcttggtggctcgcacctgtaatcccagctactcaggaggctaagcaggagaatcgcttgaacctgggaggcagaggttgcagtgagtgaagattgtgccactgcactccagcctgggcgacagagtgagattccgtctcaaaaaaaaaaaaaaaacacccatctctaaagaatatttcttactgttaaatactataaaaatgcataaaagtaatgtacaggtttgcaaattaatttgacccctggtataagcaccattcagataaggaaatagaacattaccaggactccaaaagcctgctaaaggctactactcgattacagtttcctttcttttcctttcgttaaacatactaaatggcagggtgcggtggctcaagcctgtaatcccagcactttgggaggccgaggtgggcagatcatgaggtcaagaaatcgagaccatcctggccaacatagtgaaaccccatctttactaaaaatacaaaaattagctgggcgtggtggtgtgtgcctgtagtcccagctactcaggaggctgaggcaggagaattgcttcaacccaggtgacggaggttgcagtgagccgagaccgtgccactgcactccagcctggcgacagagcaagactctgtctcaaaaaaaggaaaaaaaaaacaaaccaaaactaaacatcccaacactatagttttgcctgtttttgtaccttatataaatggaagcatccatactgaatacggtatataacttgtctcacccaacaatatttgaaagatttatttgttttgaacttagctatggtttatccattttaattcctgtatagtatttcaccatatagatgactgttcattcattctacagtttatgggttatttccagtttgggactggcatgaatactcttgtacatgtattttggtgcatacaggacttaatatgaggaaagatagatatccagaaaaggaattactgggtcatagtctacatgtattttcacagtcttcatgtaatgcctatttcccaaagtggttatacctattttcactctaccagcagtgcttgagagttcccattgtttcatgtttttggctgagcgtgggttttgtcctaattttttgtttcagcctctctggtgggtaaatggtggtactatgatttaatttatctgtgatatctgtgacatatgtttatgtctatggaccatttgggtcatctgttgtgaagaacccgttcaagtcttttgcccaattttttcagtcaagttgtatatctttttcctatttttctcatttttcacttttttttgtcatttttttcattttcttaatgtttatcaaatagaagttttaaattttaggctgggcatggtggttcatgcctgtaatcctagccctttggggaggccaaagtgggcggatcacctgaggtcaggcgttcaagacgagcctggccaacatggcaaaaccccgtctttactaaaaaatacagaaattagctgggtgtggtggcgggcacctgtagtcctagctgcttgggaggctgaggcagggataattgcttgaacctgggaggtggaggttgcagtgagccaagattgtgctactgcacaccagcctgggtggcagagtgagactgcatctcaaaaaataaataatttttaaatagttgaatctgggctgggtggggtggctcatgcctgtaatctcagcactttgggaggccgaagctggtggatcacttgaggttgggagttcatgacaagcctgatcaacatagagaaaccccatctctactaaaaagacaaaattagccaggcgtggtggtgcatgccagtaatcctagctactggggaatctgaggcaggagaatcacttgaacccaggagggagaggttgcagtgacctgagatgatgccattgcactccagcctgggcaacaagagcaaaaactccgtctcaaaaaaaaaaatatatatatatatagttgaatctgttgatcttttcctttatgctttagtgcttttggtgtcttgaaaatgtttccctttacccaaggtcatgaggatattatccatcatctttcacatttaggtctataattaaagaattgatttttgtgtatggtgtgagataggggcccagtttttttttccccccggtttgggtatctagttgttctgtattaacttcaatttaaaaggccattctttccatagtattgtagaatgccatcttggttataaatttagtgtatgtgtttcataccttggttataaatttagtgtccgtgtatcataccttgattctatattccttcgtctacttttctatccttgagcggccagtaccacactctctgaattattatagcatttgttgttgttgagaacagggtcttgctctgttgcccaggctggaatgcagtggcaggaggatggctcattgtagcctcaacctcctgggctcaagcaatcttcccacctcagcctcctgagtggctgggactacaggtgcatgccactatgcctggcttatttttaaattttttgtagagacggggtctccctctgttgctcaggcggtcttgaactcctgggctcaagcaaccctttcacccaagcctcccaaagtgctgggattacaggagtcagctgccatgctcagcctagtatagctttttaataagccttaataggcgttctgtattgttcttcatgaatgttttggttattcttggccctttataattttatgtgctttatgtgaaattaaacttctgtatcttagtccgtttgtgttgctataaggaatacctgaggctggataattttgctcctggttctgcaagctgtgtaagaagcatggtgcacagcatttgcatctggtgagagcctcaggttttttccacttacggcacaaggtgaagaggacccagtgtgtccagatgacatgatgagagaaaaagcaagagagatgggaaaggaggtgccaggctgtttttaacagctagctctcagggaactaatggaatgagaactcactcagtgctggaaagacagcaccaagccattcatgagggacctgccctcatgacccatgcacttcccattaggcccacctccagcactgggtgtggtggcacgtgcctgtggtctcagctgctcaggagtctgaggtgaaaggatcgcttgagcccagaagttcgagactagcctggcgacctagcaaaacctcgtctctgctaaaaatacaaaaattagttgggcatggtggtgcatgcctgtagttccagctacttggcagactgaggcaggaggatcacttgatagcccgggtggtggaggttgcagcgagccaagatcgtgctactgcagtccagcctaggcaacagagtgaccctgtctcaaaatatgtaaataaaagaaaaagaaaaaaattttgaaaagaaagagctggggtggacaactctgaaggaattcactgaaaaggaaggaaaagataggcagtgagagaagctggggcagaagtgctactgagaggagatcgttgtgtttcttcagagtgggagacagcatatttgcatcctaatggaagtgatgcaggaaagaaagagaaagtgatgatatgagaagaggacagaatcagtggtcctcaagtggcgacagggtggggtctggttgtgaagagctagttggaggacattggagaggagggcacaggcgcaggtctgcggatgtgtgggagctgtgaaaactactgccaagtgcttttccaaaagattgctggtgctcacaccaccctcagcagtctgtgaatacccatcttcctttatactcctcagcacagagtccatgtccctgttcttccctcctgggcaccctgctccgcattgacggagctcgagatccccacatctactccactgctccccttcctctcaacttccatcattaggctcagggaccttggccctttccctgtgtcctgccgtgaaagttctggtgcctctttaccttaagtcgtctcctcatcttttgacttacatggaccataacatttttagtcatcagcctggtgacttagctttatcaacattgtattatgggaaggagaggattctataaaaaagcaagtattgcctgtgggccccactgttttaggtcactggctagcctctggtttggctgtccttgggtcagatgcctccctgctgccaggggagcacaggtgatggtgatggatgagggtctgatgatggggacctccccatcagcagaggtgtgggtgacttggggcttgtcgggtgtgcaaatggctactttggatttgcttcaggtcacttaattttgagatgctacctacctattccatgtgttgtctctgaataaaagccactttcagcctctgttctatttaagtagttttatttttctctctggtcatttctgggtattgctgtaaagactgttaataccttatgcaaaatgactggttactgtgatttttcaggaccttcagagattgaagggttacaaactgcagtgtgagaagttagtaggcctttgataccaactttttatttgaccttagtagattaactttactttaaagattggcaaagaacggtatgttagaaatacatgtaagtctgctgctattaataaattcaagctgttttgcccttttgctgtatggagcctgaatgtagagacttgaagtattttgtagatatttgtgctgtcccatgacagagcagggatatgaaacttgccctggcatccagacatgttctgaggctggctcagatatttgttttcttctggataagtagcatcaaaacaaatagtaattatattatttaatagacttaaaacacggcaactacatttgtataggaaaaaccacattagtaacattacatggagaaaagcattttatgtaactatagttccagcaaataccactatgccttcattaatgccttaaaaccatcttatttacatctgtagaaccactggccatttaatagggcaattcaggagcaatcattaaaaacagttgcagttttcattaggttttctctgtttattctaatatgtaaactgaaattaaaagtaaatccttcagagttcattctttaaaaaaagtaagtcctaaggaaaactgttatattagctatttaaaaggatgctgtaataatgtagaatcagtcactgttgaattttattgagtttccatggaacagccttgaaattataaattgctagatatttactctgtaagattacagaaattatttatcacagagccttaaatacttaaggtaattttgtgcctaactcatgatatgattgttaccaatctctttgtaaccactgagaaggaggtttaagtattaatgttagtaattgctctccaggcaatgccttttgctcagagaacctgcatatgctttgggaaagctgagttcaggaaagaaagggtgaaaagggcacaggtattttagtgactacacataacagtgttccctggacttgagtgcaggtagctaataaaagatcatgtataggctgggcttggtggcttatacctgtaatcccagcactttgggaggccgaggtaggcagatcacgaggtcaggaatttgagatcagcctgaccgacgtgatgaaaccgcatctctactaaaaatacaaaaactagccgggcatggtggcgcaggcatgtaatcccagctactcaggaggctgaggcaggagaattgcttgaatccaggaggcggaggttgcaatgagctgagatcacgccactgcactccagcctgggcaacagagcgagactctgtctcaaaaaaaaaaaaaaagaaagaaagaaaaggatcatatataaaaatgcagaaaattggctgggcgccatggctcacgcctgtaatcccagcactttgggaggccgaggcgggcagatcacgaggtcaggagatcgagaccatcctggccaacgtggtgaaaccccgtctctactaacaacgcctgtctgggcgtggtggctcctgcctgtagtcccagctacttgggaggctgaggcaggaggatcatttgaactcgggaggcagaggttgcagtgagccaagatggcgccactgcattccagcctggtgacagagcgagactccatctcaaaaaaaaaaaacaaaaaaaaacaaaaaaaaacaaaaaaaaacaaaaaaaaaacaaaacaaaattaaaaaacagaaaattgtgattgaggtaggcaagacaaagtgtgtattattgatttggactagacatttcagttcccttagcatttactgggcgcctactggttgctgggtgcattatggacattcataatgttgagtgtctaatgggaagatggacatgtgaaagataattttgtagtataatgaatatatgatagtctataggaagtgtagaagttggccaggcgcagtggctcacacctgtaatcccagcattgtgagaggccgaggcgggtggatcacgaggtcaggagatcgagaccatcctggctaacatggtgaaaccccgtctctactaaaaatacaaaaaattaaccaggcgtggtggcgcgcgcctgtaatcccagctacttggtaggctgaggcaggagaatcacttgaacctgggaggtggaggttgcactgagccgagatcgtgccactacaccccagcctgggtcacagagcaagactccctctcaaaaaaaaaaaaagagtgtagaagttgtacaggagttgtagtaattagctgcgtgtgacacgtattgattgaggggtagggagcaaaattcacagaataaaaaagttaccatagtggggtttgaagggatgcctcgcagttgtcttgtaaaggaaaggcggggagattggtgttttagggaagcaagcagcaagtatgaaggcaggaagagataaagccacatagttggttggggcgggagtgtggaactgtaaggagtttcaagtgggtgattttgcaagaacacactgaccaagggcctggtgtatcctgcttgatcctttgctaaggacttgatctttttaggcagcaggaacaatcgaagggtttaaggcagagaatgttctggtcataggtacagtgtgagggggttttgacaggagatggagggcatgtggggagcagacagccctgaaggccggtcggcaggaggtggcagcgtcaccagcacggggcctttgttgtgtctcctgcattagccttcatagggcggtctaatctgggttgtgctgctgttacccgagaggatattgcttttactgtgtttttaccctaagatgaccttttttcttcatgtttataagaagtttatctgtaaagtatttttagtaaatctgggttttcatgtttaatttggaatttcattttggaaacaaatttcaaaactagaatataagcctagcaagaaaacaaatgctattatgatttaatgtcttttatgatacacacacacctcccacccccatgcacacaggccacagtcactgggtggtagaaaatcagtttattcagaaaaggtaaaatacatcatagatggtagaactcagctgttagtagtgttcccaaagtgttttcagcaatactgccatcttagccatatgtccgtattctcctatgcaaaaatttctgggttatcttggtcccttacatggatatatatacacattttatatatttacatatttcatctatgtgtttgtaggatttgggggatgatactagtaaaatgttcattctggtacatatatataatttttttttttgagatggagtattgctctgtttgcccaggctggaatgcagtggcgcgatatccgcttgccgcaacctccgcctcatgggttcaagtgattctcctgcctcagcttgagtagctgggattacagatgtacgccaccacacccggctaattttttgtatttttagtagacacggggtttcaccacgttggccaggctggtcttgaactcctgacctcttgatctgcctgcctcggcctcacagagtgttgggattacaggtgtgagccaccgcgcccagcctgctacatttattttttaaaaatatcaatgtaactagatttctgcttccaagcaagaggtagtaactagaagtggatttatcttcctgtctcaaacagtgaaacaaaggaccaaaaaaatgtaccaagtagtagttttccaacattggcccacaggcaggcaggacagtgatccctgagagaagaagaataaccgcggcaagctccagccttgcccaggcttcctgcctggagagagtctgaaggctaggacttggagagctacccagaccgagtctgaggatctccttgattgaggaggctgagttgagactttggggaggccaaagtaaatttgcagggcagagtaccagagaggagagagctgcaaagaggggaaggaagagctctgcatagggttctccccaagcccagctgagggcgcataagcacatgcctgtggggaagctctctgcgcctgggctagcaccctggaagtgaggagcgggacaaaccttgcagctcacacagggccaggagcagtgtgtgttcccaccagccattgtgggaaaatcttacaacctgcaggaccctgggtggcagcttaggaggatattgcctcagttgtgggtaagaggaaaggcgttctgatgctgccttacagagcctacaagccctgaaaggaccagactcttcccaaacaaccctcctatggcccatgacgaagctcagatactgaaggaatgaaaaaatacccagcacctgacgcttcatacttgtccctagctcttctcctcctctcacacctcacagctggctccttcacagccttatccacttcccttcctgcagccctggtccaagctgctgctgtctggctcctgaactgcagatagtcgtttcttcccattgtcccatcccatctctctctgcacgcagcctcagagtcactccttgacttcagtggccctcagctctcccccatctctccttctgctcttgtcagccccatgccagccactgggctccccacaaggtacagccatgtcggcttcgggggtctcctcaaggaggccctcactgtccaccgggttaaagggtacagatcttctttgctgttatgtttttctccttatcactatttaattagttaattttttcatgtatttgtcttatttattgcctttgtctttgacagttttcttcaccattgtgccctcagtgcctggaccagtccctgagcatgtgatgggctcagtaaatcctggatgactggtgaatgtacaggagctgagctgtgcgctctctggtcatttctggctcttaacattatgattttaggcttggggacctttgggcctgtagagcccagcatctcattctgtaattaaaagggcaagccagaaaggtctgatgggtatggctgttctgccagtgatgggagctgttttctaagacctgaggaaaagagatggctttatattggggtaaatcagtgtgcctttttttttttttaattgtcgtcatttaggcttttgggatttgttggtatggaaaaatacatggattctcatggtactcggtggtttgagtagtctggcgttctctaggacactgtggggaggtaggacgcagttgtctgcccctgtgccccaaacattcagctcaggatggctgctgagctgggtttgggaaaactcacaaccctgtggatgtaacaggagtcagcagttttgatcactggttcatggaaacatgtgagaatatatatgaacatcttttgagtcttgctggtattgtcattcattctttcaatcactaattcattcatttatacattcagccccttgtttaaatatgtgcttcctgccggtcagcaggaagtcttaagaatggagcctggggtccaaatgagagccctcagtggctgttcaggggccaatccgttatgtacagtgggtccttttgaataccggtggtgggatggggagacagctcgaggctgtgggaagagctacaggtctagccggccttggagaagcttctgggtggagatggagactgaaaagccagaacagcgtcagctgggtccactctcttcccacctggcatgtcttgcagcaaggacaccctacacggcaggagagactagcgggggttctctcacctccaccccactgtgtgccctttttctggctgcctctggaaggccaggcgaggcttccctttgccctgctccctgggagtgcctccctccagcctctcctcagggttcgaaggggcttcctcctaaggtgcagaggcagccctgtgtgaaggacccgtcttaggattgggttgatacgggttaaaaatcctgtgtctcccccgacacacacacacttgctggtcttgggactttaaccccatttccagttgtgtgagactcagtttctttctttttcttttcttttccttttttttttttttttttttttttttgagacttagtcttgctctattgcccaggctggaatgcagtggcgtgatcttggctcactgcaacctccaccttccaggttcaaacgattctcctgcgtcagcctcctgagtagctgggattacaggtgcacaccaccacgcccagctaattttgtgtttttaatagaaacagggtttcaccatgttggccaggctggatttttctttcttttttttttttgacacggggtcttgccctctcacccaggctagagtgcagtggcacgatcacagctcactacagcctcgacttgctgggttttagcaatcctctcacctcagcctccctagtagctgggactacaggcacgcaccactatgcctggctaatagttggattttttgcagaggcgaagtcttgctatgttactgaggctggtctcaaacctctgagctcaaatgatcatctcacctctgcctccccaggtgctgggatcacaggcgtaagccactgtgcccagccttcagtttctttttctgtatttgtgttttaaaggctaattttattttttttctgatagagtgggtggttatcttttgagaggttttaaggtataacaatcttgccttttcctcctacctctaaggcctcttccccttgccccacattgtaggacctatttgaaaatgcagatgtttatttacatcaggtgataagagatgagctcagcatcattactgctgggcctggaagggcgtctgggccttggatgtgcagctgccatcagctccctgtttatcttgaatctggaatttggacagccgacctcaaagatggtttgcatctgcagacacacttaagccagaattgccatcttgaatctgagccctggtgtgcagatgcctctagaatagtagtttcagacttcgttggtggtaaccagttctggtaaacagtctgaaaattgaggctgacagtttctagcatgtggtggaaaagtaatacagaagtcaaggtgaaggggttaattttgacaattttctaactcgtactaagataagattttctttatggcactatttaaagtattacgagtttctagaacattaggtttagttttattcaatacatttcctattttatgtttctgtatataaacatacacatgcattttagttttagaactatacatatattttaatattcttggctttgtagatgaggttttgaaaatagaattttttttttctattccagactccttttagttttggcatgaatcataggacaccaccctaccctgctggggattattgtcttctgtgcagaagtgaacggaaagactcatcattcttagagagtggaattaagactgcgagcaaattggccctttccatggctcccaagggcaacagcgtgctgcacctgccactgtgggtgtgcccggactgccgcaggaccgtggagaaggaggagaggcatggcggccttgaccagccagtggtgagtggctgccagcacaggcagcgcagggcgttggctccccccgcccaggttatggggtaactggcagtgaaagaaatggatttgcttttgcttcagggggcactccctcctgcaccaccttctagtctgtgtctcctggtacgttcctcctggtcttccctggccacactgcagtaggtggcaggacacctgccctccttgtctgggcacaattcagtcatcaagctatgtgaccctgaagggtgatttttggctttgagcttagtatttctttggtggtacagtttcttgaaaagggagtacaattttcatgtgtttagttctcaacaattcgacatgcaggtaattctttacgcgatgctcttaagcctcaccttcccttttacttatttgtgctgcttcagcctcttcgaggccacagcaggcttggctgggaagaccgcacccttactcttatctttgacctgatggagttttggtgggcccttgttccgggcaggctttcacatgtactgtttgggttctggaaggagttggcttttgcaactatttgagaccccacattctaggcctcttctgtgccctttgatttctgcttgaaagcggctaattattttctgagctcttctcttccttctgataccttgctatgtgcagccaggaaacgtgtgcattccctgctcctctgttttctcctgcagaactgccttgggggagtcctggtgacaatctgaagagcgcatccccactgcctggtgtgggtttccatctttactggccttggaggcaagccccatctccagggccagtttctatccttggggtctcattgtcagaattactttctcactcggcccctcccgcatgtcccgctttcctgctgtaattctcttcctagcacttatttctaacatactatgtattttacttactcatttggtttgctttcttcttcattagaatataaactctacaaagacagctatttttatggttttctttgtgtggtttttttgtttgtttttttaccaataccattttctttgctttttgtggtggttggtttgttttctcattaaactttatcagctcttcttccgactccagccctgctcttgtattttagcctgcctctgcccttgggaacaggcttctgctgtttgccctggtccagaggccagcggaagtgcctatggttccctgcagtgcgtcttgcctgcgttggaggaggatctcatttcccagcccccggcttgtcttggtaatggatagtttgtcagatgagccattctctcctcaccagaaacagtgaccttgggaacagcagaggtgtagtgttggcctgtgtttgtggattcggaccagctgttgctttgtaggtcagcctctttgttggagctggcctttaaaaaaataacatgatttaccttccattaagattcactctttttttacttaaaaaatgttcactaccacagctaagctacagaacatttgcatcaccccataaaatccccttgttccccttggtagtcacttcccttcccccgtcctagcctctggtaaccactcacctgaatttttttttttgagacagagtctcgctctgtcacccaggctggagtgcagtggcacaatcttggctcactgcaacctccgcctcccgggttcaagcaattcttctgcctcagcctccccagtagctgggactacaggcacgcgccaccatgcccagctaatttttgtatttttggtagagatggggtttcaccatgttggccattatggtctcgatcgtgatccgcccgcctctgccttccatagtgctgggattataggcatgagccaccgcgcctggcctgacctgatttttgttcctacagttttgctttttccagagtgtcacatatacttctgtaacttgcataatgcttttgagagttacccaaaatgttgcatgcatccgtagtttctcttttttattgagtaattttacagataaaccaatttatgcattcaccaattaattgatggatgtttgtgttgttcccacgtttgggctattttgaaaaaagctgctatgaacattatttttcttctgtggacatcctttttatgtgttgctggattgatttgctaaagttatgttaatgatttttgcatctgtgctcatgaaggctgtctgtaggcctcttgtcttacagtggccttcggggtctcataaaatgagttagaatgtgttcctgtttcttctcctttctggaagactgtgttagaattggtattatcatctcttccttaaacgttattggttcttgctttctgtttctcttgttctgtttggtcaaatgccagacagtgtgcagagagcatcaggctgaggttgtttcctgtgtcctgttgtgcacctgggaggccaggtcagtgcatttggcctcagctgggctgtctctagcactgtgcgtgctcgtgtgggcctgtagaggggagtctctctctacttcctccttggcaaggtctccgatggtggcatcttctcagttcccccctctagcctgactcttgggcagctctgtgctcacggccttgggggcagctttcccagcgagcccacctctgcccggtggcagccagactctgccttgtatctgcaggggtctgaccggccccgtgtcttgtgctggtcctggcctgtgtgtggcacacgcctttctccaggacaaggagaaaggcatgtttccttcctctctgctagtggattagctggagacttgggtgcaggtctcctgggaatgagtgggaacattcgttttggggctttccaggggttagactcccacacttgacactctcaacctttcagaatttgtttaaagttaaactgttttttttttttctaaccacttttatggcctccttccactttccttcctctgtcaaaggtgaaacagtaagtgtgtccccttctccctggaggggctgctgcactttgttgtgtagttccctccggcagcctggtcacttcggctctctgatggcccagagataggattttatcaattgtcctgctctgtctctggtcagggctctggtcagggctcagagtgcacggctctcctgcagctttctgcatccagaggggaagtggggctgaattgctgtcttctagataagcattctgttatcagcagttgtaggagaatattggtgggaatttatcttaacatcttgcctgacagttgcacgttgcaaatttctctggagacctcttcttccaagattgacccatcctagcatcacgtcctagacatagtcgtgcctggaaacctaagaaatctccatttcaaactttcatcttgatcattgtctgtctttgtagctcacttgcttgtcttctcttgccatagtttttttttttttttgagacagagtcttgctctgttgcccaggctggagtgcagtggtgcaatctcagctcactacaacctcacttcctgggttcaagagactatcgtgcctcagcctcccgagtagctgggactataggcatgcgccatcacacctggctaatttttttttttttttagagacacagtctcgctctgtcaccaggctggaatgcagtggtgcgatgttggctcactgcaacctctgcctcctgggttcaggtgattctcatgcctcagcctcccgagtaccggggactataggcgcgcaacaccacacctggctgatctttgtatttagtagagacagggtttcgtgatgatggccaagctggtctcaaactcctggcctcaaatgatctacctaccttggcctcccaaagtgctgggattacaggcgtgagccactgcgcctgacctgccatagttctttgacctcatccatccctatcagtccatggattccattcctgttaggtttatcacgtctccccgacctcactcctaggagcctgagttcccggacttggcactgtggctcttccgtggctctcaggcaaaggccctgaactttttttggttatgctggtccagccctgtctcttccctccatgtggcagaatattcatggagaaaattgctggcctcagtttactgcttcctcttcataacttcatgactgcaaaccatgcatgggcatctagtgcgtttttctggcttaagtacctccccaaactccttggcaggaacccttccttttccttgcttcttagactacgtgtaccctctttacccaccccttgctcagctcagctattgaccttcgtgcttcagggagaaaatcaaagttaacacctcccctgtatcacccccaaacccccatagctgagggcattttctcctctctttcctctccaaggcccacccccactgggctttcaggtgcccatctgttttcatcttcttcaagactttgtcgctttgattattgttttcttctgccttggcccatgacccatggaatgcaaatactctggggctacccattcatgaatgacccgcctttggcctcacctccccttcacagccatgtatgtctctaggtagattttaaagttgtggttcaatttctttaatggttaaaatcttgtcaggttagttttggtaagttatattcttagaaattgtcaaagttgcccaccagcgtggcacatgcctgtagttgcggctacacaggaggctgaggcaggagggtcgcttgagcccaggagttctgggctgttgtgcggtatgatagtgccactgtactgcagtctgggcagcacagtgagaccccgtctcttttaaaacaagaaaaattggcagagttactggtataaagttctgtgtaatggtctcttttcacttcttacctgatttgtagatttgactttttatttcttcttcttcttttttttttttttttttttcctgagatggagtttctctctgtcgcccaggctggagtgcagtggtgcgatctcagcttactgcaacctctgcctcccgggttcaagcgattctggtgactcagcctcccgagtagctgggactgtaggcgcgtaccaccacacccagctaatttttttgtatttttagtagagatggggtttcgccatgttggccaggctgttctctaactcctgacctcaggtgatccgcccacctcggtctcccaaagtgctgggattacaagcctgagccaccatacccggctacttttttatttctcatatttgtgccttcttttttttcttttaaactagttttgttagaagtctgtcagttttggcccagcacagtggatcacacctgtaaccgtagtctttgggaggccgaagcaggaggattgcttgaggccaggagttcaagaccaacctggctaacatagaaagactctgtctctataaaaaaaaaaaaattataaaccaaaaaaaagtcttgtcagttttgtctttccaaagaagcagcttttaacttttaaaatacttgtactttgtctgtttaattaattgttgctttttattattattatttttaagatagattctcgctctgttgcccaggccggaatgcagtggcgtgatcttggctcactgtaacctccacctcccaggttcaagggattctcctgcctcagtctcctgggtagctgggactacaggcatgtaccaccgtgcccagctaatttttgtatttttagtagagacagagttttgccatgttgcccaggctggtttcgaactcctgacctcaagtgatcctcctgctgcggcctcccaaagtactgggttgacaggcgtgagccactgcacccaggcaattattgctattttatatacatacatgtgctatatattaatatttgattggttgatgctatggtgaatgtgatttaaaaaaaaaaaatttagaggcccgaaagagaacagtgcaaagttagtttcctctggctctctctctttatcctctttgccttcccagaggcctccactattggcagatgcttgaatcttcctctagagatgttctgttcttttttttttttttttttgagacagagtttcgctgttgtctcccaggctggagtgcagttgtgtgatctcggctcactgaaacctccacctcataggttcaaacgataatcctgccttagcctctgagtagctgggattacaggcacgtgccatcaacccagctaatttttgcatttttagtacagatggggtttcaccatgttggccaggctgttcttgaactcctgacctcaggtgatccacccaccttggcctcccaaagtgctaggattagaggcatgaggctggccatgtttttcgttttgatgtttttgtttttgttttgtgacggaatctcgctctgttgcccaggctggagtgcagtggcgcgatctcagctcactgcaagctcagcctcccgggttcacaccattctcctgcctcagcctcccaagtagctgggactacaggcgcccaccaccacgcccggctaattttttgtatttttagtagagattgggtttcaccatgttagccaggattgtctggatctcctgaccttgtgatccgcccgcctcgtcctcccaaagtgctgggattacaagtgtgagccactgcacccggcctttttttttttttttttttttttttttgagacgaagtctcgctctattgcccaggctggagtgcagtggcgccatctcagctcactgcaggctccgccttctgggttcacgccattctcctgcctcagcctcctgagtagctgggattacaggcgcccaccaccatgcctggctaattttgtgtgtatatatatatgtatatatatatattttttagtagagacggggtttcaccgtgttagccaggatggtctcagtctcgtgacctgcccacctcggcctcctgattgctgggattataggtgtgagccaccgcgcctggctttttttgtttttttttttgagatggagtttcacgcttgttgcccaggctggagttcaatggcgtgatttcggctcaacgcaacctccgcctcttgggttcaagccattctccttcctcagccgccctagtagctgggattacaggtatgcactaccacgcccagctaatttttttttttttttttttttttgagacggagtcttgctcagtcacccaggctggagtgcagtggtgcgatctcggctcactgcaagctccgcctcctgggttcacaccattctcctgcctcagcctcccaagtagctgggactacgggtgcatgccaccacgcctgactaatttttttttgtatttttagtagagacggggtttcaccatgttagccaggatggcctcgatctcctgacctcgtgatctgcccaccttggcctcccaaagtacaggtgtgagtcactgcacccggccaattttcattattttctagtttttattatttctgttttcacccgtgaattatttagaagtacgtgtaagtatccaaacacatatctcttgaattattattattattattttgagacggaatttcactctgtcacccaggctggagtgtagtggcacgatcttggctcactgcaacctctgccttctgggttcaagtgattctcatgcctcagccttctgagcagctgggattacaggcgtgtgtcaccatgcccagctaatttttgtatttttagtagagacggggttttaccatgttggccaggctggtctcaaactcctgacctcaggtgatccgcccgcctcaccctcccaacttgctgaaattacaggggtgagccaccacggccagccacttgaattacttttaatcatgttgacttttaatttaatgctgttatagttgaaaatcatggtctgtatgatagtgattccttattaatcactgtatttgctgtatttgctagttctaatacatagttacttttttaaattattctgtttgtgctggaaaataatgttttctctgggtttaggtggaaggctcaggacctcattaattgtgttcttaaatccttctgtgtttccgtggttttattgcttttttggtgcttaatctgtcaatttctgagtgttatttaaaatgtcctactatgaatgtgtctttttcctgtcttccttaaaaagtttgttttgctttacatatttcaagagtgctgggtagaatacaggttgaaattattattaagtctttaagtcttggcgtatcattcctgttactgcacggaccccatctgtggtcgtgcctttctcctgaagggcgttgttttctgtttgtttagctatgggagctccctcccattcttttttttgcacatctgcacatccttttaattttgatttctttgtgttagtctgtttaggtgttcttatgcagtatatatagaggtagactttacgtggttttaattgagagtctgctttttttcttttttctttttcctttttttttttttttttttttttggtggcaaggcctctctctgtcactcaggctggagtgcagtggtgcgaaaacagctcactgcagcctcgacctcctgggctcaagtgattctcccagcttagcctcctgagtagctgggattacagctgcacgccaacagtcctggatgattttttttttttttttaaattttttgtagggatgggtccctactgtgttgcccaggctgatcttgaactccggcgcccaagcaatcctaccaccttggcctctccaagtgctggcattacaggtgtgagccaccatgcccaggcgagagtctgcatcttaatggtgaaatcaatcctcatcacttactgtaatggttaatatatgtggggtaatttctgctaccatgcaggtcaaaaatcaagcgttgctgttaacccagatcccttcttgaaccccttctagtcattaccctcttgcagcaagttcacacttgccggctgctcctagtcctcactcttactgttctttgttagttatatcacctaagcatctacccacaaatactgtagtacagttttcctggtgttttgaattttacagaaatgtaatcgtactgtgtgttattttatgtcttacttattttgctcagcattatgtttgagagtcataaatcttgtttctctattttcattgctagatgccatcctcctttgtgaacatgttgcattttagttgtttccaaatcttgctgattgtggagcacacatgacattctgttgtctataaatagaaggaattgctgagccataggtggtttatatacttgactgattccatgttaagatcagtagcatgtttttaaatgaaaactattttccaaaaacaagaatggtttagtaagtagggccggacacggtggctcacgcctgtaatcccagcactttgggaggccaagatgggcggatcacctgaggtcaggagttcgagaccagcctggccaacatggcgaaacctcgtctctactgaaaatacaaaattagcccgtcatggtggcacatgcctgtaatcccagctactggggaggctgaggcaggagaatcacttgaacctaggaggtggaggttgcagtgagctgagattgcaccactgcactccagcctaggcgacagagtgagactctgtctcaaaaaaaaaaaaaaaaaaaaaaaaaaaatggtttagtaagtagagtggccgtgttttgtatattttgcaaacctctttttttttttttttttttttttgagacagtgtctcactctgtcacccaggctggagtacagtggcataatctcagctcactgcaacctctgctgcctgggttcaagtgattctcctgcctcaacctcccatgttgctgggattacaggcgtttgccactgcgcccggctaatttttgtatttttggtagagatgggggtttcaccatcttggtcaggccggtcttgaaatactgacctcgtgatccacccacctctgtctcccaaagtgttgggattataggcgtgagccaccgcatccggcctaacaaacctctttaatatctgaatgatagaacaaagctggtttcttatatctgcctctgtgtggaacctgttgtgataggttgttctgattgaagtatttgaagaaatattttattggcttttttagagaattgtggatatttttctttgatgctgtaccaaaccatgacaagttagtttctcaagggttaggtgtagtgtagaagctaaaaccaatcagtggcttttccctacactgttatgtgaaagtccattggtctgtcttgtcctctgaatggatatcttgcccatgcgtggcttgtaacatcacatgttggttatttgtaaagtattggtttactaaggtagacagattttcctgatattaatacttttcatcattatttttaaaaaatcatatttgttacaaaaaaatcatatttgttaataccaccactgatctcatcagaaagttctttaaatgttgagttttcaagcccacagtggcaggtgaaagttttccagagttctaatttttgctcagaaaaattatgattatgagaaaagctcagattttattggtcacaaatagtgccaaattgccttgaagtgacggactcattttgttcattttggaaaatatctgacaaatatccaagtccaaataaccatagtttggcccatcagtcactttttgaagtaaaattgacatttcacaggtgaagggccattcatctcacaatgcacagtgagattcctcgaggcggactcttcctggggcgtgccggagaaataaatgctctgtgtatacttcccacttcgtcacgcagaatattcagaagacttgtgctcaggggttgagatttatgcaaaataattatttttattgcatcaaggacattcttaagtggaactggcttttttcccgcctcacagctctgaagtgtgtggcagtgaagaatgcagcagccactagcatgctttgctcctgctgtcttcgtccttgcattggtgtttcactcttttccccaccattgtttttttccctgtcagtgtgaatgtcagcacagtgaaaaaggcagaggacattttggtacaaatttgaaaatagttttgactcgtgggcctgctgaagggtgttagggtgaaaatcctattttgctagccattagtagttaaccacagatttcttgaaacttgctcaactttttaatatctgtctgctgatacatatttaacataggtgtcaaccagatttgtttttagtatttggaaaataatgctttcccttctaattcttcattatagctttaacactgaaatttgtcagagaacttagttaattatcaatgatatgttcaggttggcaactaggcttatagcatggccttaccctcgctgcggctctaggctatgctggaccatctgaatggggtcctcggaccacactttgagaaccacagctctgttgggttgtctttttcttattgacttgtgggatttctttatatacactcagtagcagctctttattggttgtatgtgttgcagatattgcctgtttcttttttgtctgtttttcactatgtgatggtgtcgctttatgaacacagattcttttctttttttaaccttgagatgctaccagggcagccactcaccacagcccctgctggggtgtgaatgtgcaccacgcacttcacgtccgggtgtgcagcataaattgcagagtgtaaggtgaagccggcctgattcactcccagattagtgcttccacgatctactatatctccttgtagattgatcttaacctgaaaataaaaaaataaaaatttaaaataccaagaggacttcatttttcttttctgttttcgagacggtcggtctcgcccagtatggagtgcagtggtgcaatcctgattctctgcagccttcacctcctgtgttcaagcaacccttctgcctcagtctcctgagtagctgggactacaggtgcgcaccaccatgcctggctaatttttttatttttaatatagacggggttttgccatgttgctcaggctggtctcaaactcctgggctcaatcagtctccctctgtcgccctggctggacctcagatgatctgcctgccacggcctcccaaagtgctgggattacaggagtgagccactgcacccagccaaatatgataatgagccaggggtagtgggaagcatatttagatcatgggcgggtcagcaatatgcccatgggctttgccaccagagtcctgtgtcctggtgtgcctcggcacactgtttgccataggctttgaggagagtgttggttggtcttaataacattctatctcgggcccagaggtagcccactgaaggagaaattcagagaagagaggtgggatggctgagacatttttgcatagacctgcaaggggacaggcctgactaaacaaatcttgctccttaatagtcaggaccaagcctgtgttgaacttagcaatttggtttcagctaatcatcgatctctctctttaaaataatgttgttaatttgaatttcaccttttttttttttttttgagacagagtctcactctgtcgcccaggctggagtgcagtggtgccatcttggctcactgcaagctctgcctcccgggttcacgccattctcctgcctcagcctcccgagtagctgggactacaggcatccaccaccacggctggctaattttttttgtatttttcatagaggtggggtttcatcgtgttagccagaacggtcccagtcttgtgaccttgtgatccacccgcctcggccttccaaagtgctgggattacagatctgagccaccgtgcctggctgaatttcaccattttaaaaatatttcactttaaaccaccttgagtttttacattatatgaaggctaaaagacatattatgttgcattttaacatttgcatatgtttaacaaaaatagttttagtctggtgggagatacggtgaggggatggcactttggggtaattgttttttctttaaagggccctgaactcaagcatcctgtcataaagaagactactcggcaagtagtcttaagtttctatctatttttctgttttcaaggctgttttagactccattttgattatgggcattagcagttgtctttattctcatatatcatattattaaaatgtaagttgcattttacactaaggaactgggttctccaatagttattatgcccatagattaatcaaggcatatagtcccaacttaagccatttaagagtttgctggcgtaggccaccgtgcacggcggcctaggccgatcacgcctgtaatcccggcactttgggaggccgaggcgggtggatcatgaggtcaggagatcgagaccatcctggctaacacggtgaaaccccgtctctactaaaaatataaaaaatcagctgggtgtggtgttgtgcatctgtagtcccagctactcaggaggctgaggcaggagaatccctctaacccgggaggctgaggtttcagtgagctgagatggcgctacagcactccagcctaatgacagagcgagactccgtcttaaaaaaaaaaaaagagtttgctggctgggcgcagtggctcactcctgtaatcccagcattttgggaggccgaggcagatgggtcacctgaggtcaggagattgagaccagcctggccaacatgatgaaaccccatctctactaaaaatacaaaaattagttgggcttggttgcgggtgcctgtaatcccagctactcaggaggctgaggcaggagaatcgcttgaaccagagagttggaggttgcagtgagccgagatcacgccactaaactccagcctggcgacagagcgagactctgtctcaaaaacaaaacaaaacaaaaaaaactcgctagtatttgtcattatcttgaattgttacccaatggttactacgcccatagatcaatcaaggcatatagtcccaacttaaaccagccatttaagagtttgctagtattggtccttaccttgaatgcttgccctgttgggttttaggtcatattagaaacgtacagatttctttgcagtgaacttcatgaaagtagttgctaatgtaatttgttggaactactcaaaattgccagattgacttgagttagccttacagaaagataagctgagtggtgatctttggcttttttcctttagcataatgcttttgagagtcatctctgttgttgcatgtagcaatagttaattccttttatttctgggtaataatccattgtatggataaaccacaatttgtttatccattcatcaatagagagacgtttgtattttccagtttgggctgttatgagtagagctactaggaacatttgagtatcagtctttttttttttgagatggagtttcgctcttgtcacccaggctggagtgcaatggcgcgatctcggctcaccgcagcctccgcctcccaagttcaagcgattctcctgcctcagtctcccaagtagctgagattacaggcatgcaccaccacgcccagctagttgtgtatttttagtagagacagggtttctccatgttggtcaggctggtctcaaacttacaacctcaggtgatccactcgcctccgcctcccaaagtgctgggattacaggcatgagccaccgtgcccggccgagtatcagtcttttaagtggatgcaatttacttctctttgataaacacctgggagtggaattgctgagtcctatagggtaagtgcttatactgttctgcagccacgtatgagaggtccagttgatctttatctttgccaagtgctggatattggcagtctttacttacagccattctagtggtttgtagtgttatccttcattatggttttaatctgcattttctatttatttatttatttatttatttgagacagagtctcactgtgtcacccaggctggagtgcagtggctcaatctcggctcactgcagcctccacctcccaggttcaagcagttctcttgtctcagcctcccatgtagctgggactacaggcgccagccaccatgcatagttaattttttttttgtatttttagtggaaacggggtttcaccatgttggtcagtctggtcttgaactcccgacctcaggtgatccacccgcctcagcctaccaaagtgctgggattacaggcgtgagccaccacgcccggcttaatctgcattttcttaacgacttgttgagcatcttttcatgtacctattttccatttgtatctctttggaaaagtggctgttcagatcttctgctcatttttattgagttgtcttaatgagttgtgagatatttttatataatctcaatacaagccctttattagacaggcttcacaaacattttctctcagcgtgtgactggcattttcattatacagcactgtcctctgaagagcaaaagatttatattttgatcaaatccattttttttttttttttgagacagtctctcgctcttttgtccaggccggagtgcagtggcactatctcggctcactgcaagctccgcctcccgggttcacaccattctcctgcctcagcctcccaagtagctgggactacaggcgcccaccaccatgcccggctaattttttgtatttttagtagagacaggatttcaccgtgttagccaggatggtctcgttctcctgacctcgtgttccgtctgtctcggcctcccaaagtgctgggattacaggcgtgagccaccgcgcccggctccaatttgtgtttctaaatgattttgtgcctttgtgttccatgtaagaaatctttgctactcaaggttataaagattttttgccctggccgggccgtggctcacgcctgtaatcctagcactttgggaggctgagacgggtgggtcacgaggtcaggaatttgagaccagcctgaccaacatggagtaaccctgtctttactaaaaatacaaaaattagccgagacggtggcgtgcacctgtaatcctagctactcgggaggctgaggcaggagaatcacttgaacccaggaggtggaggttgcagtgagccgagattgcaccactgtactccagcctgggtgacagagtgagactccatctcaaaacaacaaacaaacaaaaaagttttttttgcttgtttgtttttttctgtcttaatagttttagcatatacatttaggtctatgagccaccttgaatgaagcttttatctgttgtaagggttaagagtcatctttttttgcatactgatatccagttgttcagaactatttattgaaaagacaattttatctcattgaattaccttgggacctttgtcaaaaatcagttggttctgtatgtatggatctattattggatgctgtgtcccactttacatatattcctattcctttgccagtaccatactatcctgattcttgaagctatttatagtaagtcatgaaattacatagatgtctaccaactttcttctttttcaaaagtggtttggatatattagatcctttgcattgctatgtaaactttagagccaacttgtcagtttctacagaaaagcctgttgggattttaactggcattgtgttgactctatagatcagtttgggggagaattgaaaccttaacaatattgagtcttcaagtctatgaatatggtataactcttcatttatttagatcatttaagtttattttcagcattgttttgtagtcagtatattaaaaactttagtagtcagtatattaaaaactttccagacaggcacagtggctcatacctgtaatccagcactttgggagttctacgcaggtggattgcttgaggccaggagtttaagaccagtttgggcaacatagtgagatcctggttttacaaaaaataaatacattttcccaaagtattttatattttcttgctattttaaatatactctaaaaagtttcaatatttgtttattgctagtacatagaaattcagctttttttttttttttttggatattggccatgtgtactgtaaaaactcatttattagttctatgggccttttggtaggtttctttttttttttttgagacagagttttgctctttgcccaggccggagtgcagtggcgcgatgtcggctcaccacaacctctgcctcctgggttcaagcaattatcctgcctcagcctcccgagtagctgggattacagtcatgtgcccccatgcctggctaattttgtatttttagtatagagacgggtttctccatgttggtcaggctggtctcgaactcccgacctcgggtgatccgcatgccttggcctcccaaagtgctgggattacaggcatgagccaccatacctggccttttttttttttttctttttcttttttttttgagacagagtctcgctttgtagcccaggctggagtgtagtggcacaatcttggctcactgcaacctctgtctcctgggtcccggttcaagcaattctcttgcctctcagcttcccgagtagctgggattacaggtgcgtaccaccatgcccagctaatttttgtatttttagtagagacggggtttcaccatgttgaccaggctggtgttgaactcctggcctcgtgatccatgtgcgtcggcctcccaaagtgctgggattacaggcctgagccaccgcacccggccttccttaaaattttctatgtagatgatcatgtcgtctacaaataatgtgtttcttcctttgcaatctgtgtatcttcattttttcttgcccaattccactgactagtttttccaatgtgagattgaataggagtggtgtgagtaagcatcctcttgctcatgatcttaggggaaagcatttggtctttcttcatgtagtatagatcagattgaggaaatttacttatatttttagtttgctaagaattatcattatgaatagatactgaattttgtcatactctctacatctgttaagatgataacagagttttccttttttagttaatgaaataaattttggtgattttcaaaatgttggaaaaccttgcattcctgggataactcacatttggttgtgatgtattatccttttgctaggttgctggattggatttactaatgttttgttaaggatttttgtgtctatgttcatgaaggatattagtctataaatttcttgtctcacatctttgtgtggttttgatgttaggctaatacttcattataaaatgagctaggatgtattttctctttgattttccggaaaggaaaagtttgtgtaaaattggcattatttctaccttaagtgtttggcagaattcaccagtaaagctgtcttggtctgaagttgccttattgggaagattttgaactacaagttcaattcatttgatggaggttatctgtttctttgttagtgaactgtgctagtttttgtctttaaggaaatttgcccattttatattaaatgttgtgacataaagttgttcagaatatttattacctttttaatttccataggatctctagtgattgcttccctcctctttttattcctgataccagttttttgagttttgtctttttttcccctaagactggctagataatttaactgatcttttcaaagaaccacattttgttttaattgcttttccattttcttttttgttaatttttctctttattaatttcattcctctacttattttgtatttatttattttttttaagagcagtcaaacaaagcagtgggagtcaagaaggaacaaagaaatctgtactggttgtgaacagttagttatcaacagcactgcatttgtaccagcctgtttgttatcaacagccttgcatttgtaccagcttgttttggtttcttaaggtggaagtttacatcattttatttgagacctttcttcttttctaatttgtttaattctatacatttcttttaaaatttgcaccaatcacacaggatctataaatctctgtctaagcattcctttagctgcatcccacaaattctggtatgtttttcattctactcaaaatattttataattgcctttattatgatttgttcattgacccatgttttgttcagaagtatgtttttattttattttattttatttttatttttgagacggagcctcactctgtcaccaggctggagtgcagtggtgcgatctcggctcactgcaacctctgcctcccgggttcaagcaattctcctgcctcagtctcccaagtagctgggactacaggcgtgcgccaccacgcccaggtaatttttgtattttttgtagagacagggtttcaccatgttggccaggatggtcttgatctcctgacctcgtgatctgccgtcctcggcctccgaaagtgctgggattacaggcaagagccaccatgcccggcctattttatttttttagacagagtctcagtctgtgcccaggctggaatgtagtggcgcgatctcagctcactgcaacctctgcccgctctggttcaagcgattctcctgcctcagccttctgagtagctgggattacacatgcacgccaccatgcccggctaatgtttgtattttagtagagacagtgttgcccaggctggtctcgaactcctgagcttgcgcaatccgcccgcctcagcctcccaaagtgcttgggttaaggcttgagccaccgcgcccggccgaaacttctaaatgtaactatggattggtatatttatttcaatttctactttaggtattttgagctctgttgttatttaccatttagcactgttatttctaattgttgaattaatgccaccaccatcatcatcagcatcagcatctccctctttgttgttactaatccttgttgtgaagcaaactttgtcttatactgagagccacctagccttttttcattagtgtgtacatggaatatggcttcccaacctttctttttaacctgtctttatcatctcttgtagcttaggagctcttgcctttttaaagtctagtctgaccttctctgctaataattgtagtatttacactctttccatttaatgtaattagtgatctgtttgggtttaaacataccatcttgcattttttctcctgtttttcccatctgttatttgttactcttcttttaaatgaattgaattttttttttttgaaacagggtctcactctgttgcccaggctggagtgcagtggcgagtgatctctgctcactgcaagctccaccttccaggttcacgccattctcccacctcagcctcccaagtagctgggaccacaggcacccaccaccacacccagctaattttgtttttgtatttttagtagagacggggtttcaccatgttattagccaggatggtcttgatctcctgacctcatgatctgcccgccctggcctcccaaagtgctggggttacaggtgtgagccaccacgcctgcccagtgaattgaatattttaagtggctgggcgtggtggctctcgcctgtaaccccagcactttgggaggctgaggcgggcggattacccaagctcaggagttcgagaccagcttgagcaacacgaagaaaccccgtctctactaaaatacaaacattagccgggtgtggtggcacatgcctgtcatcccagctactcaggaggctgaggctggagaattgcttgaactcaggaggcggaggtttcagtgagctgagatcgtgccactgcactcgagcctgggcgacagagcgagactccatctccaaaaaaaaaaaaattaaaaaaaaaaaaaagaatattttttgacccatgtattggtcagaagtatgtttttattatatatatatatatatatatattttttttttttttttttttttgagatggagtctcactctgctcccaggctggagtgcagtggtgccatctcagctcactgcaacctctgcctcccgagttcaagcaattctcctgcctcagcctcccaagtagctgggattacaggtgcccaccaccgcacctggctaatttttgtatttttagtagaggcggggtttcaccatcttggccaggctgatctcgatctcctgacctcgtgatccacctgcctcgccttcccaaagtgctgggattacaggcatgagccaccgcgtctggcctatgaatattttaaactctttcattttgtctcctgttgaccttactacctgtatttctttttctttgttttataattttttagctatagcttccacttttcagcctctactctcaaagaatagtataccacttcacatgtagtgtaagtaccttacagtagtatacttggagcgccaccatttctggtgctaatgtagtcgtgtgtttttcttacatgtattatacacctcagcatacattgtcattttttccctttctttaaatagcgaattatcttttaaaaagaccttataaataagttcttgacccacatctttatcatgtgtggtgctctccattcctttgtgtagatccacattttcatttggtattattttccctgtctcaagaactgcctttaacatttcctgtaggccagggtagcttctgtttgaaatcttttttgcctttgttttaaaaagatatttctgtttggaatttgaggttgttggtcatttctttcgtggcctctccagtttgtgatgagaaacacgttgtcgtccttatctttgctcctgcatatgtaaggtgactcgttttcctctctgtgcttctgagatttgcactttgtcactggttttcagcagtttgactgtgatgggcctcagcgtgctttgctttgtgtttagtgtgctttgggttaattgagcttgcagtgagtgtgggcttacatagtgtgaatttatagtttcctcaaatttagaaatatttcaagtatttcttcacgtagtcccctttttttctgggatgttagacatcttgagtttgtcctacaaatgctttgtccattttttcagtcttctctgtgcttcattttggatttatttatttatttatttatttagagacagtcttgccctgtcgcccaggctggagtgcgatggtgcgatctcggctcactacaacctctgcctcctgggttcaagtgattctcctgcctcagcatcctgagtagcggggattataggtgcccgccaccatgcccggctttttttttttttttttttttgagacgaagttttgctcttgttgcccaggctgaagtgcaatggtgtgatctcgtctcactgcaacctcctcctcctgggttcaagtgattctcctgccccagcctcctgagtagctgggattacaggcgtgtgccatcacacctggctaattttgtatttttagaagggacaaggttgctccatgttggtcaggctggtctcgagctcctgacctcaggtgatctgcccaccctcggcctcccaaagtgttgcgattacaggtgtgagccactgcgcctggccaatttttgtatttttttgtagaggtggggtttcaccatgttggtcagactggtctcgaactcctgacctcaggtgatccacctgccttggcctcccaaaatgctgggattataggcgtgagccatcgcgtctgggctggattatttttattgcctgtgttcaggtttattggtattctgatctgcttaatctgccaagtgtgtttagtgtatttttttcttttatgtcttatttctcagctctggaagtttcatttggtttatttatttattgacatcttcagtttctcttcccatcgtgtttatttttcctctgtttcttgaacatatggagtttctttataattgccaatttcagattcttgacagttgtatcatctctatttttggggagatctgtttctttttttcttttttatttttttgagacggagtcctcagtgtgtcacccaggctggactgcagtggtgtaatctcggctcactgcaacctccgcctcctgggttcaaacgattctcctgcttcagcctcctgagtagctgggattacaggcacgtgccaccatgctaatttttgtatttttgtatttttagtagagctaaaaatactaatttttgtatttttagtagaggtggggtaatttttgtatttttagtagagatggggtttcctcatgttggccaggctgctctcgaattcctgacctcaggtggtcccgcccgcctctgcctcccaaagtgctgggataataggcgtgagccaccgtggctggactggggaatttctttctttctttcttttattgttttgagacaatgtctctctctgtcacccaggctggagtgcagtggcacgatctagtctcactgcaacctcccctccccttcctcggttcaaacaattctcctgcctcaacctctcgagtggctgggattgcaggcttgtgcctccatgcctggctacattttgtatttttagtagagttgggattttgccatcttggtgaggctggtctcgaacacctgacctcaagtgatccactcgcctcatcctctgaaagtgctgggattacaagcgtgagccactgcacctggcctgggggatctgtttctattgattggcttttcctccttcttaggagtcattgtcctgcttttggtttcgttactggatgctggacattgtgaattttacattgttaattgctggattttgttatttttcttttaaattgtgttagacttgggtgaaacatgactgaggttaaatctgtatatgatgagtgctataatgggacacatttaaggatttaatatgtagtcatcatgtaccctattttaagacttactttcatgtcttgtctccaggaaatgttgctttcccaagttcttgattgcttttctgagtgtactgcgttccagccatgatgataggcactgatgtaccatagtgagcaagtagataggttctggctctcatgaaccatgaattccagtgttgaagacacataaaaaaacaagaacacagtagaacaccaggatttcagatagcagtttaatagaggagattaactggggtgtttaggttgatgggtaagctagagctcaggagatgggcaccgcgctcataatcagaacaaacacatttttaacataaagaataattagcaagtggcagggtgtgtggctcatgcctgtaatccagcactctgggaggctgaggcaggcgggatcgcctgaggtcaggagttgggagaccagccttgtcaacgtggtgtaaccccgtctctactaaaaatacaaaaattagccaggggtggtggtgggctcccgtaatcccagctactcaggagaatcgtttgaacccaggaggcggagtttgcagtgagccgatatcacagcattgcactccagcctgggcaagaagactgcaactccgtctcaaaaaaaaaaaaaaaaaaaaaagtaattaacaagtagcgacaggtcagccacccagatccgtgaagtgaatgctaaagaatatggccggggcagatttagggagcagccactaacgggagcttagggaggggactcaagaaaggaacaaacttggaagaggccctgacatggagggggtgtcattatgccccactgggtagcagagaggctccctgaggtcctgcaggctgggactgagtgctggagagtgcgtgcctctcagtcccccacacaccactgatgaggagctgcctcagggtaagagcaagatgagaaaagcacaggaacctggagggagaccccttcttcttcaccgtccctgtagtaccctccacccataggaccacacattgtacctacctgctggcagaggagaaatgtttacagggtgcagctccttcattgtaagtgtggcgaagaagggtggatttggagttgagaggcaaaaaaattaattgactcaaccagcctccctcagtaggtgatctttttgctgaggcctgatgggacagtattctacagtctaccagaagccaatcagaggctcactgactaagggtacgaggcaaagggagcaagggcagtgacttaaaagcagaactttgacctgagcaaccttgaaagctgtggtaagaaatacggtgtttgctcctaagtgaagtggaggagaacagaggttttatgtagggagctctgtgatctcactctgctgctgcttggagaatggatgattagtacatacggaaataggtgtgccactagagagagccagtgcagctgtgcaggcaagaggtaggtgatgatggcttagactgggttggaagcagcggaggaagaatgggtggattgtggaggtgcttaggattgaggtggagtggacaactttgctgttagatgggcgtgggatggaggagagcgtgaacctcgcttgttgaagggaacggactcgcttagggaacagcctcttctaccactgccctctccttgccctaccatgcctcttcagtcagaactccatggccttccagccacttttggtattggaataaccacattttcaggtactcaggtccagtctacataaaaacctaaatgtggcttagtgtggtggctcacgcctgtaatcccagcactttgggaaatgaaggtgggcggatcacttgagctcaggagtttgagaccagcctgagcaacatggcgaagccctgtgtctaccaaaaatacgaaaaattaagccaggtgtggtggcgcatgcctttggtcccagctactcaggaggctgaggtgagacgattgcttgagcctgggaggcggaggttgcagtgagctgagattgcaccactgcactccagcctgggtgatagagcgagaccctgtctccaaaaaaaaaaaaaaaaaaaaaaaaaacctaaatgtctcatctaattaattcaaagcctcttcccctcatgttaagtgatggcaggagtccccaagggcagagggcggtggtgtatgtcctgcttccttatgcctgtcctgttcctccaggatggagaaggggcactggagcggagacttgggggtctttgttctctgctgggttgtctaggttctttttggcccactagcgctaggcctgtggtcctaatgggtggcccagtggttgctggctctttcttgttggtggcgggggtgctgctttagcatgctcaggctgctgcaacaaaatgccatgggctaagctgcttgtaaacagcggacatttatatcttatagtctggagggctggaaggtctaagatcaaggtgctggcagattggtgcctgggaagggccaagctttggttcatagctggtgccctctctctgtcctcgtgcggtggaaggatgtggcagctctctggggccttctttataaaaggacactaattccattcacgaagactccgacctcatgacctaatcaccacctaaaggccctacttcctgatacattaccttaggggttaaaatttcaacttatgaacgggggcgggcgggggcacaaacattcagaacagagcaaaacattcagacctttgggcacttctgagaccttggtagggacttcgtgctggactgtctagtggaaactgtgtgacacaaccagcctgcccccaaccccctaccactgctgtcccgcactctgccccccttccctcatggtgtaattctggggtctgcttccccagcaggacctatttggggtgggattctttcaggatgacacaagctcttaccctcctgtgtgctggcggcagctgagctgggtcccctgctgtcttttttttttgagacggagtcttgctttgtcaccaggctggagtgcggtggcgcgatctcggctcactgcaagctctgccttcgggttcaagcaattctcctgcctcagcctcccgagtagctgggactacaggcgagcgccaccacacccagctaatttttgtgcttttttagtagagacagggtttcaccatgttggccagaagggtctcgatctcttgacctcgtgatctgcccgccttggcctcccaaagtgctgggattacaggcgtgagccaccgcgcctggccggtcccctgctgtcttaatcctctgcccacttagcaacgctcaggcttttctgctgcagggtcttacctgcaaggcctgcaccagtgtctgtgtgacccaactccacagcacctgccacaggcccttgggagtttccttgtgcttggctcagcagcagactggggtagtgcaagcatctgaacagaccttgccaagtccagcccagggtgagccccaggctccttgccacaggccaccacccgtctctctgggggcttgtctcagtggcttcatgcttgactgggggaggggttggtgaggagagcacacttttccttgtggggaccagagtgggaatagtgcaatactcaagacttaggtgaattcctttctggaagtctctcttgtgactgtatttcttttcctcatgctgtgggggtcagggggatgcaatgattatggagctggcagcccctgtcatgagcctggggaaggctctctagcaccctgcatcaccctgtgggcaccctcagctctgagacctgagccctgagcccctgttcccaaggagcagagtccttctcagggcctcttctagaaggagccttggtgccgatggaagggtaactgagcgggaggaggaacctagggttgtgttgtgttctctagttgttgttggtgaaatccttttggcgtgggacataggaaggtctttgcccaatgttctctctctctttttttttttgagacaaagtctcggtctgtttctcaggctggagtgcggtggcgcgatctcggctcactgcaacctcagcctcccgagtagttgagattacaggcgtgccccaccatgcctggctaatttttgtgtatttagaagagacggatttcaccgtgtgggtcaggctggtcttgaactcctgacctcaggtgatccgcctgcctcggcctcccaaagtgctgggattataggcgtgagccactgcccccggccaagtgttctctttcttaagcctccttgttcctcagagcaggcagtgcaggctatgggattccccaggacggagaggcctctgccccggctgcttgatgcaaggctcagagaggccactaggtttctaccatgtgctgtctcaggcaaccgtgggcatatcactttccagaggtgcccactgaggtggtcattgtgtgtgctgattaggacagtgggagtaaaactgttcctttttaaatttaatataaattaatttttaaactttttaaaaaaatttatatagagatgaggtcttgctgtgttacccaggctggtctcaaacgtctgggctcaagtggtcctcccatctcggcttcccaaaatggtgggattacaggcgtgaaccgccatgcccagccgaattgtttcctttttgtatgtatgtgtgtgtctgtgtgacaatgtctctgtcacccagacaggagtgcagtggggcatgatcacggctgactatagcctcaacttcccaggctcaagtgatcctgtcacctcagcctcctgggtagctgggactacaggcgggcaccaacacgcccggcctattttttgtatttcttgtagcagtggtgtttcaccatgttgcccagcgatccacccacctcagactcccaaagtgctgagattacaagtgtgagccactgtatctggccaagatagtttcttttcaatgtttaggttttacagttttttaaaaggcatttttcctgaacagttaataaaaaattgatgccgtgaacattttaacataactggtctattctgttctctttttaaaacagagccaagattttcttcttcactcctcgcttggtggctcccagccagaggccggcagtggtgggaggctcgctctgggtgcacagacgctgccttcagacaccgcatgctcgtgcgaggcctgcagtgagcgcaggtatgtgacgtgtgtgccacgttgctcacacctgtccacaatgacatgcagacctgcatattggagctggacggagaaactgggctaatgtgacagacagcaacaagagtaaggcagttgcttcgctattgagagaaagaaccatatgagtaagacaaaaactgttgctcttgaggaactggcactaggaagcatcctcagaacaagagaaggagtccttaaataatcagaatctaagagcagcctcagtgaatgagaggagcgatgggggagagcctgactggctgcttctcagtggctgaggggagagccctggagctcatctttttttttttttttttttttttttgagacagggtctggctctgtcccccaggccggagggcagtggcgtgatctccgctcaccacaacctccgccttccaggctcaagtgatcctcccacctcagtcccggtatctgggactacaggcgcgcaccaccatgtcgggctaatttttgtatattttatagagatggggcttcgccatgttgcccaggctggtctcaaactcctggactcaaacgattagcccgtcttcacctcccagagtgctgggattacaggcatgagccaccatgcccagcccaggagcacatctaaaaatgctctgtgctctggctcaggaaggaatgcatgtagccaagtgggggccaaagggtgggggcaaagctgcccattaagtaccttggaggtgaaggccaggtcagcagtggggatgtgggtaccctaattgtggacattagccacagatgctcctgtcatctgtgcagtggctaagatcttacgcagagtgcaccctaggagctgtgctggggatgccatcacccccctgcactgacagcagcctgattgccggctcctgggagctgggcaaggtgcaagagcctgggaggtcctctgaggacagtgtgctaggtgaggaagggcagcagattgtggtgactttctaaccttcctgtgttgtctcacagagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggtacatactgccctttcctgttgtggccccatgcaaacccctgccctccctgctgcacttggagccactcctttcaggatgggctttccttacagtgctcagctgggtttgcttagcctttggtgcctgtcaagactgcagcagatgaactggcaaaagtgagccccctaggtcaaacgtcttgaatttttctgattttgatgaaacgctattgcctgtataattacacaagaaatgtttctgtcacttgtttgtgtgaagactgataataataccttcctttttgagtccccctgtgccagggatgatgcagagtacttttacaagcactcttgcctttatcaacccaaggagaaaggccgagttagcccatttatgaagtgaaaaaatgggggctctgtgaggttgggtagcttgtgtatgtgcctgtggttcatgaggccaagacagctgaggcgtgcctggccgtgtggctgtttctcatgatgccgcagccgttcttcagcagataccttatgctcagtaaccacacagaatttgaggtggccataatttttattcttccttatagtttgatgtaactttttttttttttttttttgagatggagtcttgctctgtcagccaggctgtagtccaatggcgtgatcttggctcactgcaacccctgcctcccgcattcaagctgttcttatgtctcagcctccagagtagctgggattacaggtgcccaccactgtgcccggctaatttttgtatttttaatagagatggggtttcaccatgttggtcaggttggtctctaacataatccacctgccttgacctcccaaagtgctgggattacaggcgtgagccactgcgtccggcaacataacatatttttatgttttttgaaatgtttcaaatgaaagcaacttatttgagatggccatttcatgggttgattctcatttgggtttctttctcacattttgaatgcagcacatttgggaggcttttttttttttttttttttcagatggagtctcactctgtcgcccaggctgatgtgcagtggtgtaatctcagctcactgcaacctctgctgcctgagttcaagtgattctcctgcctcagcctcctgagtagctgggattacaggcgcctgccactgtgcccagctaattttttttttttttttgagacgatgtctcgctctgtcgcccaggctggagtgcagtggcgcaatctgggctcactgcaagctctgcctcctgggttcacgccgttctcctgcctcagcctgccgagtagctgggactacaggcacccactaccacgcccagctaattttttgtatttttagtagagatggggtttcaccatgttagccaggatggtcttgatctcctgacgttgtgatctgcccgcctcggcctcccaaagtgctgagattacaggtgtgagccaccacacccggctgcgcccagctaatttttgtatttttagtagagacagggttcatcatcttggccaggctggccttgaactcctgaccttgtgatccacctgcctcagcctcccaaagtgttgggattacaggcgtgagccaccgcgccccgccgggagttttataaactgatgtttgctgtgcagtagattctttcctggaggcagggatagtgattagccatagattaggttaactcattgaattcagccaagtattttcagggtttgacctgtgagccactggtattgcatgaggtccctctctgtggtatgtgcttttattagaagttaggtttccagccaagcgtggtggctcacacctgtaatcccagcacttcgggaggattgcttgggcccaagagttcaagactagcctgggcaacatagtgacttgtctctacacaaaataaaaaaaattagccaggtgtgatgaagcacacttgtggtcccggttgcttgggaggctgaggcaggaggagctcttaagcccaggagttcggtgctgcactgagctaggatcgctccactgcacaccagcctgggcaacagagtaaaatccaaagaaaaacacaaaaaaacaacaaagttaggtttcctagtgagtattaggaaaaaatgtataaccttcacgtcaaacccatgacttcacagcttattaacattgcaacttcagtactttagagtagcagccagtgtgtagttgatgtgcccgcatctgttgaatgtgtgtgtgagttagcgaatgagcttcctagcttcttcagcatattgctgtctctctctttttttttttttttttgagacggagtctcgctctgtcacccagggtggagtgcagtggcgcagtcttggctcactgcaagctccgcctggcgggttcatgccattctcctgcctcagcctcgcgagtagctgggactacaggcgcctgacaccatgcccggctaattttttgtatttttagtagagacagggtttcaccgtgttagccaggatggtctcaatctcgcctcccaaagtgctgggattataggcgtgagccactgcaccctgccccgctgccttctttttatataacttaaaaaaaaatctgtttgcaaaagtatcacatggttatttccttaaatttataaaatacagaaatagacaaaaaaaaaaaagagatctaagtccgacatgctaagagaacagtgacgtgggtgtccagtctgcttctaagtttggttgtctctgtcaaaatttgaccttctgtggctttattttaatagatgaaatgcattctgtttcagaggacagttttttatactagtagttgaaatgacagttgtcatgctcaaaaaattaatgtctgtctgaaatatactaaccataataggaatcccatccatctacactatttttttaatccacattttccataaggcttcacatgttccattgcaagattttacttggcacttgtcttttatagcctaggtaatatggcaatttaaaaatagaacaggtgacaactttcttttcttttgacataatatggtatgtaggtgaaaggatttactatgtaaaatccaggagctgtagtttaatacattttacaactcatttctgttagagtgatgaactcaaactggtttctcctggtgatgggttatggacgaatttttattattacatcagtggttttaggtttccatctagaggctcctggattaaaatacaattaaatttaaccatagcaatgccagtactgtagaatacgttttaaaatgtgcattatcggccgggtgcggtggctcacgcctgtaagtcccagtactttgagaggccaaggcgggcggatcacaaggtcaggagatcgggaccatcctggctaacatggtgaaaccccgtctctactaaaaatacaaaaaattagccgggcgtggtggcgggcacctgtagtcccagctattcgggaggctgaggcaggagaactgtgtgaacccaggaggtggagcttgcagtgagccgagatcacaccattgcactccagcctgggcgacagagtgagactccatctcaaaaaaaaaaaaaaaatgtggattatcatacacatttgtgtcaaaaataatggattatcccaaagtttggcctgaaattcatgaaaatgctcattgcatttgtggcttagtcatgttgcatgtattttttttttcctactcttcagcctacaaattttattttacacacctttattgcttttttggtgggataattgttaaaaaaaaaagataaactgtgtctaaagtttcctcttttgataagcctaatacaaacccatttggattgtacactgaacttctagaaagaaggaaagagcaggctgccgcagatctgcagccaggtggcacctctcctgggatcagtgctttttacttgttaacatataagcctttaaaagagttgtccccagcctcgtgtctgagcatgttgtctggggccagctgctgagaagtggtagcgtgctcttccagctgtgtgagtttacgcaagtcacccaacctgtgtgggccaaaatgtcccctctgtaaagcaggcactgaacccacacacagcgaactgaattagtgcacgtgcacggacagtgctgtacagagaaagctcaataaatgtcacttgctgttccctagtgacactctgtgccccggattccccatccattaggtggggtgattgtgcttctcacaggtggttatgaggaaggtgactgtgtggtcatctagaggtggccacctgtggaagggcttcagaaaagatgctcactgacatcagagcacccatgggccctggtgggcaggccctggtgaccctcttctctgtgcaggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggtaagagagaaaacgtgtttttctttctgtttggatgagctgaagagaagcatgtggcaagaggaagcttctcacgcatgtgtgccgacctcgctgtcacacccccacacactgtgataggcccctcttctctacgggagaggacctgtttcctctcctctttgtctttcctctggactttgccactggataaaagcattgggtggattgataagcaggtgacacctcatggtagtactgtttggaggaccttgaggcccagggaacgaggcatgggggcagtgtgaggggagcactgatgtgtgcctttataaggagacagagaaatctccggtgtcttacttaggttgttcattctttcgttgctgtagacagagctggtattaggtgaaatgcccatgaagagcatgaaggctgtagagaacagcttgtttaccgcccagtggcgttcattcattcatgcaggcatgcatgcactcagcaagccagcactgagttaaggatctgcttgcagtctcaagacaggccctatcaccatccttgccaatggggatctgacagtcctaacaaaagagacacacagatgggtccggttgcctcaaaagaggaatcactacattgggtggaaggagcatggtatagaaatatggttacaagtaggctgcggtcaatcctcaacagcctcagtgcccccacgctttggaaggagaccagagacaagccctcaaagcttccttgactgttactaatagtctatggagtttttcatcacttaaactttattattaaataatacttaactgtatttgggtgctagttttgggtgctttctttcttttaataaagaaaaggaatttatttctcatggttaggaaggctgagaagtctaagtttgaggggccacatctggtgagagctttcttgcaggtggggacttggactctgaacagagtccaaaggtggtacagggcatcacatggcgagagggctgagcatcagttttgggtgctttcttagtggtaaacctacattttgaaacaaatacagtaagcattggccttggtctttatctgattctcaagttgatggaccctcttagaaaaatttacatacagcccgggtgtggtggctcatacctgtaatcctcgcactttgggaagccaaagtgggaggatcacttgagcccaggagcttgagactagcctaggcaacatggggagaccccacctataccaaaaaaatttaaaattaaattaaccaggcgtgatgacgcatgctactcaagaggctgtgaggcaagaggatcatttgagctcagggttgaggctgtggtgagccagtgtactccagcttgggaatagagtgagatcctatctcaaaaagaaaagaaaaaattacatacatgtaattgtaagtcatttcagggggttcacagacttcctcaagcttcactgcgccaagccatggggaggtatctattctgagaagaggtagcgaggtgaatgggtagggtgaggggtgggggtggggcaggggggcagttatcctgtttcaaggtctgagtccactgggtagtgccaccaggcttccttctggtacctcgtccttcctctggcatctctcgcagcacagcctccccgtctctacctgagagtctgcctgcccttcagaggttcaaatccagagcccctcctctgtcttctacaagaacactggctcaggttaagaaggatgctctccagcccacctaaacctggtgcccagagagactctggtagtgaagacagcagctgttgctgctctccagaaaatgctggcgaggtctgcacctcctcagatagttactgtaggatactgttttatgaagctgacaaaaattaatttgaaccatatttattagagcaaattcctagcagttgacatagaaataatttcttgtggcttgaggccgggtgcggtggctcacgcctgtaattccagcactttgggaggccgaggcaggcagatcacctgaggtcaggagttcaagaccagcctggccaatatgatgaaaccccgtctctactaaaaataacaaaaattagccgggcatggtggcgggcgcctgtagtcccagctactcgggaggctgaggcaggagaatcacttgaacccgggaggcagaggttgcattgagccaagattgtgccagtgcactccagtctgggcaacagagcgagactctgtctcacacacaaaacaaaacaaaataaaaaagaaataatttcttgtggcttgaaaaaaatgcatacacccagaagctgtttgattagtgtcttttttcacttcctttacacatagaaatacccacattgatttctaggggtccagcagactagatacccttaactattccttcctccaagggaaacaactgaatttactagataataaaaaaataagccaggcgtggtggcttacggctataatcccagcactttgggaggccgaggtggttggatcacctgaggtcaggagttagagaccagcctggccaacgtgatgaaaccccgtctctactaaaaatgcaaaaaattagcctggcgtggtggcacgcgcctataatcccagctacttgggaggctgaggcaggagaattgcttgaacctgggaggtggaggttgcagtgagccgagatggggccgctgcactccagcctgggcaacaagagcaaaactccgtctcaaaaaaaagatgaaatcttttaaagtgtatggctgagatggcatgaaagggagtaagtcgtagtggtgaaaaaccaattgaaagctggaatcctgagaaatacatgggcttgaaagtcagcatttgctgtgggtatttcttctgatcctgggagacaagagacaacctagcccaggatggggtctgcacataatgctgggactgtaagtgacgacactagtaaggttgaagtggaaactccgagcaccgaaagggacagcagggatctgcagctctcgtggccttggggtggagatgcagggagtacagcttcccagagacttggtagctgtcagccagctgccacatgagctggagtgtgaataaatgttggtgtggtatgaacagcccaagcctggaagttactttacagtggtccaggattgctggtaaagtcaggcagcatgcagatcacctctggaaaccttcaatctgacctcagagaattcgaatagataaaatccccccaaatgagcagctcacagtaaaaaaagtcataaaacacaaggttcatgacagcacagttaaaagccagcagaagcagtagacagaatcacataacaaagatatttaaattttcaaaaaagaatatagagtaactttgttaactgtgcttaaagaagctttgtaaaagtttgaaattgggagttaaggattaatactctaaagaatgataattcagatttgaaaaaatatcaaaactagaaacaaaaactttttttagagatgatagctgagaaattctcagaattactgaaaaatactagtgttcagcaaggaaacgtatcagatttcccaagtaagatgttgaaaaatccttctctggttatagtataatgacagctacagaacatcaaagaaaaagtgatctcaaacacaaaacacaggactttgttgaaaatggtctgtgagatgttataatgtgtaattctggattctgggtagagactacaatgaatctatgtactccttacccagatgcgcagttaatcagcattttgccactctgacttcattatgccttctttttcttccactttctcttccctctttttgatgcagtattttagtatgggtcccagacaatgtgctttttgtcttagaatattccaataagtgtctctaaaaatagtcatccattatcttctgtagccacagttccattgtcacatccatgaagactgacggtaatagtaatttcttaccgactaatgccagccaatctctttttatggttgggttattccaatcaggacccaaaaatcttcacaaattcatagccacattattacactgccatccagtgatctatgcagcaccagcttaagataaactcggtgtctcagggcagtaattctcaacagttttggacttaggcccctttatacttaaaaatttaggaccccgaagtgtgcttttttatgcagacttacatcagtacttgctgtattgaaattcaaactgagaaaattttttaaatgcttattgtcattttaaaaatgtaaactctcattagattacataaattgcatattttaacatatattagagaatgtaacaaataatacacttttacattagataatgtaacataaattacatatgtaaaaataactattttccaaaataaaacattgttgcccaggctggagtgcagtggtgagatcttggctcactgaaacctctgcctccccagttcaagcgattctcctgccccagcctcccaaataactgggattacaggtgcctgccaccacatctggctaatttttttgtatttcttttagtagagatggggtttcaccatgttggccaggctggtctcgaactcctgacctcaggtgatctgcccgcctcggcctcccaaagttttgggattatgggcgtgagccagcgcacccggccaacatatttcttaagaagagtgggtcactcacacctctccagatctctctgtaaaagcagtgggagtctcatctgcattcagtctgttgtcataggttgtctggttgaagttattgaagaaaattcaactttttacagataatgtagttggaaaaaggacgaatttttttttttttgagacggagtcttagttggaaaaaggaataatttgtctttttgtgttttttttgagacagagtctcactctgtctcaaaaaaaaatctcgctctgtctcgctgtgtccctcatgatctcggctcactgcaacctctgcttcctgggttcaagtgattctcctgcctcagcctcccgagtagctggaactacaggtgggtgccaccacgccaggctaattttttgtatttttagtagagtcggggtttcactgtgttagccaggatggtctcgatctcctgacctcgtgattcgcctgccttagcctcccaaagtgctggaattacagccgtgagccaccgtgccctgccaggaagaatattttaatagcctcttcaaatcctgatagatcttctctgagagtacaccaacgcgggagagtttcttaatggttagttgcgatgtagagtctgaaactgtatcactgaacttaccctactctgttccgttaaaatccacaggctccagctcaccccatgaatggattctctacttatacatggtttgctagtgtcattcataggtcattttgcaaatattgattcactgagtatcttctggatgttgacagttttattaatataaaaaatgatatttgtttatatcagcactgatctcatcagaaagctctttaaatgtgtaggatctttcaagccaacagcagcaaatgcaaattttctaaagttttcttttttgcttgaaagcttagattttatgattagccacagattgtgtcacttgttttctttgaagcaacatgttaatttgctgtgcaaactctgccagctagttagctcttctgaacagcacccccattctacttgtttttgctgaactcactggatactcttggacatagaaaggtattctcagaaatgcaactttactggagaatgccctcacgtgaggtttattccacactgcctgggggatcaaacaggataatgagtcatattttttgtatttactttaaatattaaagtaaaattgggggagtgggcatggtggcccacacctgtaatcccagcactttgggaggccaaggtgggtggattacttgagcccaggagttcaagaccagcctgggcaacatggtgagatcccgtctctacagaagatacaaaaattagctgagcgtgatagtgtacacctgtagtcccagccactccggaggctgaggcaagaggattgcttgagcctgggaggcggaggttgcagtgagccaagattacaccactgcactccagcctgggcgacagagtgagaccctgtctcagtcaattgaccaatcactcaatatttttttaaaagaaatctaaaaaataaaataaaattgtcactaggcttaagttatgcttctagtcatctaggaaacacctcaccaggctataatagtgaagtctaaattttcatcgacaaagacagaaagatctcaaatgtcccgttatttcagtctattgtaggaactacattctaaacatcttctcttccttctttcaaacccccaaaccttttttgtagtgggaagtgagaacagtttgcagagcctgcccttaggtcactgacaagcctttctgcctctagctcagcagttcttccataggcctcacctctcgtaggagctgtgaggacacatcctgcagagcccacccctgcatgccccggtccagttatttgagcccctctatgctggttccacgcctgtcgatggggcatgggcagggcactaccaggttcacagggaacttactggaggcattgaattcagcgctaaggacagtgcctggccatgctaggcactcaggtgttaacatgtgttccttaagtaaactccaagttgatttccggttgtgaagtgagtctgatatctgtttgtcttgcatgcctcacctagaggtgtaattttaggttttattaaaaatgccaaatatcttcataaattagccttcacccagtgaccattagcaactggcccagaaagccagacttgtgattccactcatagacaggcaggtggaaatggctatcccagaggtttccaagggaggccaggcaaagcctcagctcttccaggaggcccctccctcagctagttgccaacctggtctgatccaggtgctgcattcactctcatgtactctttgtcttgtagctgaatcgtaagtcaggtcactgcctactcttctgttccccgggaactcctggagagcagcggactattgtagcaggaggtagtcttcgtgtcctcgtacctggcacagggcctgggcagcatgggcttggcatttcacctgcttattattacaagcacatttgtgggttccagcctggggctgggtatcagttacctggccctggtctcctgccacgtgcatttttcctgtaccgagtgtgcttgctctgagataatgcttggtgtgaaacaggagtgatgatgtttcaatctgggaggcactggtgaaaacacgatgaggaaaagtactggaaatgttaacaaaacggaaggttttagattttctgcagatggcatagattcattgctgaatctctcaattcttgtgtttccaggtatgaaaacagagctgtatccagcaaggctggcacacagtggtctagcagtatcactggtgtgctctctccaaatgtgtttataggtgtttactttcaatcattataatcattataatttgttctctcagcccccataccaactagggttattaggtgacataacagtgaaatctttgtgtcgttcatttgctaaggtctccatcaactcagcttggctatattgtaaacaggagcagacctctaaacccagtccctgtgagtgacccgactcaggagacgtggagtagccaagcatgatgaagtgcagcttccagagctggcggttgttgaagtcaggaacattcacccaaagatgtaacgtgatctgaacacaagtagtgtccgtgtagttgacagagggaagcatggattcacacacgcatggttgtagcaagacttattaaatgtgaacattacatttaggaaaggtaataatggcatcaacctcagtgatcttgtgttgggggcttgctgtacatctctgctgacatcactctctatgatgactgggacacttctaggttttcgtggtattatctaaagtaattgacaagtttgcctacatttattaggaagacaaaaaaccttaactctgatagggtcttgcaagtggagaaattgtgtgtattaattagaatggaaggtttctccaaataggtaagaaaattgttatcctttagcatcgagggacttgatgtatctaaactgtttgaactgtaagggctttcattacattttaaaagtataattgtgagaaatgactctcaaacgtgcagttactgctttgtctctgtgcacacctgtcaccctgtctttgcagcccttctaaacttgccattttagaggggagatgtgctgaaatccatgtccgtgtagtcagagttctgatgcactgtgtgccttgagacatacagggagcagcacttctcataagctgaacactctgggcctgtgaagagggatgtgtgcgtggtggggggaaatggggaggggggagggaatccctctgggaattttctagtctttagcaattcactacatcttctgtttatcttttactttttcttaaccaggaaaatgaacacttgaaaaagttccaagtgacgtgggaactgcataataaacacctgtttgaaaatctggtcttttcggagccacttcttcagagcaacttgcccgcactggtgtcacagatcaggtattttgccttaacccgtatgtgtctttgtggtgtgacagcacagtcttttctcctgactggtgtgcgtgtacccgagtaccactgagtatgaaagttcttgcaggaaaaataacagggcttaaagaaaaagatagtttgggccaaaagctcaaaacctgagaagcaatacaattaaacttttaaatgataagtcaatataaatgctactaagatttaacaccacaaattcctcatacagaaaagctacagtaaatatagcacttttccttgacaagacctatccttggccgggcagctgtggtgtggttcatgctatggctcttggacatgtaggggaaatggaggagggaagaggcccaggtctgagggtgcccaaggccctccggatacagcttggtgtttcccacacattccgttgctacccgaggctctgttgctctgtctcctggtgtagcgcatccatgtggcttcttcacgcttgggaagctggctgggttctatgctttcactgagaaaaaggggtgcagagtgcagcagtcactcactgagtatttgctcggggtcagagtgagaagatttaggctgggcatgtgtttgccctgtggtaccatgttcagttagaaggcatgttcctcctgatgtgacgttactcagcagaacgctgttccctgcactgagtcatgcatgagctaccacaggtctgcagtttggtgattttgttctttggtgttttattctatttaccacatgtgagcacattcccataatacagacccatcgtgacagcagccatctacatttgaccacgttaacctatacttaggggtgtggtggctcacgcctgtaattccaacactttgggaggccttaagcaggcggatcacctgaggtcaggagtttgagaccagccttgccaacatggtaaaaccccgtctctactaaaaatataaaaattagccgggcttggtggcacatacctgtgatcctggctacttgggagtctgaggcaagagaattgcttgaaccccagaggcagaggttgcagtgagccaagagtgcaccactgcactctagcctgggtgatagagcgagatgctgtctcgggggaaaaaaagtcgttagcttcacaaagcaagggaataaattgttgttctgttgactacaccagttattgctattttatttattttatttttgagacagtgtcttgctctgtcacccaggctggagtgcagtggcacaatctcagctcactgcaacctccacctcccaggttcaagcgattctcctgcctcagccttctgagtagctgggattgggattacaggcttgcaccaccacgcctggctaatttttgtatttttagtagagacggggtttcaccatgttggccagggtggtcttgaactcctgacgtcaagtgatccacctgcctcagcctcccaaagtgctaggattacaggcatgacccaccatgcccaatctgctttttttctcttaaaatccgtatattaggactggtacggtggctcacacctgtaatcccagcactttgggaggccgaggcgggcagatcacgaggtcagatcaagaccatcctggctaacacggtgaaacctcgtctctactaaaaatacaaaaaattagccgggcgtagtggcgcatgcctgtagtcccagctacttgggaggctgaggcagaagaatggcgtgaacccaggaggcggagtttgcagtgagctgaaatcgtgccactgcactccatcctggaccacagagcgagactccatctgaaaacaaaatacaaaaacaaacaaacaaaaagaatacgtgtattgacccagtctttgtttcctgtattcccaaattttatttgaggggtcctgaccatctccacttcataaccttacctctagagaaagcaattaggtaaaagagaattgaggacaaaaagatcagaagctacacgtgctggctcatgcctctagccccggctacttgggaggctgaggcaggaggattgcttaagcctaggagctggagaccagactgggtaacagcgagaccccatctcttaaaaaagaaaaaaaaagggccaggtgcggtggctcatgcctgtaatgccagcactttgggaggtcgaggcgggccaggtgcagtggctcatgcctgtaatgccagcactttgggaggtcgaggcgggcagatcatgaggtcaggagatcgaaaccatcctggctaacatggtgaaaccccgtctctactaaaaatacaaaaaaaaaaaaaaaaaaaattagctgggcatggtggcgggcacctgaagtcccagctacccgggaggctgaggcaggagaatggcgtgaacctgggagcggaggttgcagtgagccgagatcacgccactacactccagcctgggggacagagcgagactccatctcaaaaaaacacacaaaaaaatcagaacaaggtgttacggggcgtgtggccagctggcaggtgggctgcagacccttccagtgttccctgtgccctggcctgctccttagccattccttcccttctgtggccactgtgtatcaagattggaaagtccttactctgacccttgcagaagaaaaggcatcggaagagaattcacagtggtgaatctggaatgtggagtaggctttgtccctggttatgacgttcagattcatcaaaagcacttttcatgagaagatatgcatcttgggagaggggctctgaaaacaagattccagggaatctaccttaaaaaaaaatattttactggtaagccagtgagttccgtcagcctgtcagactgtgggtgggtgactgaaaccggaagtgcatcataaaactcccatctttttttttttttttttggagacagagtcttgttctgtcgcccaggctggagtgcagtggtgagatcttggctcactgcaagctctgcctctcaggttcatgccattctcctgcctcagcctcccgagtagctgggactacaggcgcccgccaccacacccggctaatttttttttgtatttttagtagagacggggtttcaccgtgaaaactcccatctttttctgtgccctagttctggattttccgtttgctcattgggtatgatggtcagactccaaccatgagccacgtctctagtgtggatgctggatctcaagctgcagtctcacttctcacttttgggacccacaggcagttgagggagaaggataaacacagacagggacagaatgaggccaaccagcacgttccctgagcagcactgacgacgccaggacacgccatgcctttgtgctctgcagctgactcccttgtcagcctgagactaattcaagataattcagatttgcattgctaatgtacagatacgcatttaacaattcataaaaattttgctactgattacatacaaacaccccttaaagcttctgcatcctatgaaatacatatggtacaattcacccacttaaaatgtacaattcaatgacttttgatatatttcattttttaaaaattatggtaaagtatatataacataaagcttaccattttaactagtgtatatttcaataacattaattatattcatagtgtttataaccattaccaccatgtactttaaaattttttcctcacccgaaacagtaactctaccattaaacagtaactctccattgtccccttcttttttccccatagcctttgaaagtctgtaatgggcagtttccttcccttgactccccaccattttttgtcttaaaatgtatctatgaaagaactaggccatctgtcctgggggtgctttggtctggatcctgcgtgggcgtgttcacagagcagtttggccacctccatcctctgtcctgcctgagaattggtggtaggatctgaaggttctggacggctctgctcagatcccctggcaggccaaggcgtaggcggggggtgtttctatcagggggtgcatccctcaggcctgcttctctttgttgtgggtatcagtagcccaatgtgggcttcactttaaatatgtattaattaggctaataaaacttacccaaaccaatgttatttcattctctttatcaataataatgtttcacatacacattggtaacattacagtaagcatattttcatgctgctgtcttgtatttgcaagctcaatatttagatggaaacctgtttgctgagccattgatttaattcaaccctgtggatagtccctgtgactcttttgatcctagcacagctttgcttgcagggaagccctgtgcctgcagattgcttttcaattataccaacaaagatatccacaaaccccctcccccacccactttgctctcccttggctcaaaataatctgaattctataacttggaagagataaattcttacttccaggaggagcgggacaaggaacacatgacagggtataatgccgcatcccaacgttccaggtggagcaagtaggggcaggatggaattgggtagaagctggattctgtgtgaagaatggaaaccagtcacggaagagcaaggctggcagagaagaagtgggagaaaaactacttcacgggctgcagtgtggcagatccctggcgccactggagtccatgtcttaaggagttttgtctcctgaggggcagaaacagccttaggagaacagctttgatgttttgaagtagcctcaatccatgtgcgtcagtattgtttctttcctttgggcttccctaaatgactgcccagttacacctaacctctgctgccttccctggagagactgcaataggtgagtgcacagatggcttcagtagctgcaaggttcccaggtgcgatttacctgagggtggagataggtcagaggagaagagggagtcattcctgcccatttcacccatgaaaagatcctaatttccacatagcttgtttattataaaatcattagattgtcattacaaataaaattatgaaaatatagaaaatcgtaaacaaagttaggttttataaataatttagtatttcttatacattttttccctatgtccactatacgtatttttaaacatgctgtagtcatatctttagttaccatgagcatatttccatttcaaaatatatatgtgtatatatacatgaatgtgtgtgtgtgtgtgtgtgtgtgtgtgaatgggtagacataattataaaattggtaacaagtatctggttaccaagtactgattctcctagatgtgccatgatgcatttggtagcttctagtgtttttatgtaaatagtgctgatccttaaccttgcgcagaatctttgtgctcttgatatattataaacatggtatttgattctaagccatccttgtcaagatgtctttattccacttattttggctcacactgatagacttaggtattaggaacatgaattttttctggtaataatctacatgtgtctccacaccactccccgtcctcctcctgaccccagcccccagccttctgtctcccaatcgccatcttgctcagtcttttcagaaatcgaggtgttttttctcactgtccacctgcatgtgtgtcttttgtttcccatttattttctcattttccatcttgccatctttctttttttttctttctttttttctttttttattgaggcatagtttcaccctgtctcccaggctggagtgcagtggcgcgatctcggctcaccccaacctctgcctcccaggttcaagcgattcttctgtctcagcctcctgagtagctgggattacaggcatgtgccaccacacccagctaatttttgtattttttgtagagacagggtttctccatgttggccaggctggtcttgaactcccgacctcaggtgatcccctcgcctaggcctcccaaagtgctgggattacaggcgtgagccactgcacctgaccgccgtctttcttaatacaatataatatagtagacagaaaactgtaactatatttcttcaagtaaatcagattttgttttgctttatttgaaaaccagatctaaattttatgtctcattaagtgttttgttttctctgagccagttgtattttcaagagtaaaataactttgtattcccatatttatttttttatcatttttatttttatctattttaattttttctttgcaattccatatttggtaaactgaattgttaagtcatagtctttagagacatgttgttcagtgctcatttttttcttagaagctgttgtttctttgagcatctccttttttttttttttttttttttttttttgagacagattctcgctctgttgcccaggctggagtgcaatggtgtgatttcggctcactgcaacctccgcctcccgggttcaagcgattctcctgtctcagcctcctgagtagctggggctatgagtgcctgccaccacacccggctaatttttttgtatttttagtagagatggggtttcaccatattggtcatgctggtctcgatctcccgacctcaggtgatccacccacctcagtctcccaaagtgctaggattacaggtgtgagccactgtgcccagctgagcatctcctttttacaagtctgtcctgggtgccttgcatggggatctgttgatccctcacagctccctgctgtggtgcagagtggcaccctgttttccacgttgggaggcgagatgacaaagcaggatagtatcagcaggaagcacatttctgatctctgcttcagagcctttgggttctttcctttgttacaaggccttctctctcctaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcaggtgagtgccacccgggaccaccgcaccccgcgcacatcctcagacggccctgttgaaggcagcaccaagtcactagctttgtcctgagctgcaagccaggaattcccgactgaggcccagaggcgcatgtgggtagcccctgtgtgttagctgctggttttccggaagggatgggaaacctgttggcatcacagatggcttgggcctcctgggcctgaggtgtggtggcagcagttggtcaagttttccttggcctgggcacacctgctgtcactcacacgggctgtcaccaggctctgcaccccaggtaggaggtttttctttttttttgagatggagttttgctcttgttgcccaggctggagtgcaatggtgagatctgggctcaccccaacctccgcctcccgggttcaagtgattctcctgcctcagcctcccgagtagctgggattacaggcatgcaccaaccatgcctggctagttttgtatttttagtagagacagggtttctccatgttggtcaggctggtctcgaactcccgacctcaggtggtttccctgcctcagcctcccaaagtgttgggattacaggagtgagccaccacgcctggtccaggtaggaggttttttaagtccaggagctgtttactgagcactctgctgttgagagctcattgtccatctgtcctagtctagaagggagtgcagacacatgcacaggtggcaggtggctcaccaggtggaagacagaagagggagggcacctgctggaggtggatctgaagggagggcactcaggcagcccaagcctgtcagacagagcagggctttgagacggcgccccctccccccgcttcccacccctggcctgcctgctctcctaaagcagggttgggccaggaaggaattgagagcggccctggtttaaagatgacactagtgtgagcaagggtaaagaaggaatgactgagtttctcttttgcacttcggagactctctgtaggaaaatggaacctgggctctagcctaagacatgtgctggttccatgtctgccctggcatggtgagtgccatgtggatgccacctgtggctccttgtcagtgttccttgtcagtgctgtgagggactgggaagaaggaagggactagcatgtgcttgctccctccgagaattgtgtcattgatttcacagctacaggccgtgttttctgttgctgttctctactgcagccacagggactagagctacaaatggtctgttgtttggattttcgcgggttttctcttactccattcttctgcattctcagcctcccaaagtactgggattacatttgtgagccactgcgcctggcctgctggctttttttgaacctgcatcagcttcagtggagtaagttccaacttcgtcacatgcggaattctgtgctgttgagcttgtcttagggcaggtggccctgagactctcccatgactctgcgcctcttccttggctgctgtacgcacagcacgtcagggtgaggaggggcctcagagatcactttggtcctgggagactccctctgtgtcctgtgcctcatggtggggcctgagagagcagttgctgttttgtgttttcttcaaagtgggtgtattcctaattcatgtttttgtctgtttttgcaaccagagactttcctgctgtggcttgtcactgaccagcgacttcttagcctggactactgtgagagcagggtctggatgccaggtggggagggcagagtctcctgctgcagcagcacctcagcagccttcatctcgtgaggcctggagcatcccaggggctgcagctgtgccatgtgggggcagcacagcagagagggcgctgaaagctgcattcccctctgccatctgtgggtgcaccagcccattttcacaagtttgctgttctggtagagggagcaggagttgggggaagctaggacagtgggcattaaccttctccaggaagtgggcatcttcggcagaggctcttcagggctgtggccgtgcaggagggccagtagtgtgtccaggtcaccactccctgggatgttcttgacttgggtcccagggagaaccctgcacggcagtcaacaccagaatgtcccggatctgccccatgagtcttttccctccctacctgcaaaatgagataattatgttaggtgatgttttagtgttgtgtgagcttttaattccaaataagttttttctgtgttatttttaaaaagtaaaactggccaggtgcagtggctcacacctataatttcagcactttgggaggctaaggtgggaggatcacttgagcccaggagtttgagaccagcctgggcaacatagtgagaccttgtctctacaaaaaattaaaaaattagccaggctgggtgccgtgtgtttgtggttccggccactccagagagtgagtgggggaggatcacttaagaccaagagttagaggctgcagtgatctatgatggtgccactgcactgcagcctgggtgacagagtgagaccctgtctgaaaaaaaaaaaaaaaaagccaggcttagtggctcacacctgtattcctagcactttgggaggctgaggcaggtggattacttgagcccagaagtttgagatcagcctgggtgacatagatagaccttgtctctacaaaaatacaaaaattagcctgccatggtagtgtgcacttgtggtttcagctactcgggaggctgagatgggaggatcacttgagcctaggaggttgaggctgtggtgagctatgatcatgccaccacactccatcctgggcaacagtgagaccctatctcaaaaaatgaaaaaaatatataggcatagggacagtaaatagtccctgtgttggtattgcactgtgggctgctggttactgggtgccccacagagcaggggtccctaacccttgggtcacagaccagtactagtccatggcctgttaggaaccaggctgcacagcaggaggtgagtggccggtgagccagtgaagcctgtcagtgtttatagccactccctattgcttgcattaccgcctgaacttctcatgtccgatcagcagagacattagatcctcacagaagcatgaaccctattgtgaactgcgtgtgcaagggatctagattgtacgctcctcatgagaatctaatgcctgatgatctgtcactgtctcccatcacccctagatgggaccatctagttgaaggaaaacaagctcagggctcccactaattgtgcattgtggtgagttgtataattatttcattctatatgacagtgtaataataatagaaacaaagtgcacaataaatgtgatgagcttgaatcatcccagaaccatccccttgcctcacctggtctgtggaaaagttgtcttccatgaaatcggtccctggtcctaaaaaggttggggaccactgctctagagcacatcccatggcacccacgcagggtggtttattgagagcacagaaggagggaggagcatgagatctcaggccatcagtagacactgtgaaggaaagaccttgagaaggaaaacagaaggcgaggggccggctttcctgcccggctcactctcgtcaccggggctcaagggaacgaagcgcacctgctctggcctcacgggtgcggtaggggaagccaagaccaccctggctgggggcagagatgggagctcagggctctgaagcccagggagaggctgctgtgcagggcggggtttcaagactcccagagaggctgcttgtgggaagcacgtgaaaggctccttaatccaagagtgtctctgttgacgacatagtgccacctgctaagtctctgtcttgccaacatgagctgcagtcaagttgtattgcattaggtcattgaaacctcccaagtgcataggaccctgcctacctttaccaaggaccgcataaaaaaagaggagccccaagcaccttctgggtaggcatggatagccgcccacggtacactctaatggcagcaacggtatttgcctttggcccagagaacgctgtctcagggccctcctccacagtcttgttagtgtttgtagcagtaacagacgtgcagatggagaagctgagtgttggtgaatccactggagggtggcatcagacctggaggggtgtgtgtatcagtccattttcacactgctataaagaactacctgagaccgggcttgatactcacccctgtaatcccagcacttagggaggccaaggtgggcggatcacctgaggtcgggagttcaagaccagcctggccagcatggagaaaccccgtctctactaaaaatacaaaattagccgagcgtggtggcacatgcctgtaatctcacctactcaggaggctgaggcaggagagtcacttgaacctgggaggcagaggttggggtgagctgagatcatgccattgcactccagcctaggcaacaagagtgaaactctgtctcaaaaaaaaaccaataaaacaaaaaacctacctgattctgggtaatttataaagaacagagatttcattgattcacagttccgcatggctggggaggccttaggaaacttataatcatggcggaaggagaagaagaggcaaggcacgtcttacacagtggcaggagagagagagcaagaggggaaatgccacacttctgagccatcacatcttgtgagaactcgctatcatgagaacagcatgggggaaatccgcccccatgatcccatcacctcccaccaggttcctcccctgacatgtggggattacagtttgacatgagatttgggtggggacaaaggtgaaccatatcaatgtgacaggttgacatgacgtcacggcagacgtggaaggtcctgtaatcagggtgtggtagcagcctcgctgcctgtcctcaggacagctctgaccagactggatccccctggcagggaagcataagaggttgctggcctgagtcgtcaagaagtgaccattgtgaagcagacattcagctcgtcccagacagcccccaggaggagagtccagaccccgtgtagatgtgtgtgatcagaaagagtcccttgcaagggtcgttcgaaggcagagtgggctgtagtgtggagatgagttccccatgatagggaatgtggagaatagttggagaggtatttggactaggtgaccatgaggtctcatctcagatttcatttcagggacacatctgtccctgactggggctggtggcctctgtgcctggtattcattgtttaccagggatttgcagagtacccttcatgggaggcacttgtctgcaagtctaagtgcaaatcagccttgcctgtcaacaaagatgacttgggtgtgtcggtgcttcctgtcctggtgttgaacaggagacgctggcctattgcagagaagctttgagtctggaagcttttctgaatggaactcccacctccctttctcctgcatttggtgtttttcttctgtaggattgatgctgttcacttgatttatccctggtgtattagtccattcttgcattgctataaagaaatacctgagactggataatttataaagaaaagcagtttaattggctcacggttctgtggctgtgtaggaagcatggctgggaggcctcgggaaacttacaatcatggtggaaggtgaaggggaagccagcacatcttacgtggctggagtaggaggaaggggggtggggaggtgctacacacttttaaacaaccagatcttctgagcactcgctatcacgagaacagcaccttcggggaaatctgcccccatgatctgatcacctcccaccaggccccatctccaacaatggggattacagtttgacatgagatttgggcggggacacaaatctaagccatatcacctggctttcccttcatgtatcgatataagtttctgaggttgtgaataacttgtaaccttcaggtgacttcagaaaaatagtatagttagtgataacatagggaaaaagatgaaagagaaggaagatgaaccgttaccgagtgctgtgccaaaccccgtgtggctagagcctcactactgcttcctggtgttaccacatctgcagatgacaggaggctcccgagggtctcagccaggcaggcctgttggggtttaggtcagcggtgtcctacgtagcataacatcctgcccctaagagcctggggtgctgtccttagttccacatgtgatggaaatggcagataaagttctagtttcagagattcatttctccaattgaactgtaactaaacacaaaaatgcccttagggaaattcttttactaagactgaaaaatcctttgggaatagtaatttcttcaggtatctgtttcttgaaggtaaacatttattttgaaatattatatatggtattattgctgttgttctagggaaaatggtatatatgtaaaaataacacatacatgttctctctagggagaaaataacagtgtcacttaaaaagtaaagtgtatttctttaaaattgcatgttacattgcttttacaaagagaaaaccagtctcttcactaaagcaaccagaagatgctttttatttttatttatttttttttagacagagtctctctctgtcaccaggctggagtgcagtggtgtgatcttggctcactgcaacctctgcctcctgggttcaagcaattctcctgcctcagcctcccgagtagtagggactacaggcgcccgccaccacgcccggctaatttttgtatttgtagtagagacaaggtttcaccctgttggccaggatggtctagatctcttgacctcatcatccacccacctcagcctcccaaagtgctgggattacaggcgtgagccaccatgcccagccaggagatgcatttttattttcactgtcttgtgaagaaaccatgagaaacaatctgccactaatacaattgagggaaattgagccactttagtaacatccagagaataatagtcattctggaaccatgtatgcatgggtgggaggttgtggggagctgaaaacaacagaaatttatgctcacagttcttgaggccagaagttcagaatcagtatgtcagcagggctatgttcccctgaaggctttgggggcaactgcagtgacccctggagttcttggtttgtggccactccactctccactggagctgttttaatgcactatttaatttaaaacctttgaatgaacattggttgcttctaatcaataacattttagaaattttatactgattcaaaggctttaaaatgttgaatacgtgtaaaataattgagtctctgttcacaaataagtatgtatgtatgtggcaagagagttggtaggttttgtttgtttgtttgagatggagtcttactctctcaactaggcggtggtgtcatctcagctcactgcaacctctgcctgctgggctcaagcagccctcccacctcagcctccagagtagctgggatcacagcgcacaccaccatgcctggctaatttttttttttttttttttttttgtatttttggtagagacggggtttcaccgtgttgcccaggctggaagtttgaaatcaattatttttatgtttgctgtctgaaattcattctttctctgttgtttgacacatacataagcctgcaggtacccaaatttgttccaaaaaaaaaaaaatttccctgaggctgtgaggagagagtcaaggaagaggtttttattgatgttatttatcaaacaactcttacactgtacactaagattttataataactgcagacatatacaatgaaaagggagaattggcaccaatattgaatcttcccatccaagaatatggtatgtcactcttttttaaggtttttaaaaatatattgtattatggttttatagtttgtaaatcttgacccattttgtgcctccatagtctgtagtttgaggggctgctatgaccggcatcttgagtggggaatgtgtgtttaaagcattcatgctggaaactgggaaaatggagatgccctgtgaccagtcatctcgccagatgccggcattaactcttgtagtttttgagttgagtcttgaatctgggagtctaggaaatcacggtatcttctacaaataatgataggtttatctcatcttttccagcatttgtcccctttttttggcttccactaggaccttcagaccagtgtgaataagagcattgatactggcacccttgtccagtcctggcttcgaggggctgctgtgagtgtttcaccatgaagtttgatgcttgccatacagacttttgatactttctagcaaattaaagaagtttacctttatttctagttgatttaggctatcatttaaaaaataaaacaggaagatgtcaaaattgatggtatgatttttcttatatcaatttctgtatgagttaagagtttaggttacctaattttgagacattcttgcgttcctgggatgaaaccctagtagatcatgatatgtcattctttattccattattaaatttattagctgatatttgatttaggacgtgtgtgtgtgtgcgtgtgcgcctgtgtgtgtgtgtgtgtgtattcggacagctatataaaattatttttagagacagggtttcacactgctggccaggctggagtgcaatgacaagatattagttctctgcagcctcgaactcctgggctcaagctctcctcccacttcagcctcctgagtagctaggaccataggcacatgccagtgtgccagctaagttttggcttggtgcagtggctcacagctgtaatcccagcactttgggaggccaaagcagaaggatcgcttgagcccaggagtttgaggccaacctgggcaacatagggagaaccccatctctacaaggaaaaaaaaattagccaggtgtggtggtgtgtgcctgtggtcctagctacttgggaggctgaggtgggaggatcataggcccaggaggttgaggctacagtaagttgtgatcataccactgtagtccagccttggtgacagagcaagagaccttgtctcaaagataattttatttacaaacaaatgaaattttttgtagcggtgggggtcttgccttgttacctagactgttctcaaattcctggcctcaagtgatcctcctgctttggcctaccaaagtgctgggattacaggtgtgagccactgcatccagccaggacttttatatctatattctgaggtataattgagttgtcttggtctttgaggtcttacttgttttgtataaaggttgtgctagcttcatagaatgaattgagaaactctgtgtttttgcaattttcaggaatagtttaaattttctgtcccatgaagggtttgatagaacctaccgtaaaactttggggcctaattcatttttacagggaagaagaacaagaactatagatcttgtctgcctttttcatttatatgacatttattagtgtatttcaggtttccttctccctcgagtcagttttacaaatagaatttggctcaagaagttatccatatcgtttagtaaagggttgtaaactcacacctgcagggctagggaaagtcacggaaatggatgatacagggtagagcggccccagcgttcctgtggtgctcatggccgtcaccaccctcaccttgaaagtgccctcagttgggataggccctagtggagcctggggcatgggtagcgaaggccacacctgtgtgtgcgtgcgtgtgtcctcctgttctctgttaggggcagtccccacttgggtccaacagtcttcacagggccaccagagctgccaggttgtcaagagaagccagaaatctggattattaggtgaaatctcgaacacttttaaaaagaggtgaagtgcaagtcggacaaaatagcccatgagccccttgtttgtaactcttctttagatgttacaaagtatcaacttataaagagactttgtctcacagtttaaaaacaatcttctggccaggcgggcacagtggctcacgcttataatcccagcactttgggaggccgaggcaggtggatcacttgaggccaggagttccagaccagcctggccaacatggtgaaacaccgtctctagtaaaaatagaaaaatgagctgggcgtggtggcgggcacctataatcccagctaactcaggaggctgaagcacaagaatcgcttgaacccaggaggcagaggttgcattgagccgagattgtgccactgcactccagcttgggtgatatagcgagactcagtctcaaaaacaaaacaaaacaatcttcatatgtacccatatcctttctcaatcctgatttttttttaatgttacctttttccccctttttcagccttgacagaagcttacagaaccgactttcggttttattaatcacatatgcttctctgtttcctcagtaatttctctttttgcctttaactcctaacttctttgttagttttgttttgctttgctttttaagtctcatatgcctgttaatagctcttcctttcctgtagtctgagctcttcgtgtggcaggaccgagttgccatcatcttgcttatttctaacacattcagggcacataatgggcattcagtaaatagtgaatgttcatccactgtattgacagatttagtcagaatatcttgatttctctttttactgtttattcatctctgtctttcatgtgagaaaagtacttgtgatgagtttgagtaaaataaagaaatacctgttaacatatttgtagtattgtatctttattctgtttgcagatgatgtttctctcatatatatcattttaagaaagtctcctcttgaaaatgtcttgtataattgtcgcaggtattaaagtttttcttttttttctgttttttacatccccttactagatgacaatgaaaaccaagcagcgcatgttaacagaagactgggagctttttaaacaaagaagattcattgaagaacaggtaagcttgtcaataagagaggcaattaaaggaagtagaaatctgtcctgacagcaaatgacttctctgcatgttgatgtgctttgttagaacagcattggaggaccacattggcatgttttgccagcgttaaaaactgttcaagatggtgtttttaatctcaagataaactaattttcacctatttccttatcttccatatacgcctcaagaaaaacccatgtgtattgagtggcctctctatcccacagcagctctgggtattttgcaaaggatattacctgagtccccacagtcccctatgaggcagatggtgccatctgcagtttacatatgaaggagggtgttagggtgaggttaaggatgttgcctgatgtcccagagctggaatgggggcccagcatccccagacagagcgctcagatctccagacattgccaggtgccatgccttcaacatggcagctggcagatctggactctcccttcctcatcttcctggcggtgcctcctccaggcaggcttgtgctccacctttgctggagctgttgggcagagcttgctagtgatgtcctgtatctggtctgggggcccttggcttcatctggaaacttggcttcccctgatctcccatccacgtgccacatcgactctcttcctgttctctgacacttctctccatctcctttacgaactccaacttcattggtctttctgcaaatattggtggttccctggccttgaccccatgcctgtctccacatttgcatgcccgtggtctcctctgggcaccacaggtatacagatggcaccagtgttgtggcatgcttacctcttccctttccccattctgcatgtgtccctgtgcttttgttgttgttgttgttttgagacaaagtctcactctgtcgtccaggctgaagtgcagtggcgtgaactcggctcactgcaacctctgcctcccgggttcaagcggtactcgtgtctcagcctcctgagtagctgggattacaggtgccagccaccacgcctggctaatttttgtatttttagtagagatggggtttcaccatgttggccaggctggtctcaaactcctgacctcaggtgatccgcctgcctctgcctcccaaggtgctgggattacaggcgtgagccacctttcccggccatcccgtccttttgagtggcccttccagctgccacctgtcccattgccagagtgggtccagagttccttctcctttgaaatgcagatgctcaccttgtctgttagaagttgaggtgccatttcctcaatagctccgaggccgaccccttgccctccacgtgccacttttcattcctacagctctgttctcagtaccttgcaagtaccaagcacatggcagacagggtaaaggccgggtttctgcatcaggtgtgtgctgtgagggcgcactgcagcatgtttgctgaagacaaaagcgattagggtctcctggtacccgagccctttgcagctcagcccccagcttgctgccgactccaggtctgctgcccctgtattcctggtcctgtcccgctgaggaagcagtgcccgtgaacatgatacatgtcagcagaattactgaaaaataatgagccatgtctcggggaagggtcttgcaagattaaagcattttaaaatttcctctagttaaccaataagaaagcagttactggcgagaacaacttcacagacaccatgaggcacatgttatcgtcccggctgagcatgcccgactgccccaactgcaactacaggagaaggtaaggctgggttgtggtgtcagcacgactggcccattggaccttcactgggctgagtggaggcctagaaccgacccttagagagcatggtctagtcttgtgcattggttggcttggtaactgtccttaattcctgatcagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttgtaagttgtgactttgtaataaagtttccgaaatttaagtcgccccagtaatgagaaatacatacagtaatgtccacagaagtatgaacatcattattgtgcttttcatgacaagggaccctgaggtttttaatgcagcttttaaaacatgaaatcagtaaacccaaacttttaacactgtttatctgggaaaaaaaaaacatggtaaattaataaaggccagtaaagaaaaaacatgttggtatgcagagaagaagtgtctctaattccggcctcacatctcctcattctcctaaagggtgaccagtccgccgtctgtcctgtctccctgtcagcccagcactcatgcttgtttcatgtcttgctaagaactcaggtgatcgctttagcaagcagttgaaggtttctgtttttcatgttcccgcatgattagaagtacattgttgtgcagctgtcaccaattcacattgtagttggctgttcccagatttcttcagagttgtgaccctgtcatttggggaggcttcacatgctaatttccaaaagggttgcacttgatcatatgtagttgccaaagtcagcttaggtttagtttacgtgtatcgtagagcacacaggcatcatgttccatgtggaagtgtgcagtgggagagattgttgttcctgaccttggctatgcagcgtttctgggatttctctgaccaactgacttgtgttcattccttctgtctggatttctcatggtgactgacgttttccttcagtctttccattttcaatttgggcttgttctcagacaaaataattctgaaaggactggtttaaactcactgactctcttcatacaaagattgcaggctgctgtttattgccttagagacactgtgtactctccagggcacaagaaagagtgttgacatttttgcagctggctgttatccaacttcttactgaaacataaaaattaaacatatatagcctaatgaaaatttaagatggaaaatttcatccctgttcatttgtcacagctgctgatgtcagttatggtctcttgtgtcacgtgtggtagtggaagaaattggctgtgggagcctttctccttgggccggaactgcccatcaccagttacggggagcctaggttctcgggacatctgggccttcagcagcttgtgatcaatgtcttccaaatgtaaactatgatttgaaaatctccagtgttatcttttcatttgtattgtctctttcttggtgccttttctaagttggttaaaaagaacaatgtgattgtagtcagtgtaccacacagtacttcctggatcttatgggttggatctttacggagctagggctggtgaagcctcctgctgtcacatggagcaaatggctgagttacttcactagaacctcagttttctcatctgtaaattgtgcctatggtcatcctcaggagtgtgtatgagcattggcccaggcagcgtcccaggtgcagtgggcctgcaggaagccctaggactctgcaccttgtgggtgctgtttgtacttacctctggtgagctccagactctagcacgttacttgtaatgtgttgaaaagacaccggaatttggtagtcctggacactcttcactcattctaggaagtgagatcacgacgagttcctagggttttgccttctggaggttgctgtgtgcccaggctgaagatggactcagtgcatgtttttgtggaccttggagcatcttattgcactgagcttaaatgtgccagctcttttaatgcaccagagctgcatcttaagtggtctctgtaggctaaagccttgaaatctgtttaaaattaatttcaggccgggtgcagtggctgatgcctgtaatcccagcactttgggaggccgaggcgggcggatcacgaggtcaggggattgagactatcctggctaacacagtgaaaccccatctctactaaaaatacaaaaaatcagccgggcgtggtggcgggtgcttgtagtcccagctactcgggaggctgaggcaggggaatggcgtgaacctggggggtggagcttgcagtgagccgagattgtgccactgtactccagcctgggagacagagcaagacactgcctcaaaaaaataataaaataaaataaaattaatttcagtaaatttttcatttgcctgttgcttagatgtcttgctaaagctgatatttaattacgatcatgagtgaccaggccatgactggccttaaagcaaaaaaaattagtcttctgttacataagtgcctttaaagttttgttcaactgactatttctgaaaatttcagccctaagttgaaaaagcaaacactaaacagctaaggtttaaaaagcaaacactaaacacctaaggttgccatcggtacccctttaattttaatcacaaattgtgttgtcttgggagtagcagagagactagttttataccagcgctcttcaggtcaaatggaaacgttaatcagtctggttaaatttttgtagtttccttaatatttctacttttggaggtttttctgtttgttttttgttttttactcttccaaatggcacaaatgttaatcttccaagcatttttctcatgttgaggttactaagaaatgttagtggtaggaatgatacttaactaatactctttgtaaatgaaagccgtgatctgtccaggaaatatctgtgcttagtggctggtttactcattgtctttcacaattgaatgacctcacagtgaccatctctgcttgtgtcagttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgaggtatggacatggcttcttcgtagcaacaataaatgacataaaatgatggtctgacattttaatattttatattactctgttttgaaaagtgcaaattacaaaagattgtctttaaagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggtaggactttgcttgctgttttgccaaggatctctttttctgtgtgtattttctctaaacatgagcattactgaatacaaaattattttgtttcccataatttctgaaggttagaactgaagagagtcaaggcatacttacaatctccatttgaatcttgtttttcttgctcgaatatcaatcttgatttcgcaacaccccatagcagctctgtggaggccttttttgtctgtatagaagcaaagagaggagttaaaaaaaaatagtggaatattaaaatttcaggaaaggtttgtttttcctgttcattatctgttcttctgttagccaaaggtgagggtaccttattagctttttttctcagaatttcataaatagatgcttaaacaagtttttggccgggcgcagtggctcacgcctgtaatcccagcactttgggaggccaaggtgggtggatcagttgaggccaggaatccaagaccaggctggccaacatggcaaaaccccgtctctactaaaaatacaaaaattagctgggcatggtggtgggcacctataatcccagctacttgggaggctgaggcacaagaattgcttgaacctgggaggcagaggttgcagtgagccaagattgcgccactgcacttcagcctgggcgacaaagcaagactctgtttaaaaaataataataacaacaataataataagcagtctttaaatgaaagaacaaatgaaggtcaaagtgcttggctgatttattttattaggtaatataaatgtaacactcagatggtaaaggtgatgttgaaaggtctatctgggaagtctgaccacatctccttaccagttttttcttctacgtataatgtttttgatgtcttatccaagaaaactttgcctaacacaaaactgttttcttttagaagatttataattttagttcttagattctgtttgactcagcatttagttattgtgaggtgaggatataaattcaccttttctgcatatatagatatccaattgtttcagtacggtttgtcagaagtaccctattgaattgccttggccatttattgaaaatttattgaaaatcaatggactgtaaatgtaagagtttatatttggacattccattctgttcatttgatctctgtgtctgtccttacacccatagtgcatttgacaattgctttatggtaagtttaggaaaatgggatagggtcttccctccagcttggtacacctttctctctctctattttctttcttttttttttttttttttttttttttgagatggagtctccctctgtcacccaggctggagtgcagtggcgcgatctcgcctcactgcaacctctccctttcgggttcaagcaattctgcctcagcctcccaagtatctgggactacaggtgcacgccaccacgcccggctaattttttgtatttttagtagagacggggtttcactatattggccaggctggtctcgaactcctgaccttgtgatccgcccgtgttggcctcccaaagtcctgggattacaagcgtgagccactgcacccggctggtacacccttttcaaaatcgtttatgctgctcaaagttctttgcattcccatataaattttaggatctacttgtcaactacaaaacgcctccttggatcttgagggattgcatcgaattcttgaatatatatttagaattctccagtgaaatcctctggatgtggttgtggtcttttatttgtgggatgatatagatcaatttagggagaatgcaatcctaacaaaattgagtcttctaatctgtgaatatgctttatctttccatttatttaagtcatctttaatttttctcagtagttctaaaaaaattccagtctttgtgtctggaatatataagtattatgtgttttcattcacagtaaaaggtattttctaattttgatttccaattgatcattggtaatacatagaaatacaattgatttttttatattggtcttgtgttctgcagctttactaaacttgtttattctagtagggttggttctagtaggtccttttgctgttgttttggtagattactttggattttctatatacaagatcatgttgtctgcaaataaagttttagttcttcctttccaatctggatgcaatgcttttaatcttcccttccctttcccttctcttttctttttctttccttcctttcttctttttaagaaacagaatctcactctgtcacccaggctggagtgcactgctgcagtcatggctcactgcagcctcaaacagctgggctcaagcagtcttgctgcctcagcctcccaggtagctaggactacaggtgtattacaactacaggcatgcgccaccacgcccagctttaaaaaaaaactttctgtagagagagggtctcactatgttgcccaggctggtcttgaacttctggcctcaagccatcctcccatttcagcctcccaaagttttaggagtataggtgtgaggcaccatacccagtctggatgcttttaatttcagtttctttttctttttttttgagacggagtctcgctctgttgcccaggctggtgtgcagtggtgctatctcggctcacggcaagctctgcctcccaggttcatgccattctcctgactcagcctcccgagtgcttttaattccttactcttgccttattgagctagctggaaactcagtacagaatagaattgttgcaagcagatatctttgccttgttcccaatcttagggggaaagcatttaatctttgaccactctttaaatgtgatatcaagtataggtttttcatagatgccctttattgggttaaggaaattctattctactcctaatttcttgagttttttcatgatttgaatattgaattgtattgaatattgaattgttcagtttttcaaatgtcttttctgcatgtgttgcgatcttgtggttttcgttttttattttgttaccgtggtgtgtcacatcagttgatttaaggatattaaatcaacctgtgttcctgggataactcccacttggcggtggtatataatccttttcatgtgttcctgagttggtttgctaatattttgttaggatttttgcatctgtgttaatactaataaaatatattggtctgtagtttcctatctttgtgatgtctttgtctgactttggtatcagagtaatactggcttcataggatgagttaggaaatgtttttttcacttatgttttctgaaggagtttgtttaagattgagatttattaaatatttgatagaattcaccagcaaaatcctgtaggcctggtctctttttgtgggaagatctgtaattactaattcaagtttcatttgcttgtaataggtcttttcaaatttcctatttcttactgagtgaatttcaataatttttgtctttgtaggaatttactcatttaaattgtctaatgtgttggcataaagttattctatactgttataatcctttttaattctgcagtgcctgcagtgatgctaattcttgatttgggtaattttatcttccttttaacggcttcagtcacttgggctaaagatttgtcaatttctctgttttcgtttctgtgtcattggtttccattctgaaattgattatttctttctatgttctttgggttttgcttgctcttccttttctagtttgttgaaacaaaagcttagatgactgattttagagcttccaaatttattgagacttgttgatggcctaacatatagtttacctagatcctgttctatgtgtacttgaaaataatttgaactttgttcttgttgtgtggagtgttcaagaaatgaaagtttgatcaaattggttgatggcattcttcaagtcttctgtattgtcttggtctatccaggctaccatgtaaggacagtaaccccattcctgagagtagagccttccaaagtccttatcgcctaataccatcactttggaggttaggctatcaacatatgaattttggaggggcacagatactcagatcatagtatatattcttactgattatctgtctggtggttttatcggttactgagagaggcatattgaagccttcaagtttaactgttggattatttccttctcctttcaattcttccttgttttggttcatgcatttgggggtgatgttattgaattattgttatagctcccctgatatattgccccttttatcattatgaaatgtttgactactggtgtttcttaacgtccgttttatttgttagtatagccactccaccttcttgggttactgtgtacatgtattttttcatccttttactttcagtttctttgtgtctttgaatctaaaatttgtctaacatcttttagttgggccttgcatttttatcctgtatatgtcagtatctgcctttttaaatattaaacaaaaattttagtgtactattttaattcttctgttgattctttttttaattttcttagtggctgctgtagggttacagtatgcatctcttgtgaatgtcgttataaaaaataaaaagaaacaaaaattaaaatacaatatgtatctctttttttcttagagacagggtcttgctctgttacacaagctggagtggggtggcatcatcatgcctcactgcaacctcaagctcctgggctcaagcagtcttcctgcctcagcctccttagtaagctgggactataggcatgtgccgccatgaccggctaagttttttaattttagtagagacaaggtctccctgtgttgcccaagtttgtctcaaactcctggccttcagtgattctcccgccaggaaatcccaaagtgctaagattacacttaaccagtgtacccagccacaatatgcatcttttttttttttttttttgatacagagtctcgctctgtcacccaggctggagtgcagtggcgcaatcttggctcactgcaacctctgcttcccaggttcaagtgattctcctgcctcagcctcccaagtagctgggattacagatgcgcaccaccacgcccatctaatttttgtatttttagtagagacaatgttttgccactttggccaggctggtctctaactggcctcaagtgatccacctacctcagcctcccaaagtgctgagattacaggtgtgagccaccacgcccgcccacaatatgcatcttaatttatcacaatctactccagattactactgacttaattccagtaaaatatacaaactttgctccgcaggagctccatttccttctttctcctttgtactattattgtcctatatataattacatttgtatatgttacaaaccaataatatgttttaattactgctttatacagctttataatttctagagcaaataaaagagaaaaatgtatttatacagtgcctgcctgcctgccttcttttctttcttttccttttcctctctctctctttctctctctctctctttctcttttccttttccttttcttttcctttttcttttcctttttttgagacagagtcacactctgttgtccaggctagagtgcagtggcacaattttggctcacttcaacctccacctcccaggttcaagcagttctcctgcctcagccacctgagtagctgggatcacaggcaagcaccatggcacccggctaatttttgtatttttggtggagatgacatttcgccatgttggccaggctggtctcaaactcctgacttcaggtgacctacccgccttggcctcccaaagtgctgggattacaggcatgagctaccacgcctggcctgtatttatacagtgttttctatttgctagctggctagtcatttctggcattcttcattttaaattctgccgaatttaagttaccgtcttgtttttaccttcctttaatatgtcttacaggaccagtttgctagcagttaattctgtttttgtgtaaatgtctttattttgccttcattttaaaaaatagaccaggcatgggggtgtctcacgcccagcactttgggaggcagaggcgggcagatcacctgaggtcaggagttcgagaccagcctagccaacgtggtgaaaccccatctcttctaaaaatacaaaaattagccaggcgtgctatcatgtgcttgtcatcccagctacttgggaggctgaggcatgagaattgcttgaacccgggaggcagaggttgcagtgagacaagatcgcgccattgcgctccagcctaggcgagaagtgagactccgtctcaacaataaataaataaataataaatagagtggttgtttttaggaatagctttagactcacagcaaagttgagtgagagctacagagacaccctatacccagggtccccacacacagccttcccactatcaaattccacaccagagtgttactcttgttacagtcatcagctgtcagactgttagaacaagcagtcagttctcctggcagcctggctttctcaagaaggtgttttagtagggtctggggtcatcctagggacttggcctttggctgcaggaagccttaggtggtcattgtgtgccagagttctgcagctctcagtatctctttgtttttatccatcttaaggttcactgagcttcttggatctgtagaccaatgtttctcatcacatttgggaagtggagtgtccaggtgttatttggatgctcttccccctttcctctgggacttggttctgcacatgctggagtgctggctgctctcccacaggcctctgagcgtctgcatactttcccctcatctcttctctctcttcctagatcagttccattgctcttcttcaagttcacagatgatttttctgccattttaagtttgcttttgagcccctttagtgaaattttggtttagctattgtactcttcacctatagaatttatattttactgtttttttgtttctctttttttgtagtaattccctatatgttgaatctttattttcatattttcctttaattctctgaacatgttataacagctgctttgacatctttgtgtgctaatttagtatctgaactcactcctgttaaccgtttgactatttatttcctgcatgtgggtcacacttttttttttccagacaaggtcttgctctgccacccaggctgaagtgcagtggcatgattacagctcactggagcctcgagcctggacctcctgggctcaaacaatcctcccacctcagccccccaagtacttgggactacaggcacacaccaccatgcctggatagtttttgtactttttgtagagacagggttttgccatgttgcccagactaggcttgaactcttgggctcaagtgatcttcccacctctgcctcccaaagtgttgggattacaggtgtgagccactgcgcccagcctaggtcatacttctctttaatctttgcttgtctcataattttttgttgaaaattggacattttaaataatgtgataattttgcattatcattttttcccttgagggtcctttgttgtcttttgtttgtttccttgtttttgttatttcctgggcttcagttgcaggacctgtatctcccacattatgtggctgtgggtgtctcagcttacttcttctcttctcctttttagtttggcttctagaggtctgccctttgtccacctggctgattggccagctgatgatttgggcagaggttgcccatgcaccttgaatccacaggggctccattgttggctgtggggtgaatgcgctcagcactcagccagttctcaagtcagctgtgttggccccttcctccagcccgtgaggtgtcctcagtgcatgcactgtgctctcctggtcagccagcgagttgtggacagcttaagaagcccttccgtggcgctctcatttccagggttctctctgttagatttctgtctcctttgccactcaccccagttgggacctcagtctcaagggaacagagctgcaggcttccctattcattcccttctaagttcactgcttttactgcttcaccctctgcctgaccaggctgctgtttttggtagcagggttggtttgcgctgacatccctgcagtcacagaactcctgtgcccactgccgaccgagtcaggggtggagtacaggtgcaggaaatggaaagagtcccagacaagaaagccagacttgctgttcttccttgaagttctagctgatttgcatgaataaatgtgtcgcggtattttccttgggctgatttccagagcctcagaatggttgcctttgacaattgtgttcagttttacatttgccctgagggaaaggagccactgacctcttcactccaccgtaaccggaagtcgcgtctctgctttgttttggagaatccatgtgtgactacttagaagcagtgtgagcccagtggagcacagccatcccctctctactctgtcgtcttcactagttcccttgtccctgctcacatgtgggaagagagattttctgcataggcataggattcagaaccagtggctctacctgagtctgtctgtggaatgaggtacacctttcttctctgtgcgtcttcttcagtctcagtctcttggggtccctcgttttccttgcatggaaggccctggtcaactcagggtgtcaggaaaagcccacttacctttgtatttgctttgtaactacttggcagaatgtgactgactttaattcataccatttattgtttcactaaataggtatgttttttttctttcctcttaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggtaagtcagggcaaaaagggtctgaaagctcactcttcactgagatcctacaggagtacatagtcaaacaaagaaatctgtgaattagcaacttgcataggatagcatctgctctggataggaaggtctccaagtgtttcctttcaccataatctcttaagcactgtaattgtgaacctttacagttgtaacaatcattaaaaacaactgtgaaggtcatagttcttttattcagaattaaatagaacagaaggatttttcaggtgctatttctaacaggttaaacctagggaatatttccacaggagaccagtaatctacttgtgatcttccagggcttgctcttcttcttaatttgataggtaaaataatgtgaatacaacatgagtcctctaacactggctggactctacagggtctaaaatgtctatgctgctttagcatttagaaatacacgagcctaaataaaggaagagccctaagtgtgatgccacagaaaactataacgccctgcaggtgatggagcactggggaggggagggtacagaaaggagaagctgccagaaacccagtgtgaagagcccattcaggaagtggagtgaggatgtagaaataagttgatttttatgcatttcttcccagagaacctcatgtgtatacttagtatcttagactttacagtgaaattcttaggctggtttctttctttggaccttagatagctttgcctctctagttattttgagcttaactttaccagaatgactcaccgtaattctgattgttttcttttttttctttgtaccagttattcttgtccaaaggtagctctaatcagtcaaaaatataatttatttcaaaccctaatttattatttaaaacattgcttttgagctggaacagaaagggaggaggacatgacatggaatgattttttccagaccacagtttttccaaacacatgtgtgttttctcccctctaggggtcactgtgaagtggggtacatgtagcccataagtgaggtttgttgtctctttgctagggagaggcgtaggtggaagattaacagacacaggtttagaatagagtgtaataagtttgccacatctattgtaattacttggcacaaccatccaaattcatgcttaaattttgttagattgaatattgctcagtttgaacttttaatgatgtcttaataatagaatgctttttaataacatttttcaggtatgtagtcagaaccaggctatcttcatggtccgcctggtttgtagcctgattttctctgggtgtaaagtgaggaaggtttccactccctgctgtagcctgaagagagctctattacctagttccaagaaaagataatattctgttagatgtttttgctgctggaagctattcaagaattagttccgaaaaataagtaagatagtaaaattgattattactaaagactgtggggcccctttggttaaaaattgattattttcccgggcttttggccttttcttaggaaattagagatctatatatgggtaaaagaagaaaaacatgttttaggagcatcatttgtatctaatatctgttctcttgatacctgttaaactttaatcatatagaaagatttgaatagaaaagcaaatatggagtcaagccatatacggtagaggtatagaaacttagaaatttataactaaacgttatttctaccacttcagcaaactgaagactattcactgattcatttaaaatatgtggtggccattattatgtggaaacataagatacaattatcaaaatacttcatttgcatctggtatgaaaatgttcgtttctgtaaacaaacttgaattgtcacttaccaggtcttacaagattagtttgtgttatttgacttagtttggcttagttggatgctgttgaccacatctgtgcctaaatgcataatgcgttagcagccctgaaggggtctcctggtccaccagtgagttgtggacagcttaagaagcaaatgagctatatcagaattgcacaaatttcagtgacattggaggaagtttcttagagataatcaacagcaggattgttgggcaagaagttctgaatgtagggagcagaaggtgggtgctgaacgtggagggggccttgtgtactgtgtctgccatcacttttgcattgttggggccttggggagtttctgctgtgctggggtcacagtttttgccttttggcacattatgtcattgtagttgtaattcttataattcatattttaggctttgtgggtaaatatttagtacctaaaaagtttagcatgggtactatgaaaaatttattttctggctggttgtggtagctcacgcctgtaatcccagtgctttgggaggctgacgtgagaggattgattgagcctgggagctcaagaccagagcaacatagtaaaaccctgtctctaccaaaaaaaaaaaaaaaaaaattcttgaaattaaaaagacttgaagactaatttctgttttcaagtgtctccataccagtgacataccgaatttatatatggagtataagttatttgaaagttcaaagtattgctgagaaaaatacagtaatgaaatactacataaaataaaaactgtaagtgccagagaatttaatttccaaatatttggggatctcccaactatctttttgttactgatttctactttaattccattgtgatctaaaagcatgcagtgtataatctctggttttttgagtttattaaggtatgttttatggcccagaatttggtctgtcttggtgaatgttccgtgtgagcttcagaggaatatgtgttctgccgttgttcagtgaagtggtcttcagatgctcattatgtccaattgattgatggtgctcttgagttctgtcagtcagcaactatgttttgactgattctctgcctgctggatctgttcatttctgattgcgtgcccttgaagacttccattgattcatcggtttctccttgcacagttctatcagcttttgccctacaaagtttgatactctgttattagcggcacacacattgagaattgttacgtcgtcttggagaattgaccctttttcattatgtaatgctccttactaccactggtaacttcccttgctctaaagtctgctctgcctgaaattaatatagctcctctagctttcttttggttagtgctagcatggtatatcttccttcattgcttactttttgaaaagatttattatagtaaaatatgcactaacataaaatttacaatcttaaccatttttaagtgtagaattcagtggtattaaatacgttgataatgttgtgcagccatcatccgtctccataactcttttcatcttgtaaagctggaggtttttacctgttaaacaataactccacttctcccagccctgggcatccattattctactttgtctctgtgattgtgactactctaagtacctcatgtacatggaattgtacagtatttctctttttgtgactggcttatttcacttagcataatgtcctcagcgtttattcatgttgtcgcatattgcagaatctccttcctttttaaggctaaataatactcatcatatggctgtaccctattttgtgtctccatcagtgaacacgtgttgtttccatacattagctactatgaacagtgctgctgtaaacatgagtgtacaaatatttcaggaccctgctttcagttgtttggggtgtgtacccggaagtggaattgctagatcatatggtaattgtatttttaatttttggaggaactgccaccgtttcctacagtggctgcaccattttacattcccaccaacagtgcacaagggtttcagtttctccacatcctcattaacacttgttattttctgttttgcttttttaatagtaaccatcctcaaggatgtaaggtggtatcccattgtagggctttttgtcttgtgtaaatgaccacagatacattgtagttttgatttgcatttccttagtgtttagtgatgttgggcatcttttcattgttcattgactattcgtatatcttctttggagaaacatctattcaagtcctttgctcgtttttgaatcaggtttgttgttgttgcattttagttctctttctattctggatattagtcctttatcagatatatgatttgcaagtattttctcccattctgtgggttgcctttttactctgtcgatagtgtctgttgacgcacaacatttaaaaatttttcagccaggcacggtggctcacgcctgtaattccagcactttggaaggccgaggcaggcggatcacgaggtcaggaggtcgagaccatcctggctaacacagtgaaaccccgtctctactaaaaataaaaaaattagccgggtgtggtggcgggcacctgtagtctcagctactcgggaggctgaggcaggaaaatggcgtgaacccggaaggtggagcttgcagtgagccgagatcacgtcactgcactccagcttgggcgacagagcaagattccgtctcaaaaaaaaaaaaattttcatgcagtccaatttgtctattctttgttgcctgtgcctttggcgttacatccaataaatcattgccagatccagtgttgtgaagcttttgctctctgttctctcctaagagttttgttctttccttacatttaggttggtaatccattttttagttcatttttatatatggtgttaggtaagggtccaacttcattcttttgcatgtggatattcagttgtaccagtaccatttgttaaaaagactgcccttttcctgttgaaggatcttgccatccttgtcaaaaatcatttgaccatatatctgaagttccagttttgggctttctgttctgttccattggtctgtatgtcatgctgataccacacagttttgattgctatatctttgcagtaagttttgaaatcaggaagtgtgagtccaccaggtttggtgggtttttttgttgttttgttttgttttgttttgtttttgttttttttgtagagattgtttgggttggccgggcacggtggcttacacttgtaatcccagcactttgggaggctgaggcgggcggatcacgaggtcaggagatcgagaccatccttggctaatacagtgaaaccctgtctctactaaaaatacaaaaaattagccgggcgtggtggcacgtgcctgtagtcccagttactcgggaggctgaggcaggagaatcacttgaacccgggaggcggagattgcagtgagccaagatcgcgccattgcactccagcctgggcaacaagagggaaacactgtctcaaaaaaaaaaaaaaaaagattgtttgggttattcaggatcccgtgagattctatatgaatttagggtggatttttctatttcttcaaaatacatcattggcattttgatggggactgcataactgcattgaatctgtagatcactttgggcagtatgtacattctaacagtattgtcttctaatcaacaaatatggtatgtgttttcatttatttatgtttttttaatttcttagagcagtgttttgtagtgtgtgtttgtttgtttgtttgtttgagacagagtctccctctgttacccaggctggaatgcagtggcatgatcccgctcactgcaacctccacctcctggtttcaaacgattctcctgcctcagcctcccgtacaggcacgtgccaccacgctcagctaattttttgtattttaatagagatggggtttcactgtgttagccaggatggtcccaatctcctgaactcatgatctgcctgccttggcctcccaaagtggtgggattacaggcgtgagccaccgcgcctggcctgttttgtagtttttatgatacaactcttccacttctttggttaattcccgttggtgttttgttttggttttggtggttttttttttttttttttttgagacagaatctcactttgtcgcctacgctggagtgcagtggcatgatcttggctcactgcaccctccaccacccaggttcaagcgatactcctgcctcagcctcctgagtagctgggattacaggcatgcgcctccatgcctggctaattgttgtatttttagtagagacggggtttcaccatgttggccaggctggtctcgaactcctgacctcaagtgatccgcccgcctcggcttcccaaagtgctgggattacaggcatgagccactgtgcccagccctaaattattatttttgatgctgtcgtgaatggaattgttttcataatttccttttccaactgaccattgttagtgtatagacatgcagctgatttttgagtgttgattttgtatcttcctactttgctgaattcatctattctaacagactgtttttgtggaatctttggagttctctacattgtaaaatcatatcatctacaaacagagataattttacttcttcctttccagtttagatgccttttatttctttttcttgcctgtttgctccggctgaaatttctaatactgtgttgaagagaagtgatgaaagcaggcatccttgccttgttcctgttatttaaggaaaagctttcattcgttcaccattgtttgctgtgggtttttcatatatggcttttattatgttttggtagttttccttctattcctagtttgttgggtgtttttgtaatgaatgggtgttgaatttgtcacatgctttttctgcaccagttgtgatgatctttggctttttccagtctgttaatgtggcatattaacattgattactttttatacatagaattatccttgcattctgggaatgagtcccacttggtcatggtgtatgaatcttttaatatgctgctgaattcaggttgctagtattttgttgaggatgtttgcatgaatgttcacaagcgatactcgtttgtagttttctttcttttttttttttttttttttttttgagacagagttttgctcattacccaggctgagtgcagtggtgtgatcttggctcactgcaacctctgcctcccgggttcatgtgattctcctgcctcagcctccagagtagctgggattacaggcatgcaccacgaggcccggctaattttgtatttttagtagagacagggtttctacatgttggtcagctggtctcgaactcccgacctcaggtgatccacccgcctcggtctcccaaagtgttgggattacaggtgtgagccaccgcgcccgaccctgtagtttttcttacagtgtctttggctttggtatggggatatgctcaggacatgagttagaaagtgttccctcctcttcagttttttggaaactttgagaaagattggtattaattctttaaatatttggtagaattgactagtgaagccatcaggtttggggcttttctttattgggtgatttttttttttttctttgagacggagtcttgctctgtcacccaggctggaatgcagtggcacaatctccactcactgcaacctccgcctctcagattctaagcgattccctggcctcagcctccaaagtaactggaactacaggcacatgccaccacacccagctaatttttgtatttttagtagagacggggttttgccatgttggccaggctggtctcaaactcctgacctcaggttatccacccatcttggcctcccagagtgctgggattacaggcgtgagccactgcgcccagcctattgggtggtttttgattaccagttcaatctccttactagttacaggtctgttcagacttttctatttctttatgatttcgtcttgataggttttgtgtttctaaaaattttttcatttcatctgttttatccagtgtgttggtgtacagttgttcgtaatactttcttttttctttgaaacggcatctcactctgtcacccaggcaggagtacaatgacatgatcatagctcattgcagcctcaaactcctgggctcaagcattcctcctcccttggccccccaatagctgggattacaggcatgtgccaccactcccagctaattttttttttattgttttggactcttccagagagaagacagggtctcactatgttacccagtctggactgaaactcctgggctaaagcagtcctactacctcagcctcccaaagtgctgggattataggcatgagttaccaagcccagccaatacttacttacttttttttttgagacggagtcttgctttgtcacctaggctgaagtgcaatggcaccatcttggctcactgcaacctctgcctcccaggttcaagagattctcctgcctcagcctcccatatagttgggattacaggcgcccaccaccatgcccggctaatttttgtatttttggtagagatggggtttcaccatgttggtcaggctggtctcgaacccctgacctcaggtgatccacccacctggacctcccaaagtgctgggattacaggcgtgagctacagcgccgagcccagccagtactttcttataataccttttatgtttttttcttaattttaatttaattttctgctttttagagatatgcttgctctgttgcccaggctggagtgcagtagcacgatcatagctcactggagcctcgaacgcttgagctcaaatgattctcctgtgttagcctcccaagtagctatgattacaggtgtgcgccaccactcccagccccttttatttctgtgtaatcaataataatgtccccactttcatttctgattatagtaatttgagtcttttttttttcttactccatctcactaaagttttgtcagttttgtttctcttttcaaagaactatattttggtttcattgattttttttttcccctattgtttttctattctctatttcattgatcattaatctctgctctaaattacctttcttctgctagctttgggtttagattgttctttttctaattcattaagatgtgaagttagggagggttttttgtttcattttatttgttgttgttattgagacaaagcttactcagttgcccagcctggagtgtagtggtgcgatcttgggtcactgcaacctcgacctcctgggctcaagcaatcctcctgacccatagtctcgtagcttggactacaggtgtgtgccaccatgcccagctatctatctgtctgtctatgtatttatttacgtagggacggaggtctcaccatgttgcccaggttggtctcaaactcctgggctcaagcagtcctcctgcctcagcctcccaaggtgctggaattacaggcatgagccaccacgcctatcctagttaggttgctgatagagatctttcttgttttttgatgtgtttgtagctatacattttgctcttagtgcttgctttcactgcgtcccgtaagtttcagtatgttatgtttttgttttcatttgtctctaagtattttctgcttttctttgtaatttctttattgatccattggttgtttccatccctttacttttaacttctcagggtttttttttttttggtttttttttttttttgagacagagtcttcctcggtcgcccaggctggagtgcagtgatgcgatctcggctcactgcaagctccacctcctgagttcacaccattctcctgcctcagcctcccaagtagctgggactacaggtgcccaccaccatgcccggctaattttttgtatatttagtaaagacagggtttcaccatgttagccaggatggtctcgatctcctgaccttgtgatccgcccacctcagcctcgcaaagtgctgggattacaggcgcgagccaccttctcagggtttcatatgtaaagcaggtttcttgtagacatgtatagttgtgtttgtttgtttttttatttttagagatggactcttgctatgttacccaagctgaacttgaactcctagcctcaagcagtcctcccaccttggcctcctgagtagctgggactataggcacatgccaccatgcttgttgttttttgatgtactctgataatctttgtcttttcattggtgtatttgactattcacatttaaagtgattttttgatgtatttagattaatatcagccatgtttgtaattgtttcctattcattatgagtctttttctgccttctctacttttaattaagcgttttatggttttatctcctctgttagtatatcaattttatttatcttttttaaaatttctgcagttgccctggagtttacaatatacattttgaactaatctgagtcctttttcaactaactaatgtaaaaaaggtaacatttaacagattactcccgacccttccctattccctgtgacattgctgtcattattttcacttatccacatgtttatcacccagtacagtgatgatgattactttcaacagttatcttttagatgaataataataagaagaagatattttactttgtctttattccttctctagtattcttcctttctttatgtagatccacgtttctgaccttctatctgaaggaaatcttttgacatttcttgcagggcaggtctgctggtgatgagctccctcagtttttgtttgtctgaggaagtctttatttctccttcacttttgaaggataatttggctggacacataattctaggttggtggtttttttctttgaacactttagaactgtttaacttccctctgtccttgctggcatggtttctgatttctgacaagatgtcctctggaattcttttcgaattcttttccctgttcttctgtaggtccacttgcccccacccagctgctttcaagattttctcttttttttttttttgttttttgttttttgagacagagtcttgctcagccgcccaggctggagtgcagtggcgccatctcggctctctgtaaccactgtctcccaggttcaagtgatgctcctgtctcagcctcccaggtagctgggattacaggctcccgccatcatgcccggctaatttttgtattttaatagagatgaggtttcaccatgttggccaggctggtcttgaacccctgacctcaggtgatcgcctgccttggcctcccatagtgctgagattacaggcatgagccatggcacctggccaagattttctctttttctttggtattctgcaggttgaatagaatatgtcttcatgtagctttgggggtatttattccacttgatgttctctgaattctttggatctgtgctgtcagttgttaatttggagactttttagctattactacttcaactgtttctctagtctctccttccagcattccacttaccaggtgttatatctttcgaaactgtcccacaggttttggatgttttgttctattggggatattgtttctgtttttgtttttaattcttgtttctctttgccttgcagtatgggaagtttctgctgacatatcttgcagctccctgactctttccttggccgtgtcgtctcctgatgagtccatcactgatagtcttcgtttctcttagattgtttttattgccagcatttcttcccatctctctgctcacacggcccccttgttcttgcatgctgtctactttttccattagagcctttggcctaccaatcattttcaatttcctgtatgataattgccatccatgttatctccatgttcctgcaaccattcagttgtctctctcagcctctggtgagattgttgttagaccttcttctgttctgcattcctaacactctcttgcatgtttctcatctccttttctcccagttccatgttctgagaacttttttgggatcagtcctccagttaagtgattctgtagtggtgcctagcctgccacttaagtcctgattctgactatatttattatttataagttttaatttactttttttttccaaagatacttagtagctctttatattctcttgttccttgttttttttttctttctttaagcatttcacacatagttactctgtgtttgaatgaaaccttgagcatccagattcgttttctgctgatatcacctgtgatgtattatttccttttgcggatggagtatattaggaggttatgttttgctcagcttactctgtgagaaccacagccctccatagtggatgcttccctgtgagggttggcgtctgctgatgcgagagctgcctgagacctgggctcctcttgagggcctccagactgctgcccccacacgtcactgtggcgatggtgtacggctgttccttcccctcacctccacctcgcttctctcatgacctcctgatacttcttttcatcctttgcctttgtcgatagcagttggttaccaaagtgttcagtgtcatttctctcagatctagagctaagtagcccctcttacctagcaaggcccagaccaggggggaagaacggccttcaagagaagagcaaagccgagcaggtgcggctgcattttgctgctccttccacgtggcctaggagtaggaagttaacgactacagggcctgaatctataccggaacccaaggcatgtgactttgaatcctgggtctttttcatccaacacggaggatgtactgtgaaacagttggtgtactaagaaacggcctagaagtgaagacagggatgtctctaagtctccactgagaactttgcagtggagcatttgcagtggccactgggttctggccctcaggagttcagtgtatcaagtggagcctggtgacgtggtgtaaggggaggaccgggtgccaagtagccttggtcccttgttagcttcgagggccagggtgtatctttacactccctctctgggttactttgagacttaagtaaaaccactggaaacgcatttaatacagttaaaatatgattcagttaaatatagtttaaagtataagtgcagatttagattgggcaggtaaagctatgtggataatagggtcataaataggttgcaatatggggatcacattgtgatcttcgacctgcatgttcttttagagctgagattcagctcttccagcctgaaaactggcacagccaaagcaaagatggtccttcgcctctttaccaatctctgggagaaataccaaaaaacctgttaagcagaaatacagagagtctgtcatcttaaccttttcgttactggggatacaactggaactcatttttgctcggatgcttagtgttgggaacctctcacgtgtgggcctcatgactcagtctgcggctcttgctcctcatgtcttgcacccatgttccatgtccgagtgggtgtgggtggtagaggacaggcgagtcacctagctcctggataaactcagtgtgtgcgcagtggaaagcagtttgttgtgtttgcatatttgtgtcagagctttcatttaaagcaacagttttccttttctatggattacttcttttgtctcaaagtggataaaaatgcaaaacttctgctagttgaagctttgtgggtttgtataacgagtgaaattggtgttctgattcaatagcgtagtccacgttctgagagagttactttacagttatatcattggtggacttataaagtcatggtccaaaaatggtctaggtgacagacacctattttttcctgaaagaaatccataagctattgaggtcagtaggcatcttctgcaaaagcattaaagaaaatacaactttttttgttactgatccctgttacttttgtccctacaactgggcttccgtttttgagtgtgtggggttctgaatagtgtgtaaatcaaatgcgtagaatcattgccgtatgtttccaatattacagttatatagatgcattcccttattcctctaagctagacactgttcagcaaacacttattgaacacccaatatgtgccaggccctgtgctagactctaggaagacaaaaatcggttagtcttggcccctcttttcaaagagttcacagtctaaagagaagacaaaaacataatcaaaatatcaaaatgttgtgacttacagatgctaggcagaaaagtaacaccgaagagagaaaattttaaatgagcccacgggtggttttgcagaggaggtgatgctgatgaaatagggttttgaagcataagcaagagctctctgaacacacatgggtggtggagcccaggctctcagccaggcttttcaaacctgaaaccaaacaactcatggtcgtgtcttgaggagtccaggaggcacttaacgtagcttcagagccctgagagtgcttctagtcatggtttaccagctgggccggcacaatgggactgctgctcaaagctagcagtttggcatctgtcacgggcttctgccttttacaagaaggtcctcaagaccaagaagtcttctacttgttactttttgtcaattacttctcagcaaagcagctcttagcttatcgctgctttgtagaaatgggtatctattgaaatacgtttttttattttcctggctcttgtcccatggggctcccttaccaaaacaatgacttcaggccctttactgtatcctgggtggcccgtctggacctgtttattcctgctgttgagtcctgagtgtctgctctaccctcctctccccctttgccttcctgggcctgttccaggtcagtggactcgctgagctgtccagcagcccagaggggagtgcttcctctctgctccgaagcactgtggaagaagggcaaggtggaaaggtttggtcggttggtcaggtgttttgtgtccagggactctatgtctatataagtagtctctatatagtagtctctaagactattgtcctagaaaatcaaagcagtgcaccatcacactcactgaatacttactatgggccaggcagtgtgctcaactcttaccatacccctggaggtaggtatttccagattacagatgagaaaactaaagcacaaaaagattgagtgatttgcctgaggtcacacagctagcaaaagggagagctggcatccgagctcgccagactccagagcccaaaggccaagacgtgggactagagttcagatctagctgtcacctgaccgtgcctcctcatagtggagccagcagtggtagctcctggactagatgtgcagtcccagctttcatcttgatagctccagaattcctcctttccttgccaccttcactgccattgcttcatcctttctcatcccctgactaacctactcgtcctccttccgccttctggttcatccacagcattgccacaaattgatctttccacaaagctgaccaaatcatctcactctgctgtttaaatccctctgtgactccccagccccttcagaacaaagtggtacaaagttgtctttggcctggctgctgcccacactcaacctggagcctgtcagggtgtagcactgtcatccctgtacgtgcgccatccctttgctcctaacctcttcctgtcctccctctgccccagccaggccagcaggattctgccgaaccatcgcccattcttaagaaccctccagggaaccctcccacttgagtttaaagaattcactactcatttctgcatcccagaggatgtgatgaccaggttgcccataactgggcacttctcctctccagcagacagaagtcctgctgagggagaaccgtatgtctgcccagcattagcaaggactgggggagaagggccaggacccagatgtcccacctcatcctagagcgcatataatttggggaaaggcagacatcaaaccaacaggctacaagtaggtctcgaattataactgtggtaagtgctaagagggaaaatgacggattttagtgtgttcagtgggaaggctcgccttggtcttgggtgttggttcctgggaggtgacagcaaaggcaacgccggcttctctgaggaagcgatctttaggccgaggcctgcaggatgagtgcgagtgtggtagcgagctgaggcttgcacattctagagcatggacacagcacaagcagaacttagggccaagaaggtgaataggcgtgtgccggccaaggggaggcctgtgtgtccagggctttggtgagcaggaagggtggaggtggtgggcccagctcccttggaactttgcaggccagagccttgggaagccattgctgcatcctgagcaggggagtgacatgctcgaatttacattcaacaaagatcactctggctgtagtggggagaaggactgggaagagttcgtggtgcaaatgtgcaggctgttgcactgcgccactgtgagaacatggtgctcaggatctcctaaggaggtcagcagccagggcctgttgcctggatagtggctgaggcagagggaggacccaagggggccccagcctgtgcaggagcagccagatggctagtggctcaataaatgcatggatgttggctagccagctggccagaccctgctcaccttcccttggtgccttcaacaatggtctgccccacagggcccagggcggggcttgccaatgaggcagctcctttgagaacgccctggtctttagagcacagtatacaaatttctctaggtcattagatttgtgctgtaccttgcctgggtataagaggtcagtgtaagggttttatccattttcatcagtgattccaaagttgacttattagtgatgatcattaaaatgcttgctgagattaagccgtagaaacagatcttacgacgcacatggcacactcacatgtgacccagtaggaatgtgagaagttactgagttgtctaaagtttgttcagatatactcctcaaggcatcggttgcttttcatatctacatctggttgaaatttgacctgtcgtgtacagtctcataaatcaagtccatgttttgtgagatgtgctccccctgggctgagctcagctcatggcgagcacatcccatgaggctcataatgaattgtctgtctgtagtttaactacttacctaggtaaacagaatattaattttgatatgtgattagaaaatttttttttgtaggctttaccgccagca

SEQ ID NO: 1989 - DNA, 17914 bp, Homo sapiens
aaaaaactaatttaaatatgttaaaatgccaaaataaaatataaaatttacaaaaaggcataatctacaaaaaggcattgagtcccaccaagaacatacaaaaattaaaaataaattaatgggcaagatataagaagaaaatgcacattaagaaaaagcctcagagtcagatacatttaatatcatttataatacaaattttaatccacccagaagatacaggagtcaaaatcttacacaccaaaaaacactgcattaaaaatatgtaaagcaaggtattcatgaaatacccacagctaacatcatactcaatgaacaatccaaaaagaaaattgagaaaattccctttaagagcatcaaaaagaataaaatacccaggaagaaatttgtatatagaaaactaaaaacaaacacacaaatgaacaaaaacactgctgaaacacattttaaaagatctaaataaatgaaaatatatccttgttcatggattggaagacttaatattagttttggttttttttgagacaaggtctgcctctgtcagccaggctggagcactgggacaacaggcgtgcaccaccacacctggctgattttttattttttgtagagacaggcttcgccatgttgctcgggggggtctcaaactcctgtgctcaagtgatctgcctaccttggcttcccaaaatgctgagattacaggcttgagccactggcgcctggctggaagatttaatattgttaagatggcaatactacacaaagtaatctacagattcaaagaaattgctatcaaaattctaaaggtcttgtttgcagaaatagaaaagccaatcctcaaattcacatagaattgcaaagaaccctgaatacgtaaaacatactgaagaacaacaaacttggagggttcaaacttcctgatttcaaaacttgctacaaagctacagtgaacaaaacaaaacagtgtggtacatgctggcataaggacaaacacacagaccaatggaatagggttgagaatccagaatatcatagatgcatgatatctatagtcaattgattttcttttttttttttggagacagggtctcactgtgttcgcccatgctggagtgcaatggtgcaatcttggctcactgcaaccgctgcctcccaggctcaagtgatcctccggcctcagtcccccaagtagctgggactacaggcacgtgccatcatgcctggctaatttgtgtatttttagtagagacatggttttgccacgttgcccaggctggactcaaactcctgagcttaagcgatctgcccagcgcagcctcccaaagtgctgggattacaggtgtgagctactgcacctggctgccaatcgattttcaacaaagatgccaagaccatttacacaggaaagaatagtctcttcaaacaaatgttgctgggacaactggatattagatgctcaatatcattagtcattagggacaatgaaaatcaaaacaaacagcaatgggacaaccaccacatacccactagagtaactaactgaaaaaaaggaaaataccaagtgttggcagggatatggagaaactggaatcctgtacattgctgacaggaatgtaaaatggtgcagccattgcagaaaacagtttggaaattcctccaaagttacacatagaattacaagatgactcagaaattccactcctaaatatacacccctaaagaattaaaaacaggtactccaacaaatacttgtacacaaatgttgaaggagtgctatttacaatagccaaaaggtggaatcaatccacagtaatattctgttatatgtatatcatcaacagatgaatggctaagcaaaatgtggtaaatacatataacagaatattactcagccacaaatgaatgaactactgacacatgctacaatatagatgaacctgtaaaacattatgctaagtgaaaaaagcctgacacaaaaggtcacacattctatgatgccatttatacgaaatatccagaacgggtaaattcagagacagaaaggaaattggtggttgccaggagatagtggagcggagaatagggaggggcagcttaatggatcctattttgtagtttcaaaatgaaatgttttggaaccacatagaggaggtatttgtgaacattttgaatgtagtaaatgctgttgaattgtatatttttaaatggttagctttttgttacaagaatttcaccttaattaaaaaatatagacagcaaaagctgttagaaatacaagggaggctgccaggcatggtggctcacgcctgtaatcccagcactttgggaggctgaggcaggcagatcacgaggtcaagagatcaagacatcctggccaacatggtgaaaccctgtctctactaaaaatacaaaaattagctgggcatggtggcgcatgcctgtagtcccagctacttgggaggctgaggcaggagaaccacttgaacctgggaggcagaggttgcaatgagccgagatcatgccactgcactgtagcctgggtgacagagtgaggctccgtctcaaaaaaaaaaaaagaaaagaaatacatgggaggctatgagaaaaaacccacaatgatagtgaaaacttttaaaacacattttaaaatttgacagaacaaagggacaaagaataaatgcaatcttagaaaactgatggattacattagaaaacggatcaacttttcacccaaaaagatgtttcatacaaaaatcgacaattttcaaatgcccatgtaacagtgaaatgcaaaaatcatttataaactaagccagaaaaaaaatcattaaaagtagaaatcccaaagtagaaatcttttaatagttcctgatcacaataagaaattattaattacaaaaaaaattgtttcctacctctgtccattaaaatcacctacaaacattgaccaacccaacagtagtgagcacccatagaattcaggttatagaccccgaatgtcatatgctacaaaaggaaccggagttcctaggcaaatgggtgatttcaggtctgggacaaaaaataattctggaaaatctatgcatatcaaaaagcaaggatgtgatctaaaactactagggtagtgtctaaacttaaagaattcctactaaacttcatgtgagcatcattaagaataatgcaaagggctaacatatattaaatatattaaaattcatgagttcacaaatatattttaaaaattcactaatcatctttggaggatgcctgggaaataactcactgttccaaaaactgacaaagaattaagtatttaacctgactttcttttataagctgtacctcaaagtaactactatataattgatgaggaaatgttcatctctagagtagtattccaattaacaaatgaaggaagatggataaaaatagatgatcaccactgcaaattcctaaagaaacaaaggacctaggcaatgatcatcaatggctactaacaccacaaaaagatacagccagactttatgttttttcattcgtttgtttgttgttgtttttgagacagggtcttgttctgttgcccaggctgaagtacagtggcacgatttcagctcactgcaacctccatctcctgggctcaagcaatcctccacctgagcctcctaagtagctaggactacaggtgcatgccaccatacctcgctaattttttattttttgtagagatgaggtttcgtcatgttgttcaggctggcctcaaactcctgggctcaagagatccacccacctcagcctcccaaagtgttggttttacaggtgtgagccactgcacccagcccagattttatgtttatgtgtctcctggtacctaaatactacttacaagtattcttgacaaagtcctaccgaagtagatcacatctctagatctaacgtctagtttaaagtactacggcggacagagcaacatgctaaatgataccagcagatgaaatcagtaaaattctgaacaggagccactcacaggacgaaaaaaacatggtttctttaaccgaaaacaacagcaaaaagagattacaaagaacacaaaagggaggaggaaaatacagattaaaataaacttaagggacgtattaatgaaatgcaatgtccaaactttggatccaaattcaagcaaaataaatgcaataagaacaaattatgagactactagaggaacttaagcactaattagatattttataatattatataactgtcacctattttctacctttgataatggcattgtagttatgtttgtctttttaaaaaagagtccctatctttaagataatgaaatatttacaaattaggatgtatttacaaaaggacaatgtggtgcctgatatgagcttcaaaataattcagtgtcagaggattgggaaggggaggtggaggtacaaaatgaaacacgactggctaccaaatgaaggtttttgaagcttaatgagtacacaagaggtcactatagtacaggttaggcatccttaattggaaaatccaaaaatccaaaatgctccaaattctgaaactttttgagcactgacatgacattcaaggatttcagatttgggatactcaactggtaagtatacataatgcaaatattctcacaaaccacccaaaatccaaaatctgaagcacttctggttccaagcaaacaattaaaaaaaacagaaaaagacttttaaaaatggttaatttaaaaaaattgatttttgcctttcaatctgaagaatcagagataaacttactagatgaaagcttatcaattcagttaaaatttcaatcctccataacattttgatcactttcattaagcctctatagcctgaacttttggaaactttccctataatcaattgcagccttactgttgcactagtccaggtactggcaaacatcagggctgcagcctgtttctgtacagatgtcaagctaagaatggtttttatactttaaaaggttataaaaagtaaaaaataaaaaagactatgcaacagagatcatatatggaggacattcaattaatgaataacaatcaagactctgccagaagcccaccatcccaaactaaatttatacttgagagacctgaaagttcttaaagaccagaaaagactaatataagcattgtgatttttttaaaaacccacaatgcacttttatatgtatgttgaaactcacataagttgtgtgcattattttagtgtatgtgagcttttattcacgtttaagttccaaattaaactctgaaaaagaataaactaacaataaatcatgctataaattttccttaacttttactgatatctaaaaaatagattcagttaaaaaccactgttgatagtacatggatgatctctgcctctgaagcaaggagcttaaagctcagtcaaacacagatcacaaacttataagaattttagaattggaaggatttatagaggtaacctattcttatctccttggtttacagataaagaagggagatgaagagactttcaaacagctaataagctgtataaaaaggcctaggaaaacaatttaaggaagtctgtgactttcctattacatataaagtggttactttcttagttataatcagatctattttaagcctggtccctgagaaatatgattgcacaacactcctcagctaagaaccaacaggagattgtattttctgtttccttagtcacaaaaactgaccctgacctctctccactgaattatagctaatcatcaagccccaagggacctgaaactatgttcccatctctaactaaggttaaaaagaactcctccctccaattttttcctgagacatctggcaacttctatgcatatttgttttgattaggtagtatggatgctgctgctaacaggaatagaaaatagaaaaatatgtgagtaggtaaagccaggaatctttttgaaaacaaactgaattttattactatttaaaaactgttcatttattcacttagttatactcaatcttctgcctcttagattcacaaagactgtcaatatctccagttcaaacattcccaagtatctaacttttaatgtgtaatgggattttatttctgcaactgactttctattactaccaacgatgcatgaggaattcctaggttttaatagtgataatcctctttgcctggattagtctcactttgagtaaaacctttatgaattaggcaagtttttaaatgaagtttttggttaatttgtctgtaaaactgaaaaatatccacattacataccctgcaggagtacctgtgagggtgaagaaattacaatgtgatacaaatgtgggcattattctaaaagagaaagaatgctggcctggtgtggtgtctcacacccataatgccagcactttgggaggtcgaggtgggcggatcgcttgagctcaggagtttgagaccagcctgggcaaaatggtgaaaccccgtctctacaaaaaatgcaaaaattagctgggcatggtggcatgcacctgtagtcccagctactcaggaggttgaggtgggagaattgcttgacctcaggagttcaaggctgcagtgagctgtgatcatgccgctgcactccagcctgtgcaacagagcaagttcctatctcaaaaaaacgtaaacaataaaaaagaatgcaaccatttctggtttcaccaaagtcattttctttatgagggtaatatgatcataaatatattaacttagacttaaaaatggtcaagatggtaaattttatgttatatatttttaacaattaaaaataaaaattataaaatattccttccattgatagatgagtggatgaacaaaatgtggtatacacataccatggaatattactgagccctaaaaaggaaggaaaatctgacacacacaacatggataaaccttgaagacattgtgctaagtgaaaaaagccagacgcaaaaggacaaacactgtatgattccacttatatgatgatggttgcatacattgtgaactgcatttaatcccactgaactgtatatataaaaatggttaaaatgttataataaatttcatgttacgtatattttaccacaataagaaaaaatattaccttgaaggtctccaatcatctcagaatcatgacctctgtctcttcgttcagcttctaatatagcttgcagctggtaataatctttgtctgtttgtgacttagaattctctaaaattcgatttctctcttgcaactctctgttcagggactctaactgactaattgacttgctcatctctgtgtgactcttcctcaatcttacagctgtgtccgattctgtcctaagtaagtcattggcttcttctagctatttaaaaagaaagcaaaaaaataggtttctgaccaaagtacgatataatttaattatctacaatttttttaaaaaggaacctcatttgaaacacttacctgcttttgtaactgggacagcttctcattagcaagctgtgaattctgactgactttctttaagtcttccaactgatcctttaatgtagaaactagaaaatgaaagaataatatatagaaattacaacattttcataggggaaacatataaatccttttttaaaaaaagacatttagtcttaggccataatagtcagctacattaggtccactcccaaagccaaattccaatttggaagtacctgcattttaaattcattaaaaagtagaacattatcttctaatacagagtgcaaaaagatttcttcttactgttgtaaatctcaaactcctttattccctttataagatcactgatagtatacttataaagctagttttaatattatttatttttcaagagttcaattgcttgataattcaatatcttaataaaaatacaaaatttaaaaggtaccaaatggtagatagtatagaataagtcctcctttctccatttagtcatttttgccccttctgagtctcccttaactggctctcctccctaatatatatttaatttaagcatatatagacaagtactcttgttttaaacacaagcaatccgtttctgtcacttaaagatctgtcttagagactgttttataaccgtatttaaggagatgatttattattttttataagccacatagtattctaccatatagatgtactaaaatttattacagcattcattacctttatgtttcatatatgtattacattatgtttcatatacagcattgactgcattttttttgtcattttaaacaatgctacaatgaatagccttgtgtatatatcagtttgcagtaggagtatgtacgtgaaataacttatggaagtgaaattactgcatcaatgggagtagaaaggtattttaaatatatttgtaacacaagcattaaaacacaagaaattctggtttagaagttcttagacgcagctgcttgttagaagtacctagggggcttgtaaagaataatgatactcaggccacatatctagaccaattaaattagaatcgctgggatttaggcatcagtactctttaaagcttcccaggagattccagtatgcacaccatgatgacaatcactactctagttaaatgctacttactatttactttaatatgtaatttaatatttaatttaattactatttaatatgttataaatttaacctgagacctgggttatttagcttataaagtgtcttaggattgtagcttcatgtatgtatcatggacactaaattaaagacaacctcatgacagtgttagaaattctatcatttttcaaaagtagtgacaatttaccttcattttctacatttcttctcttctcattttcctgttcagcttttctttggtactcattaattctatgctgtagcaacattttctccttctcaatctgagacactgtagattctagatttcttctttgatttccctggaattataatgataaaagttaccactgtgattaatactctggtcattcattcaagtgagtattttgttcttaaaaacaaaaaacaagaaaaaaaaaaagacaaacacttaagatgaatgttctgtttcaaacgcaaatagtatctcctaatacaactttctaagtagcttgccttttaagaagacagtgggaatctgtcttctgtagctgggactacagggacgcaccactgcgtccagctaatttttctatttttggtagagacggcttttgccatgttggccaggctggttttgaactcttgacctcaggtgatccgcctgcctcagcctcccaaagtactgggataacaggcatgagctactgtgcccagcctaaaatacccaaattttcacaacttaaaaatgtacctttctgagttaccactatcagtaaatcttgtttttgatgcttcactttttaagactccacattaggaaacctgttttacagtgtttctgggctttctcatctttaagcagaaattggacataaatcattcaaggtctttctgattctaagagtttatcattctaacttttagttaatttttagataattatacattcaaagaaagttgcaaagatagtacagagaggtcccaagtgcccttccactcagcttcccccagtagagacattatatataacaatagtacaataacaaaatcagaaaattctcactggtataaggagtgtatgattctctcattttatcacatatgtaggttcatgtaagcaccaccacaacgaagatacagaactggtcatcacaacaatttctttccagtcactagttatagccacacccatccccgtcctcccaccacccatactcctggcaactaatggttctccatttctataattttgtctttttgagaatgttatataaatggaaccatgcaatatatgactttttgagacaggcttttttttttttttttttttgtatttttaatagagatggggtttcaccatgttggccaggatggtctcgatttcctgacctcgtgatccgcccgcctcagcctcccaaagtgctgggattacaggcgtgagtcaccgcgcctggccaagacaggttttttttttttttaactcaacataaagaccttaaaatccatctctgtattgtatgtatctacagtttattccttcttgtggctgagtattccatggtacaaatgtaccgaagtttgttcaaccattcacctactgtaggacattttgattgttttcagtttttggctattacaaatagagctgttataaacattagtatacaggtttttgtgagaatatacattttcatttttctggaatacatgcccaagaatacaattgctaggtcacatagtaggcacatgtttagtttttcaggaacacagccaattggttttccagaatgtctgtaccattttatatccccatctgcaatgtccaagtgatctagtttctccatatccttgccagtttgctattgacataattttaaaacttactttttttcatggttatggagtaatatttcatgatagttttaatttgcacttcccaaatgactaattatgtgaacctcttttcataggtttattttcatccatatatctaaaaagtttaaaaagtatggattcgctttccttaacacttatatagggctactgaaattacctatttcacactgtatgagttgtgatagtttgatttttgagaagttagtccctttcatctacatgtcttaattgtgtttagaactgttcataggatttccttatgattcttttgatacctatatggtctatagtatatgccctatttcattcctcatactggtaatttgtgtcctctctttttcctttatcagtcttgctagaggtttgttaattttgttgatcttttcacacagctttttgtttcactgattttctctattgtttttctgcttttaactgccttgttctctgctcttatcgttacttgtccttccttttgcttgttttgggtttatttcactcttcttattctagtttccagaagtaggagtttaaattattgattttagacttttcctcttttctaaggtaagcatttagtgctataaattaaccttcatcaccatgttaacagcatctcacaaattttgatgatgtattttcacttcattgttcaaatattttgtaaagataaagagccataacagttttatgagacataattaacattccaatgtatttttttcactgagacttcttctttgacctctgggttatttagaagtttattgtttgctttccatgtgtttgcagatttttctgttattctcatctgtacattttggtcaggaaactgtatgatttcagtgctttcaaatgtgtttgttttatagcttgggatgtggtctaccttggtgtgtgttccttaagcacttgaaaagaaggcatattgtgctgttaagcagagggttctgtaaatgttgaacaaattctgacagctgacagtgtagttgagttctcctatgtttggtgattcttacgggtgctgaagtctccaacaataattatggattggtctatttaaccttccagtcttatcaacttttgcttcacatactttgtagctctgttgtttggtgtacagttaggatttttatttatttttggtggattgactcttatcattatgtaatattcctctatgttcatggtaattttctttgctctgaagtctactttaattggtattaacattgccaatatgctgctttctttttaatatttgttatgttatctcttcacatcttccgatgttcaacttgcctatattgttatatttgaagagtttctgacagatatataaatgggggatttaaaaaaatctacccctaccacctcttttgattggtattccatttaatttccatttaatgtcattattggtagtatgttagggttaagtctgccgtttttgtttttttgtttgatctctgttatttctacattttctttcctgtctttctgtgggttacctgaacattattttagcattccttttgatttaactatggtgtttttgaatgtatctccttgtaaggccttttcagtggctgccctagatattacattgtatatgcatagcttaatatatagtacactccactggtattggcatcttaccagtttgagtaaagtataaacatcttccctttcttcttttaatttttatcttatttatttttgagaaagggtctcactctgtcacccaggctggagtacagtggtatgcttatggctcactgcagcctcaacttcctggactcaagcgatcctcccacctctgcctccctagtagctgggactacaggcgtgcactaccacacctggctaatttttgtattttttgtagagacagggtttcaccctgttgctcaggctggtcttgaactcctgggctcaagcaatccgctggccttggcctcccaaagtgctgggattacagacatgagccaccacacttgacctaaaaactttacctttctttatgacccattactctctgtttataatgtctaaaatattttttctcatacacagagaatcatattagacaatataatttctgcttcaactgcctactataaaaaataaagaggagaaaaaaatgtatttacccatcttttactgtttctttattcctggtaattcaaaattcctcctttttcttttggagacagagtcttgctgtgtcacccaggctggagtgcagtggtgcgcttggctcactccaacctccacctcccaggttcaagcagttctctagcctcagcctcagcctcctgagtagctaggattacaagtacacgctaccacacttggctaattttttttgtatttttagtaaagatggggttttgccatgttggccaggctggtcttaaacttctggcatcaagtgatctgctcgcctcagcctcccaaagtgttgggattacaggtgtgaaccaccctacctggccaagattccttcttttatcatttcctttctgtttagagaattttcttttgcaattcctttagggaaggtgtgctggtgacacattatcttagtttttcctcatctgagaatgttgtcattttctttttcatttgagaaggatgttttaattgaacacagaattctaggttgataggtttgtttttttgtttttttagcacctgaaaaagtcatgccacttcctcctggcctccatggtttctgataagaaatcagctgtcacttacactgttgtttcctttctaggtaaggtgtgtcctgtatttaagatttcttttttgtcattaattttcagaaatctgactattgtgtcttggtgtggatatctttgggtttacactttttgtggtttgctaagcttcttggtagttcatgtcttttgtcagttcaggtcttttgtcaaatttgttgaattttctgtcgtcatttcttcccacgccctttctcctctcctttagtaattcgagtgacacaaatgttagaattttattgttatagttctacaggtcccagaggctctgtcactttttttctgatcattttctctctgttgttcagactgcataatttctatttttctttgttgaaggtctctgattcgctcctctgcattgttcactctgctgctgacaccatctattgagacttttatttcagttattgtaatttttggttggctctattttatattgtctatgtctttctgagactatttttttgcttgtttgtatgtttacagttgctcactgaaacatatttatggtgattcctttaaatacttgtcagataactctaacatctgtgtcatctcagcattggtattagtttattattgtttctaattccagttaaaattttcctagttctgattatgatgagcagtttgctattcaaacctggacatcatcttacaacattctggatcttatttaaaatctcttttagaaggtctcctctgacactgttctggtgaaactaagggggtgctgcctcttttctgccaggtggagtttgcagaagtccaggttttccactcagcctctactgacacctcaggtagggaggggagcagatcctcatcactgctgggtggaagcaggagttctggcactctaccaggcctccattgagtgcaccatggctgctccttatgtggcccccacagatgacactgcattgtggaggggagcttgttattttcagtggaaagttctgactccctaccatgtctctttgataccaacccagaaggcagtgggaggggcacccccttactgccagctggaagtgtaagtgtagattccccacatggtcactgctacgctgtctggggagagaaagaaggtttgttactgcccacaggagatgaaaattcctttactggaccttctctgacactattctaattggaagttggggtgtgctacagcatagtggagatggaagtctagacttcccactcagcctttgctgttaagaatggggctacagttggctgggcgcggtggctcaggcctgtaatcccagcactttgggaggccaaggcgggtggatcaaggtcaggagattgagacaatcctggctaatacagtgaaaccccatctctactaaaaaaaatatataaaaaattagccaggcatggtggcgggcgcctgtggtcccagctactcgggaggctgaggcaggagaatagcgtgaacccgggaggcggagcttgcagtgagcagagatcgcgccactgcactccagcctgggaaaaagagcaagactctgtctcaaaaaaaaaaaaaaaaaaaaagaatgaggctaccgtttttctgtggtgtttggctgaaaagagcagtgatagtgtaagttttctgacttgctagcctgctccttttttggtctttaggctaaggaaattagctttttttggagctttgtctgcaactgttgatatttcgaggttgctggcttctccggcaccccgtctaggatacatgcagcaaaaagaaaaccctgaagactcattcatgtgttgtttctcaggacgcaagtaacccaggttggtctgccttctttccacctttcaaaatcttttcatgtttgttttatgtttaatgtttagggtttttagctgtacttactgggaggaatacagaaaaggtactcttactccatctttctagaagtgagactattttaatttcatacctcaaatttccctctctacttctaatttggaaaaatgaataacttaaatctagcacatctgaattttatctgtgttttaaaagttaaatataagtggaagatatgcaaaaaaggactccttaaacactcagagtcaaatatatactgctaaggttaagtacaaaggcaagttagtaaatgctctctaaatcttcatagatatccaaagctacccatgaaagcaagcaagccattgacagataccattctataagggaagaaaaaattaacacagcataaaaactatcagagattaaacctaaaaaaggacaaagtaagtaatgtattaggagaagactacagagagtgtatttcttttcatgggactcatagacacagtagaaatatacttagaagttgactaagaggaatggaaatgtattacatatttgcaaacaaacatctgaattatgaatgcttgttattgtttctctgataataaaaaattttgacaggtaaccatggaaaagatgaacattctaaaatcaatatattttccatttgattacatgagattatgtcagtgttaatcttttaaaaatattttaaactgtatttctctcttttccttatttgtctgtctctttctgacatagtttgagattcaatttctgatcgcttgcttctctggctcctttctcacatttcaaccatcgagaaccactgaactgaaatttacgtactaaaattaatacggctgtagaaaacaattgtacaaaggaaactaaattataatctaatctgtaccacttgaaactgcagttccaaggtgaggctttcatcacaattctctgctctgttttgtgtttcaaactacagaattcaaatacaattttctcaggaaacgaaacaatttgaaagagggaaaaatctcaaaaaggaaacttgattagaaaacaaaaagtacctcttcatccaattctttcattatcttgtctagttttatgtttgaggttctgtaaaaacaaaagcaatacagattagaaatatacgtatttcttattgcccagtgttaaacactaacattccttacttttccacttaactagagttttgtatcctttcttggtgccatggatctctttggcagtcaagtgaagcctatggccttttttcaaaatattttttgaagcacaaaaattatatatgattaaaagagacaattaggctgggtacagtggctcacacctgtaatcccagcactttgggaggctgaggcgggtggatcatctgaggtcaggagttcgagaccagcttggccaacatggtgaaaccccgtctctactaaaaattaaaaaaaaaaaaaattagcaaggcatggtggcgggcgcctgtaatcccagctatttgggaggccaaggcaggagaatcacttgaacctgggaggtggaggttgcagtgagccgagatcatgctactgtactccagcctgggtgatacagtgagactccatctcaaaaaaaaaaaagaagccaattatattgaaacacagtaataaactttaaaaaaatatgtgtaattcagtagtatatatgcttccttattaatatattaaatcacaacatctagtggcagtgatttcaaagtattgatgagcataaatgatatttagagatagctgtaacaactgtaataagaaaacatctataatttctattggtaataaaaattaacaactactgctaataactgaattgctgcctatgctcagaattgaaacaagtgctaaaattaagttataagttagagaaaacgttcaccttttgtcatccacgtttaaggacttcaaatttcatccatggactctttgggggaggtctatggatttcaggttaaggatccctaaactccgtcatgcaatacttgccactactcaaaaattagccatttatcctttaatacaggataaagtaaacaaagagaaaggtagtatatatcaaatcagtaaaggcaccatttggcaacactcaaagtgtattatcttcattaccatttgctttctttggttcaaaatgtaattctgagcttcaaaacctatatatgcaacattttcacgtggatgtctcattaaatacctcattcagcatctccaaaatagaacttactgcctctgttccacactcccaccccaataccaatttgcttctcttctagagtccctaagtaaatgacaacacctaggaatcatccttgactcatcctccctcactcccatttagctgaataaagtgccaagtgctgctaattaagcaggaacttcttttgaaaacagcaaatttaatatatattttttacttattagtttaatgacttttgatgtttttccattacacttaaattccaaatttcttagcccccccgcaaaaaaaaagagaaaaaaaaattctccccaatctagaccttgccatcctccccattctcatctcaggcttttccttccctcacatcttactggccagtcaaggtctcttacctcacggccttcacagatactcacctcctggaccctaacacttccttccactcttctcctaataatttccattgactcttctggtttagctttctctgatctctgacaaaacagtacag

SEQ ID NO: 1990 - DNA, 4321 bp, Homo sapiens
acattctgaaaactgcagttttctatttaaatagaaaaacatccagactcctaagatggcttcatgctctgcccttgtgctctggtcctagctggttcatctttgcttacagcctcatctttccttactcacactttgtggtccagtctgctgttcatctttaagagccgtcccaaggctgtgatctttaagttcagatgcatgtgcatttgggtgctatacaagttgatccaattggggtatgctagtgctgtgttctctttcctccaggcctttgcccaagttgtctctttcatctgcttgaaaccccttctcacttttgtttggctaaatcctgctagtcttaagctctcacttgaatcctcacttcttccaagaaacctcttctgatccccccaggtctgagattactatacttctcctgaaaacctgtactcaccattttgcatcctgattgcctctttactgacatgttcctgcaaagcttcagtacctagcccgtacctgcctcagaattgtgctccataaatgcctacagaatattaaaagaggaaacatttaatcattttttaatgtttaagttataaacttcattaagccaggttcttagttggttacacaggggtttttatctacacaaaaatctcctgagaagttttgtcttgaggcagaacaaaataattgattctaaaacgtaatttgaattataatagcatcgtaacactgtaacatgaataataaaatctattgggactgtgagcagactcatccaaaaaaatagaaaaaagtgtttgggcacatatttttaaatcctctctgggccatgttttgtacagtagtagcataaaattatgcaacaatttatacttttaacaggtcaatactaataaggagaattatccaaagccaccctctttcattttgctttcagcttagctcatgtccttttctggtattcaatatgtcaccccatgcatccttcagcctgcaacttcttaactaccttacctcaagtttgtgccagataaatagcaatgttaaaagttactatgaatttagtttttttttttaattgctttttgtagtgatgtttttctttccccaaactgcgtggctttctcccattcctacctcagtcttcatagcatgcttttctactccaagtgcgcatgttttgctttctgagaatgtgagattcacccaaataaaaaagaaagggtttggtgttgtttgtcatttggagtttttagtgcctccctgtactacattaggatggacaaaagagattgtaatgccatgaatataaagagttattgttcactacttacgaaaaatactctagctactcattatttcaaagtagtttattttaatcatttaaaaattagttgtgtccacactttgtgctttaatcttttattgtaatttttaatgctaaacatatctagtactccataacacatgctaaatgttgcgttttgatgtatcctcccttctctcctaatctagcttcgtagtcctttgaatacattaattttgtaaattaccgcagtagcagccagatttcataaggatgttttacattgttgtaactggtttcattttcttacttgttcctatgattctcattatataggaactacttactttatgttcttaacacagaagggtcagaggaaacagttattttttgtaacaatttttaaactattaggcattatacattacaaaatcttttgttcttttaaaatagtaaaatgtgcccagagtttagtgctgaagtattctgcagtgatgttgaaaaatgtgaaacaccttttatttggcatgttgtctaaatgctgcctgaccccgcagttcttgcagttggtgcatcatctgaatgctgtctaaccctgcagtttccagaaacatgagatgataatttgcttctttggtgagcctgtggcttaggtccatttcttttcacaaaaaagaatgatcagagaagacttaaatgccctataagtcatttcagaaacattacgtagtgattattttggtattgcctaaagcaggtatcaaggtgattaacattcattatgttatcttaaaaattacacacaatcctttattgcggtcatgaaataagtaatactgtatacaaaaaaaaaaatgaaagaaaataaccagtgacgtttttttccttccatctgctcttccatcatgcaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaagtaagcattttcaccagagctgtgggttagatgtcacatggcagaagcagccagattagatccacttgtcgtgggcattaagggggcatctttcctttatggagctgaaggtgagcatatattggccatcattctgaaagcatatggtttggggaggctgatgataagagagtgctcttaaggaattaattacagttttgtctttgactttaaccatgttgaaaattaatctagtaaccttataggaaggctgatctttagagtaataatagttactactaccaaatactaaataaatactaaggctttttctttattattatggacttgatttttttttcagtggtcccaatgtaagtctcctcttgttctgtctataataggtaaaaatagtataaatggtactcattcatttattcagcaaatacagaatgctgtatatgctaggcagtgtgctaaatttgggggctatagagcaaatgtgatacagtccctgcttcaaaaaaagtcgaagatgggagagacatgtgttctaaaaatgacagtccaatatgattagaaaaaaacacaaagctgtgtacatatagtgtgctttgaggacacttgaaggagggttaggctctaggatgtcaggaatggcttcacagaggaggtgcagttctccagacagataaacctggtgagcatttcagagcaagggatgagtaagtgcacggcccccgaggctaaggccaggcttcttgtaatcaagtgcttctagagctggtggagagtcgggagaggcagctgatcgggcagataagagcagatcatgttgagtcttgtgcagtttgcgcagaagtttggatgtaactctgtaagcattagagaaatgtcatctggcagcattcatagaagctatcacaagaggaccagacagaagtctggtttgaaaccaaggcaacaactgtgacagcagagcattgattcacagccctgattgtatattagaatcacccgagaacttccatgacacaccagtgccccaggcccaccccagaacaattgtcttccaaatttttgagcctcaccaggtgactaatccacagtagagaatctttgcagtaaatgaagcagaaaaccagtgaggctgtggcagtagttttcatccttgtcattacagcaaaatggcaggatgaagtggtttcaaaggctgtttggagtcatctccatttaaggtaagtttctggtcatgttccctttcttgagagcagcagttacattattcattttgtagctttgaggggaccatggtttagcaggtagtttcctctgctgttgcagttataagctacagtattgtaggttagtcaaagcttcttcatgagtcgttgttctttgaaactgcttggctctcatagttaatttatttactgtttttatgcaggccattctctatcaggtataactgttagaaaaaaatcctatttttctcttctataaaaagcattatttttgaggttacaaaaattgtataactaaagtactgccctacagtggtgttgaaggctaactgaacattaatagaatacttttatttcatgctatatatccttagattatttttaagttattttcattgcaattgtatgttattgtataagatcaggaaattactagttttagaaggactcgtaattccataaattaggatattcaatttttttctaatatatgtttggacttagatacatagaaactgagactatactaatttttaaaattgcagtaattaaaacatgtacaaaattgaattagagtgggaataactgagtaacttttaaatgtgttgtttttatgaaatgggtaaaggagttataatttaagtcacaattat

SEQ ID NO: 1991 - DNA, 68853 bp, Homo sapiens
ccatgcctgattttactctgttgttaattaagtttgtaattctgagtctacagtgtcaccattcttggcttagtttgcatcttgtaaaagaagaacgctgaggcatagggtgtccttggcaaagatgcggatgtccactgaggtctgcgtgccccttcccctctgtggactagctgctgcccagccagagactacacttcccagacccccctgtgatttgttctcagcaatggaatgatgagcaggagtaattggagcacttccagaccaaaagggacaaaaaacagatgcatcttttccaaactctcttctatatcctggcaggatgttggaatccacagcaaccttggaaaccacatgcccagagcccccatccttcagcctgtgtccccaaacacccatacagagtgagcgcagaccaggacttgatatgaatgagaaatagcccctcattatgttcaactagtgacattctaaggtctctccatcaaagcagcctttaagcttcaagtttatgactaacaatttacaaatactttcttgttaatatttttaacttaacttgacctagagaatgacaaccatgggaaataagtcagatatttttctcattttacaaataaaaacctgaagctaaaatgctgaaattgttccccaaagtcattgacaagcagcagagccaggaggcaggagcagggtcttggattaggtttgagtgcaagaaatagggtggtgccggcattcataccacagggctctgggtgtcatcgtgggcctacctgggactgcctccgtgattttaaggaattgtttaatttccctcaggaccgtttcttggataataaacagggaacaataggccatgtcaatcatgtaaagttgttgtaaagataagggaaggccgggcatgatggtgcatgcctataatcccaacactttgggagaccaaggcgagaggatcactagagcccaggagtagaaggttgcagtgagctatgactgtaccactgcactccagcctgggtgacagagcgaggctcacacttactgaacatctaccacagaccaagcactgttccaccatcttgaatctattgactcattgactcatccaaccaccctacaagttatatcaagttatatcctccctattttcaagatgatgaaattaggaaaagttaagtaatttctccaacaatgcatatccttagcctggattctccagagagccaagagggaggaagggagggtgggatccgccccaagctggttatcactaaatgcatcttcttgacctggtcagactgtccgcctagaagcttcttaaggtgtgactaatgactgtgagtctggggcaggaggatgcctgggtatgagcgctgagtagggtccccaggaagccccagggcagaagataagaggagcccaagtgagcctgaggcggggcacggccaggctgactgctggagtcagtgggagtctgtgcagagctggtcgccacctctgaggctggcacaagagacaggcgaactcgaaaaagcatgcagtcgggcaaagtcgggtatgttacaagcctacgatgtcatggggctagtctttctctccttgtgtgaaagacgtggttcccattcctgaccaaccacagggaggcatgcattgtgagctagttagctcctggtgggaacaggcttacacaaatccacacatatgttctgttccagtctacggccaatgcctgtcttggaggaagaaacgacccaagtacagggaagctgcagctttctgctcaggactgccagcatgtggagcttccaggtctagggtggatgagacacatccccagggaactccctctggctagatgattgaagatgttaacgatgcatatagttgcacccagccatgctcaccaggggagaaaaatgctgctgcccccaccaagcaagggtctttcaaggagctcctagtcaggcttgtgttttcaaatctgacacacacaaacacacacacacacacacacacacacacacacaaaggccaggcacaatggcttctgcctgtaatcccagcactttggggaggctgaggtaggtggatcacttgaggtcaggagttcaagaccaacctggccaacatggtgaaaccgcatctctactgaaaatacaaaaattagccaggcatggtggcaggcgcccataatcccagctacttaggaggctgaggcaggagaattacttgaacctgggaggcagaggttgaactgagccaagattgccctactgcactccagcctgggggacagggcaagactccttctcaaaaaaaaaaaaagaaaagaaaaagtttagttctttgattatacaagtaaatacttctccattaaaagtaatttatactgttgtagaaaaattggaggtataaatacacttagaagtttgaagagctcatcttccctggtctatgtcctctgctcctggagacccagcctctgtggccctgtgacctgcaggtattgggagatccccagctagacgtcatgtcccctgagatgcctagaaatggtctcttcccagggtgagagaggaatgaaaacttaaaggaaagaaactctgggcttccaagatggccaaataggaacagctccagtctgcagctcccagcgtgatcgatgcagaagatgggtgatttctgcatttccaactgacgtacctggttcatctcactgggactgtttggacagtgggtgcagcccacggagggcaagctgaagcagggcggggaatcacctcacctgggaagcacaaggggtcaggggatttccctttcatagccgatggaagccatgacagactacctggaaaaacggggcactcctgcccaaatactgtgcttttcccaaggtcttagcaatgggcagacaaggcaattctctcccgtgcctggctcggcaggtcccatgctcatggagccttgctcactgctagcgtagcagtctgagatccatctcctatgcctggctgggggaggggcatctgtcattgctgaggcttgagtaggtaaacaaagtggctctgaagctcaaactaggcagagcccactgcagctcaacaaggcccactgcctctagacttcacctctgtgggcagggcatagctgaacaaaaggcagcagacaacttcttcagacttaaacgtccctgtctgacagctctgaagagagcagtggttcccccagcacagcgcttgagctctgagaacagacagactgcctcctcaagtgggtccctgacctccgtgtagcctaactgggagacacctcccagtaggggccaacagacacctcatatagggggctgccccttagggacgaagcttccagaggaaggatcaggcagcaatatttactgttctgcaatatttgctgttctgcagcctccacttgtgatacccaggaaaacagtgtctggagtggacctccagcaaattccaacagatctgcagctgagggacctgatagttagaaggaaaactaacaaacagaaaggaatagcatcaacatcaacaaaaaggtcatctacacaaaaaccccatctgtaggtcaccaatctcaaagaccaaaggtagataaaaccacaaagatggggagaaaccagagcagaaaagctgaaaattctaaaaatcagagtgcctcttctccaaaggattgcagctccttgccagcaacggaacaaagctggacagagaatgactttgacgagttgacagaagtaggcttcagaaggtcggtaataacaaacttctccgagctaaaggaggatgttcgaacccattgcaaggaagctaaaaaccttgaaaaaagattagatgaatggctaactagaataaacagtgtagagaagtccttaaatgacctgatggagctgaaaaccatcacaagcttcaatagccaattcaatcaagtggaagaaacggtaccagtgattgaagatcaaattaatgaaataaagtgagaagacaaggttagagataaaagagtaaaaagaaatgaacaaagcctccaagaaatacgggactatgtgaaaagaccaaatctgtttgattggtgtacctgaaagtgatggggagaatggaaccaagttggaaaacactcttcaggatattatccaggagaacttctccaacctagaaaggcaggctaatattcaaattcaagaaatacagagaacatcacaaagatactcctcgagaagagcaaccctaagacacataattgtcagattcaccaaggttgaaatgaaggaaaaagtcttaaaggcagccggagagaaaggtcgagttacccacaaagggaagcccatcagactaacagcagatctctcggcagaaacctgacaagtcagaagagagtgggggccaatattcaatattcttaaagaaaagaattttcaacccagaatttcatatccagccaaactaagcttcataagtgaaggagaaataaaatcatttacagacaaaaaaatgctgagagattttgtaaccaccaggcctgccttacaagagctcctgaaggaagcactaaacatgaaaggaaacaaccagtaccagccactgcaaaaacataacaaattgtaaagaccatcgatgctaggaagaaactgcatcaattaacgggcaaaataaccagtgaacatcataatgacaggatcaaattcacacataacaatattaaccttaaatgtaaatgggctaaatgccccaattaaaagacacagattggcaaattggataaagagtcaagacccatcagtgcactgtattcaggagacccatctcaggagcaaagatgcacataggctcaaaataaagggatggaggaagatctaccaagcaaatggaaaacaaaaaaaaaagcaggggttgcaatcctagtctctgataaaacagactttaaaccaacaaagatcaacagagacaaagaaggccattacataatgttaaagggatcaattcaacaagaagagctaactatcataaatatatatgcacccaatacaggagtatccagattcataaagcaagtccttaaagacctacaaagagacttaggctcccacacaataataatgggagactttaacaccccactgtcagtattagacagatcaatgagacagaaggctaaaaaggatatccaggacttgaactcagctctgcaacaagcagacctaatagacatctacagaactctccaccccaaatcaacagaatatacattcttctcagcaccacattgcacttattctaaaattgacaacataattggaagtaaagcactcctcagcaaatgtaaaagaacagaaatcacaacaaactgtctctcagatcacagtgcaatcaaactagaactcaggattaagaaactcgctcaaaaccacacaactacatggaaactgaacaacttgctcctgagtgactactggttaaataatgaaatgaaggcagaaacaaagatgttctttgagaccaatgagaacaaagacacaatgtaccagaatctctggggcacatttaaagcagtgtgtagagggaaatttatagcactaagtcccacaagagaaagcaggatagatctaaaattgacaccctaacatcacagttaaaagaactagagaagcaagagcaaacacattcaaaagctagcagaaggcaagaaataactaagatcagagcagaactgaaagagatagagacacacaaaaaaaaacccttcaaaaaaccaatgaatccaggagatggttttttgaaaagatcaacaaaattgatagaccactagcaaaactaataaagaagaaaagagagaagaatcaaatacactcaataaaaaatgatcccacagaaatacaaactaccatcagagaatactataaacacctctatgtaaataaactagaaaatctagaagaaatggataaattcctggacacatacaccctcccaagactaaaccaggaagaagctgaatctctgaatagaccaatagcaggttctgaaattgaggcaataattaatagtctaccaaccaaaaacagtccaggaccaggtggattcacagcagaattctaccagaggtacagaggggagctggcaccattccttctgaaactattccaatcagtagaaaaagagggaatcctccctaactcattttatgaggccaacatcatcctgataccaaagcctggcagagacacaacaaaaaaagagaattttagaccaatattcctgatgaacattgctgagaaaatcctcagtaaaatactggcaaactgaattcagcagcacataaaagagcttatccaccacgatcaagtcagcttcatccctgggatgcaaggctggttcaacatatgcaaatcaataaacataatccatcacataaacagaaccaatgacaaaaaccacatgattatctcaatagatacagaaaaggcctttgacaaaattcaacagccctacatgctaaaaactctcaataaactaggtattgatggaacgtatctcaaaataataagagctatttatgacaaacccacagcgaatattataatgaaagggcaaaaactggaagccttccatttgaaaacaggcacaagacaaggatgccctctctcaccactcctattcaacatagtgttggaagttctggccagggcaatcaggcaagagaaagaaataaagggtattcaattaggaaatgaggaagtcaaattgtctctgtttgcagatgacaggattgtatatttacaaaactccatcatctcagcccaaaatctccttaagctgataagcaacttcagcaaagtctcaggatacaaaatcaatgtgcaaaaatcacaagcattcctatacaccaataacagacaaacagagagccaaatcatgagtgaactcacattcacaatagctgcaaagagaataaaatacctaggaatccaacttacaagggatgtgaaggacctcttcaaggagagctacaaaccactgctcaatgaaataaaacaggacacaaacaaagggaagaacattccatgctcatggataggaagaatcaatatgaaaatggccatactgcccaaaataatttatagattcaatgccatccccatcaagctaccaatgactttcttcacagaactggaaaaaactactttaaagttcatatggaaccaaaaaagagcccgtattgccaagacaattctaagaaaaaagaaaaaagctggaggcatcatgctacctgacttcaaactatactacaaggctacagtaaccaaaacagcatggtactggtaccaaaacagatatatagaccaatggaacagaacagagccctcagaaataacaccacacatttacaaccatccgatctttgacaaacctgacaaaaacaagaaatggggaaaggattccctatttaatcaatggtgctgggaaaactggctagccatatgtagaaagctgaaactggatcccttccttacaccttattcaaaaattaattcaagatagattaaagacttaaatgttagacctaaaaccataaaaaccctagaagaaaacctaggcaataccattctggacataggcatgggcaaggacttcatgtctaaaacaccaaaagcaatggctacaaagccaaaattgacaaatgggatctaattaaactaaagagcttctgcacagcaaaagaaactaccatcagagtgaacaggcaacccacagaatgggaaaaaaattttgcaatctacccatctgacaaagggctaatatccagaatctacaaagaactcaaacaaatttacaagaaaaaaacaaacaaccccatcaaaaagtgggcaaagcatatgaacagacacttctcaaaagaagacatctatgcagccaacagacaaatgacaaaatgctcatcattaatggtcatcagagaaatgcaaatcaaaaccacaatgagataccatctcacaccagttggaatggcaatcactaaaaagtcaggaaacaacagatgctggagaggatgtggagaaatgggaacacttttacactgttggtgggagtgtaaactagttcaatcattgtggaagacagtgtagcaattcctcaaggatctagaactagaattactatttgcccctccaatcccattaccgcatatatacccaaaggattataaatcatgctactataaagacagatgcacacatatgtctattgcggcactattcataatagcaaagacttggaaccaacccaaatgtccatcagtgatagaatggattaagaaaatgtggcacatatacaccacagaatactatgcagccataaaaaaggatgagttcctgtcctttgcagggacatggatgaagctggaaaccatcattctcagcaaactatcacaaggacagaaaaccaaacaccgcatgttctcactcataggtgggaattgaacaatgagatcacttggacacagggcagagaacatcacacaccagggcctgtcggggggtggggggctgggggagggataacattaggagaaatacctaatggaaatgatgagttgatgggtgcagcaaaccaacatggcacatgtatatctatgtatcaaacctgcacgttgtgcacatgtaccctagaacttgaagtataaaaaaagaaattagaaaaaaaagataatatgacaggctaggaagaaaggcaggtggaaaattattgtctaatgagcacaaagcttttgtttagaatcatgaaaagtttctggaaacagataatggcatggttatacaacactgtgaatgtatttactgccaccgaattgtacaattaaaatggttaaaatagtttttaaaaaaaagtttgaagaagagaactattatcacctaaaatctctcttctccccaagataaccacactaacattttggtgtattcctttccaggcctttctttgtagacatataaatataaactgcatttttaaataaaatggagttgatgatacaagtgttttattactctgctttgttctcttaacattttatgataaatattttattgccattaagaatgcttccaaaacacattatttatagctgaacaatattttttggatattcgggctgtttataatttttcactctgatatatggtgctgggatgaagagccttaaacagaagtctttgatcacatttctgattacttcctttagaagacacttaaaagtagaattactgggacaaatgatataaatattttaatgaaaatttttattgccaaatagtttccagaaattgaccaatttacagttctatctgcatctgtcagtgcagacacattgcaaaaacaagtcagtattttaaatgcttttcagagtagcaggaggaaatggtatttcattttttttgactcctatttctttgattaatggttctattgaccaattcttaatttgttgaccgtttggatttcttcttttaagaactgcttgttcattttctttgataatttttaagttggtatgttagtattttttattgactggatataattaggagctgcttatttgtcatgctcattgcaaatatttttgcctgttttcattttactttttacaattttttacaattttttatttttaaaggccagtcaaatttagcagtgggtgtcattttgcttttaacttgtattatacagggattttgtaaatatagctggtttggggacttttctttgttttacatggttaaatctaacaagagttacctttgtgattcctcccatgatctcatgcttataaagttctctccatcccaagatcagttacacatgctcttattttcttctagataattaagaaaagatatgaaatcacaacacattagtattggaagagttggcgaagtccttcatttcacagatgaagaaacttaggcttaaggggtaaagtaactcaaaaaccagatcacgcagccattaagtggaaaagccaagattttcctttcgattgaggtataattagcacacaataagatgcacaccgtctcaagtcatcagttcgatgggttttgataattgctgacgctcttgtaatcaccacccaaatcaagatacagaatatttccaccaccatcagcaaccactatctgagatctttcactatagggtattttgtctagatttggattttataaaaacggaatcataaagtactttttagtgaatgtcttcattcacttagcataatatgtttgagattcaaccatgctgttgtgtctatcagcagctaattcgttttttattcctgcgtaggatttgtatgaatctactatactatgaatgtactatatatacaaatataatataatatgtttatccatccccctgtttaggaacacttggttgtttccaatttggggctattatgaaaaaggcttatatgaataagtattttttggacatgttatttcatttcactcgggagtgaaattgctggggcactgaatggatgcatgtttaactttataacaaagtagggctaaggtttactatctgaccctagagaccatgccctaagccactggacacactgtccctcacagacccaagcactgagagatcaagtttaaatcccagctattctctgtccttgctgtgaacactttggcaagttccttaacctctcagtgcctggtttcctcatcggcaccaccgtcccactccacctcccaggggttgttgtgaaaactaaaagagttaatacaaataaagccctcagaatgagatcttgcaagtggttggtttattattatgaagaatgtctctacatttagtttgtcagatactggactgagagaatggttctcttgaaagtaaccaggaaaggcctccctgtgatggaggggccaccctttaagactgcttgcagcagaatgctatcccttcccacaaagtcagctgggcctgccataactgtcccagtgctccagtgtgctgcctcaagtgcccctgctgcctctgcagtgctcattctccaggtcttgttcttgtccttgtggggttcagcatacacagctctcttgatcagaaggtggccccagccagtccctgaggactcactgcttttaaatactccttaacacctgagcaggatcccacacgctgctctacctctcctccttaggggctaaccaaattgcacaagactccattggctgtggttaatccctgatgtcccagcttgcagtccgtctgcaggcaggtcttcggagggaacgcatttgcaccctggtgtagtactgctaggactggatggcagagcacctttccaaacctgagtgcagttgtccctcagaatccatgggggattggttcaagaaccccaagattacccaaatccatggatgctcaagcctcaagttttggatatcaaatggcctgcaacctaggcacatcctcctgtaaactgtaaaaatacctaatacaaagcctacacatcatttagtgtgcatgaaatccacatacttctcagcatgcaacaaaaattcaagttttgccttttgcaactgtgaaatgttctttcccaaatatttcagtcctcggttggtggaatccatggatgcaaaagccatgaatatggagggttgacagtacttcctaattccttctagaatatcacctacttctgcccttcctccatgccaatctttcccactggatgagaagctccataagggcagagtctaagaaaacttcatgcatggggcccaggcacatcattagtcaggccttcagtaagcattgtcgatggataaggcaaaaatacatttatgtataagcattcaatgcctatcttctcctctcaccctcagaggagatttctgccttctctcatagttcagtttctgggcttttattgaaaagatcagaaaagggttgaaaagaagaacagagctcagagatgctttttagatttctttggaaaatagaagcaaactattaatccaccaacaggagtacttatcatttataattatggctatgcatataatagagtatatagtgaaaatgcaaaatctaacacacacttatccatggactctatccgtgcacttatcaacatgcataaatcatgcaaagttcagttcttaaaatctggagagtgattcatgcatacatatatgtgataccatttaaataaaatttgaaaaatgcaaaatgttgctattattactatgatacctagttatgaatacatactatgtagaaatagtacaaaaacgtatataaaatagcgtgagagtgataaacaccaaattcaggaggaaggttatctaagttgggaccaaattatgtagataaattatttgtgaagaataactgaaagttttggagccacaactgacttgatcagagttgcagtttaggaaggtaaatcttacaagagaaatggaggaaaagttgattcattcaatatttatcaagagtccattatcagccagttgcagtgactcacacctgtaatcccaatgctttgggaggctaaggcaggaggatcaattgagccaggagattgagaccagcctggacaaatggtgagactccatctctataaaaacattaaaaaattagccaggcatgctagcatgtacctgtggtcctagccactcaggaagctgaaagaggattgcttgagccgaagagttcaaggctgcagtgaacgatgatcacgccactgcatactgcactccagcctgggcgacagagtgagacaccatctcaaaaaaaaaagaaagaaacagaaaaatccatgatgtgtcaaacacttgttacaggcacttgtgaatggatagaaacccctgccctcggttgcattctttctgctttctagccctaaggcaataaagcctgtttcacagctgcatctagtgagggcctagaacctcaggattggaaatgaggaggatagactacccaggtagaaggcacagcctgctcaaatatgcaaggcactgcatcaggtatgaaaatgaggtttggcatctcggtggcctgaaaaaatgggtgtccctgggtgaaaccaggaacatggaagtgagacagaatgagcacttgttatgtgcccagccctgcagcagggcccaagcactgcggaggtggatgtcatgttccctgccccgaagcagctcaaattatttctgacaaccattcattcagcagttcattcagcaaatactttctgaataagtgtgcggaaatctgtactgggtaactgtcatcctagcaacctagcaagaatgtgatctatggccccacagcagaatgtggctgtggtttgggggggtctggtgcaaaggtgagaggtaccctgactccaggcaggaaggagagtgagagagttacgatgtgcacttgtctctcacccagttcaagaacctgctcctctcctccttaaacactgttcattcccaggtcctggtccctcactggctcagcctccagacccgcagaccacagccataactctccaaactcaaaacatccactcaggggagataaatctccgcttatggaaggactttctctgggaaggagggtcagaaaggccgcctgaggcagctgaccgctcctgtgggctgaatgtcagtctggcgaagcagaaaacatctgtcagtgagtcagagacctgggtttcagtctcagctctgcactaaaagctgggggaccttgtgcaaccgcttcccctctctgggcctccgcttcttcattggtatgaaggcacacttagatctcttggggccactcctgctataacgattgtgtttcgtttttgagggctgctgtaacaaagtaccatgagccgggttgcttagagcaagaaatacgttttgtgtaatcgctctggaagtgaatagcctaagagaaagatgacagcaaagctaattccttctcaggattgtgcgggagaatctgtttcttgtttctgtcctggcttctcctggtttgctggcatactttggtgtttcctggcttagggacacatcacccggatttctgtcttgatgtccacatcatgttctccctgtatgtatgtgtgttgtatgtgcgtggaaggcgggggtggtgtctctaacttttttgggtttttttgagacagtcttgctctgtcacccaggctggagtgcatgcagtagcttgatctcggctcactgcaacctccacctcccaggtccaagcgattctcccatctcagcctcctgagtagctgggaccacaggtgtgcaccaccatgcccagctaatttttgtggtttttttactagagatggggtttcaacatgttgcccaggccagtccccaactactggccttaagtgattcacttgccttaacctccgaaattgctgggattacaggagtgagccaccacacccagcccggcgttcttcttataggatatcagccatattggatcggggcccaccctacctactccagtatgacctaatcctaactcattatacctacacctatttccaaataaggtcatattctgaggtactgtgggttaggagatcaacacacatattttgtaggggggcacaatttaacccataatgaccatcctgaccttttaattcctcctcccaggaatctgtagggtgactgtaacatttatcattcaaacaggggattttgagaatgaaaaggggaactactaacaattgtggcaaatgacaggtgtcactggggactggcccaggtgagcaggtatgctggtcccctcaggggcctgggggatctaccggggccaaacacgagggtggttgcagggcccagggctgcttccaccacccacggggtcatggtgtgacccagaggaaaactacatcatctctcaaaatgagaacggacggagtgaggggagagacagtgcctggggaagcgccaagggacacgaagaggctggtgctggcatgtggcacctggagtttagttggagaaaagtcaccattttcaagcagtagtgcttcctgatgtgtgagtatggccgcaagcccgggtgggacatgcacagtgtatgtgggactataggatgcatggagaagccctgcatctatctacacagagcgtttaatccatcctgggggacactgattcacgtgaatgattagagggcatccttatgctcagtggagaggaactgggctccttagtgcaatcaaagttcggaaaagaaggtattcagctgggcgcggtggctcatgcctgtaatctcagcacttggggaggccaaggtgggtggatcacgcggtcaggagttcaagaccagcctggccaacatggtgaaaccccatctctactaaaaatataaaaattagctgggtgtggttgcatgcccctgtaatctcatctactcaggaggctaaggcaggagaattacttgaacctgggaggcagaggtggcagtgagccgagatcacaccactgcactctagcctgggcagcagagcgagactctgtcctcacaaaaacaaagaaaaaaaaaagaaaaagaagcatttgagtgctgtaaagtaattgggagatttgtgctcacaaaggtcacttgagagcagaggaacgaaagtccagtcgtgtaagggacagtgaccagagtagcctgagtaaatacggccttgaaagatgaactgagaaactctcctcccatctctatttcctatattctcatgggatcagcataatttcttccttaaacatctggtaatactctttagtgaagccacctgggcctgcagtactctttgtgggaaggttttagattattaattcaatctctttcattgatgcgagtcaattccatattttcacttcttcctgagtcagttttgataaatgggtcattttagtggacttgttcttttcatctagggtatcaaatttattggcatataattttttcaaaatagtattttattaatgcctttaggatccttatgatgtcctagatacagtaaagatatggcacagccatgtaccacataaagtttcagtcaacaatggactgcatatgcaatgataatcccataagagtaaaatggagctgaagaattctgatcacctagtgaagttgtagccatcataacattgtaatgcaattactttattttttaataaatttagtgtagcctaggtttacagtatttataaaatctatggaagtgtacagtaatgtcctcagccttctgaatagtccattctcacactgctgtaaagaaatacctgagacttcataatttataaataaaagaggttgaattggctcacagttccacagcctgcagaggaagcatagcagcttttgcttctggggagacctcaggaaacttacaatcatggcagaaggggaaacacccacctcacatggcagaggcaggaggaaaacagaggtgggggcaggtgccacacacttttaaacaaccagacctcttaagaatactatgatgagaacagcaccggcggatggtgctaaaccattagaaacctcccccatgttccaatcacctcccaccaggccccacttccagtactgggaattggacataagatttgtgtggagacacaaatccaaaccatgtcaccttcacattcactcaccacttactcgctgattcaccagagcaactttccgtctcacaaactccgttcacagtaagtgtcctgtacaggtctaccacttttgatcttttgcactgtagttttactttatcctttctatgtatagacatacaaaaactactgtgttataataggatctaccatatagcctaagtgtgtagtaggctgtaccatctaggtttgcgtacgtgcactccatgatgtttgcacactgataaaatcacctaatgacacatttctcagaatgtaacctgttgttcagtgaagcatgaccactgtcatacatgtgatctgtcactgactgaaatgttatttggtctgtgatgatattgtaaatctcacaaagtattattataaaagagtcaacaatcttttaaagaaattcaaaaatgaaggaaagtatctcttatatttaatcaaatattttctgtttctggcacttttcattcctttgtgtatctaatgtctctctatctggtatcaccttaattctgtgttaagaacatcttttagcatttctagtaaggtaggcctcttggataaaaattctctcagcttttgtttgtctaaaaagtcttcacatcacttttcttagttttggaagacacttttgcttggaatagaatttttggtcaacaagcttcttttcttccctccctgctcttcaaagacatcacttcattgtgtctgacttgcatagtttccaacaagaaaacagcctcaaattttatatttgctccccaatacataatgtgtctctttttttttgctggctgggttgcttttttaaattttcattagttcacgtttgcagcaatttggttatgatgtgccctcgggtgcttttctttgtattttcctacttgaaattctcagagctttttgaattggtgtctttccagtttttataaatttgagcagtctttagccatcatttcttcaaatatttattctgcccccttttctgggactcgaattacttgtatattgaccaactgatattgtccaatgtgtcacaaaactctgttcattttttcctagcaattcaccattttttttttttttgagacgaagtcttgctctgttgcccaggctggagtgcagtagtgcagtctcagctcactgcaacctccacctcccaggttcaagcgattctcctgcttcagcctccctagtagctagtattacaggcacctgccaccatgcctagctaatttttgtatatttagtagagaaggggtttcaccatgctggccaggctggtctcgaactcctgacctcaggtgatctgcccacctcagcctccaaaagtgctgggattacaaacatgagccaccacacctggtaaattttttatcttaattgagcatttctatgattctatcttctttcctttcttggcgtatcagttatacttctcctaccttttttcagtcattgacctagaatttgcaatatacatttagaactaacccaagcccactttcaaataacaatatacagcctcatgggtagtgtgagtacattataataacaaaataaccgaaaatcctctttttattccttgtgtcattgctgtcattcatttcatttatatgtaagcatatgtaagtgtgaatatataagtatatttgtcacaagcatatatttatatatgtattcagttataaatcttatgtatatatcttatgtacataattgaaggtgcagttgctattattattttgaacaaactgttatgtgttagatcaactaagaataagaaaaataggccaggtatggtggctcacatctgtaatcctaatactttgggaggctgaggcaggagaattgcttgagcccaggagtttgagaccagcctggtcaacataatgagaacccacctctatatttagaataataataatctaaaaaagaaaaaaattaatgataagaagaataaacatttttatattgatgttcttcctttctttatgcagatctaaatttctgacctgtactattttccctctctctaaagaacttcttttaacatttcttacaaggcagatctactggcaaagaaattccctcagtttttgtttgattgagaatgtctttttttttttcttcacttttgaaggataatttcacagggtacagcattctaggctggcggggggttttctcccaaacctttaactatttcactacattcccatcttgcttgcatggtttctgaggagaagttggatgcaattcttagctttgcatctctctagcttagctggtttttccttctgtcttctttcaggatatttttctttatctttggttttccgtaatttgaaaatgacatgtctaggtgtagttgttttggcatttatcctgcttgatattctctgagcttcctggatctgtggtttggtgtttgacattaattttggaaaattattggtcattattatttcaaacatttcttctgtttcctttctctttttattctccttctggtattccgttacatgtatgttacaccttttgtaagtgtctcacagttctgtttcttttttcagtctctgttctctttgcttttcagttttagaggtttctattgatctacccacaagctcagagattctttcctcagccatgtccagtccactaagaattctatcaaaggacttgtccattcttcctttctctcacagtattattgatctctagcatttccttttggttttccccttaggatttccatctctctgcttatattacctatctgttctggcatgctgtctactctatccattatggcccttagcatattaataggagttgttttaaatctcctgtcctaattctaatatccctgccatgtctggttctaatgcttgctctgtctcttcaaactgtgtcttttgttctttagtatgccttgtaattttttcttcacagctagacatgatgtagtgggttaaaggaaatgcagtaaatagacccttagtaatgtggtggtaaagtgtatggggggaataagcattccatatttctatgatgaggtttctgtctcttagtgactctgtgcctctggactgtgaacttctcaatttttctccaccttaggttgggcaggatggctagagtagctgaacttgggttatttcccctctcctacatagaaggatagagctggctggatttgggcatttcctccttccctcccaggtcattaggctctgataaaattccagcaggttagactctagttaactaatttctcccgacagcagaccttgttaagacagagtgttctggcatatttcaaaatggctcctttctctctcccatcctgctgaaagcatgaggagatttttctccagtatttactgtgagaacctggttgatatcctgaagacaaaactcacataagtgttgggggcctcctaagactgggtctccctagagcttttaagtctcagatttgtccacgcctagactccatcagcttgtcagttacagttccggttctcccaggcagcagtggttcctgcagaggttgctgctctaatgtactatgattctctgtatttgcttgtctgtctgtttaatttagggggcagtagtttgccctatgacatcatttctcttatgcatctaagaagagtggttgatttttcagtttgttcagctcttattgttaggacacagtggcaacttctaagttccttatatggaggacagaaagccaggagttgcatttttcatttcagatattatatttttccactctagaatttctgtttggtttttttatatcttccatttctctctccattatcttcatattttccactagatttttgagcatatttataatggatgttttttaaataaatttttattttagaataattttagatttgtaggaaagttgcaaaggcagtataaagttactgtacacccttccttagattcccttaatgttaatatcttgcataactctggtacatctgttaaaagtatgtgttgtggctgagcacagtggctcacgcctgtaatcccagcactttgggaggccgaggcgggcagatcacttgaggtcaggagttcgagatcagcctggccaacattgtgaaaccccatctctattaaaaatacaaaaattagctggacgtggtggcacacatctgtagtcccagctacttgggaggctgaggcgggagaatcgcttgaacccaggaggtagaggttgcagtgactcaccactgcactctagcctgggcgatagagtgagaccctgtctagaaaaaaaaagaaaaagaaaaaaaagtatgtgttgtgagttaaactgaactccccaaaaaaggtattgaagtcctaacccctggtacctgtgaatgtgaccttacttgcaaatagggtttttgcagatgtagttaggttaagatgaggtcatactagagtacagtggaccctaactccagtatgacaggaatccttataagaagagacacacaaggagaaggccgtgttatgaaggaggtggagactggagtgatgcatctacaagccaaggaatcccagggtttgccagtgaccaccagaaggcagagagaggcgggaatggtttctccctaaagcccttcagaaaaagcacctccctgccaacatcttcctatcagactcaaggctccagaactgtgagaaatgaaattctattattttaaggcaccctgtttgtgatactttgttacacggtcctagaaaactaatacaaggaaaatactaacattggtacattactatacaccaaactccaaactttgttcagctttcaccacttttccccctaatgtcctttttctgttctggaatccaatccaggagacagtgttgcatttagacactgcatttctcctgtctcctctggactgggacactttccaaactttgttttccatgatcttaaaagtactggtcagcattttgtacgtgtttcccagttagagtttctttgatatttttcctcatattaggctagagatatatggggttgttctttttttttttttttttaaataccagacaggtgaagtgccctctcataacatcatataggggataaatgatattagccagatatatcagcagggatataaaccttgatcaattggtgaagatcgtatctgtcagatctctggctgtgaagttaccatttttccccttccatcctctattctttgcaagtgagtcactaagtccagtcacactcaagcagatggaaatagggaaaattaaattacttttctgctaattccacatgtctgtcatttctgggcttatttcttttgagtaattttttctctcctggctatgggttacattttcctgcttctttgcaaatctagtaattttgtgaatgttacattcttgagtgttagattttgttgcatttctttcaagagtgttgcactttattctggctttcaggtgagttattcagacatcagttgaatagtttgggctttaaaaaaaaagaaaacctttttatcaggcaggagatctagagaagtgttattctagattagttaagtaccactgccaagatgtgtactttctgcggctgttcaagtattaaactaggtttctccaagctacctagtggaattgaatgtgtcccagtcctgtgtaagctctggagatctcttggccagcagcctctcggcaattgttctttccccagtggttgttctttgcccaatcccaaggatgccatcctgctcagccccagactcaagagaacccctctgcacatttctggagtcattttctgagtagtttattcatctctattctctgccttaaaagtcccagctccctcagcctccggaactccaatctctgcctcaacaggaccactgggttctgttggggttcactcttcctgcaccctggttcagaaatcccccgcaagcagggagccagggaaattgtagggctttcttgcttcattttccttctcccagcaatcacagtctcagtctacccactacccagtgtctgacaattgtcattgcacatgtctttcttatccagtttttcagctgtgcgtgacagggagacaactgccgatgctcttaccactcaaggcaggagtgcttctaagttttctttctctctttctttctttctttctccttccttccttccttctccttccttccttctccttccttcctttctcttttttcttttctctttctttctttctttctttctttctttctttctttctttctttctttctttcttctttcgacagagtttcgctcttgttgcccaggctggagtgtgcaatggtgcaatcttggctcactgcaacctctgcctcctgggttcaagcaattcccctacctcagcctcccgagtagctgaagtttccatagttcttctcggccctctattccctgaaaggagtaactgcttgctatagtccctgccttgtaataccttagcagtcggttgagccttttcagttctccaatacaaccagagagctgtgttgctaacagggatttacactgcgctctctccatgggagtaatatgtgtttccatctcccatcaggaccgcccaccttccttcagagtaaaagcgagagatggagcggagggctggtggcatggtgacaggtgatacggatggtcacctttttctgcctaaagaaaagggggcctataactagaggggaggcccaggaagagttcccaggggagcccacacggtgttccctggagtcaagaggccccaggtcaggtgtccgacctttacaggagagccagatggccagagcatgggttgctatgtggaagggccagcaatgagagggttgtcctggagtgcctctcggggactggcagggccacggagccaggtgcttcctctggctaggccatgctagccaggcacggtggctcatgcctgcaatcccagcactttgggaggccaagtcaggaggatcagttgaggccaggagtttgagaccagcctggaccatatagcaagactccgtctctacaaaatataaaaataaattagctgggcctaacggtgcccacctctggtcccagctactcaggaggctgaggcagaaggatcacttgaaccaaggagatcaaggctgcagtgaacaattatctcaccactgcactctagcctgggtgacagagtgagaccatgtctcaaaaataaaataaaataaaataaaatgaaaaataaaggccatgttcacaagcgcaccctccaggaccagatagccccagcagacaggtgcaagctgggcctccaggagcaggaactgagggaactgtgtcacatggaagatgggaggtccccaaggggaagggagagggtgtccaataattcctaaaagtccccagagagaaagcctcaccttgggcaccaaccggcccagttagaaggtacctactcagttcctatcgccagccagggatgactgcttcacccctttatggctccccacctccctctcacccacctcccaacaagcaggagagccagcaggggccgttgaactaagtctgatctgaagctgcctctttgactattttaagtttggcctaaagttctttccatgcatagtgagctgtaagctacctggagactgaacagactgcagcctactcttgtgccaatcaccgagtttctggcaatcgaaagcggccaactgttcaaactctgttcacataaggcaagtgcccagctgcaatcaccctgctgcttctgcacctcacttctgtgttctgttcctcactttcccttttttgtccataaaccttcttccaccatgtggctatgttggagcttctcggagcctattctgctcccggctctgcccaatgtacaaatcattctttgttcaattaagcctgttaaatttaatgtttttttaaaaaaatttaatgttgtttaaggtttttcttttatcacagaggaggaagacacacagagagggaaaagatacaccccttcctctactgcaggtttaggaggctgtggggcagggagagtggaaagtttaacttcaataagaacgttaaggccgggcgcggtggctcacacctggaatcccagcactttgggaggctgaggcacgtagatcactttaggccaggagttcaagaccagccatgaccaacatggtgaaactctgtctctactaaaaatacaaaaataaaccaggcatggtggtgcatgcctgtggtcccagctgctcaggaggctgaggcaggagaatcacttgaacccaggaggagaaggttgcagtgagccgagatggtgcctctgtactccagcctgggcaacagagtgagactctgtctcaaacaaaaactagaataaaataagataaaaacctttaaaaactcctttagattagtctggactatttggtacaggaagatgagacagtgtcttagtacctgcaaaggaccagaaagcaatggaatctaaatgacgcccccaggacagggatccaatggagcaggcgggaaaggcagtcaggtggaaaatagaaaatgatttcattatttcagccccagcctagctccttcagtaaaccagttacaaatattagatgcatgaaaatcttcataggaaaagagatgggagcccagagtcccagacaaagagcaggcagctgctctatcttccctcggtgccctgccaccccacggcttcccctgcaggccacgctgagtcccccaaccctgcggcttcccctgcaggccaccctgggtacccccctaccccaccccatggcttctcctgcaggctgttctgtctttcctgagtcccccaccccacggcctcgcctgtaggctggtggcagtcctcagctccagaccttccccacgacccaaggttactctcagggtggagccagaaacaccggccctagctcccacacacacctgaagacctgtgtccctgcctaaccatgtgggaccccagcacaggtatgtagatgtgacaggccacctgcactccagctggagagaggaaatagatcaggcatcagtcagcagccctcagcaaaccatatgaggctagagcacgcgtcaccctaggaaaacggagcctcttccgggaagaatatcttctcaaaccagccatggtttgagaaaggctgtcaggaaagaccagttgttgttttttctgtccaatctgtcacagatctatattttgtaaaatgcagtacaaatgagttattaggaaaaattgaataaaaacaaagcactcaaaatacaagctgaaaatttgtattattagattggacggacataaaattactccatcaaattacaatttctgtacttatttcttcatgggccagccacagccagtccacggaccatgctgtgagcagccccagcccggccaggaactgttcatggcagccagccctggccactgcactgcccaggaagctggtcattaaaacttgcaggccatttggcagacctaggccatacctttcgtgtctccctgctggcctctccagcctccttaaagccacttctgattaggtcagttcccctggcatcagccttcagcagatcccccagcgtggatccacgtcctccttctctgactgctgtgccctcttcctgacctcgcgtatccagtcctgaccgctctcaggctccacttcactgccccaccttgtgagtcctcccaataccatcactctgaggattttcaggggagttcgtccacacttctcttatttctcatttcacttcctactcagcactggggttcttataccgacctcttaccttccctgcgagatcgtaaaatccttgggggcaggattcatttctgacttatctttgcatccttcataagagctggtacagtggctacccccaaaccactgacttttattaatgattgaaaacattaaggccagtcgcagtggctcacgcctgtaatctcaatactttgggaggccaaggcgggaggatcacttgaggtcaggcatttgagaccagcctggccaacacagtgaaaccccatctctaccaaaaaatacaacaattagccggatgtggtggtgtgtgcctgtacttccagctactcgggaggctgaggcaggagaatcacttgaacccaggaggcagaggctgcagtgagctgagatcacaccactgcactccagcctgggtgacagagtgagaccctgtctcaaattaaaaaaaaaaaaaatagaactctctccctgagtctggatggagtcatttgggcagagataagcagctgtttgtctgttcttcctaccttgagtgccagtaagtcccaggccctgaaggcccccagtctgggaagttccctcagcactggggaaaaaggtcggtcgctaagtggacagtttgatgcgctctgtgcctctctgagcccttcagaaaacgaggacaccagctgtcccctgtctcaattgagcaggacgtctcctttcatttctcctgggcctcttactccctagcagggtgtcagagcccgctgccagttgtcccaagatggggaagcggccccgacagatggaagatagctcagtgctgtgtgaagggaaacggcttttgtttcagcccccggtgtgtgtggcaggcacgaggcttgatgacagggtgatgagctgtggaaggaatgcaccacagggctggaacacaatcgtgctttgtttttgttcttgcatctgagaatgcccctggactgatggcagcgacgaggcccaatgtgccacatttcatcctacaggcgccaatccacatccccccaccgcagagaggtggctcttcctgcaatccggccgcgatgcgcctgctgtaaatcagcgtggctccccccaagtcaaaggccgtctgaacaaggtgacagagaaatgcaaggaggatggacagcctcgtctggctctgccttggagggggaggctgcctggcctcccacagccgggacaggttccctatgtgcagcgctgcctgcgagagggtccccaggatgaactcctgctgtgtcactcctcagaacccgagtcctgtgccaaggacggtaactttagctatgaaggggagtcaagaaagagagaaaaatgaggagaaagcaagaaaaacagaaagattgaggacagggggatagaaggaggcagaaggggagaaatgaaggaagaggattttaaaaaataaaaaaaaaaagaatggacgcagcaaaccaccatcgcacacgtatacctatgtaacaaacctgcacgttctgcacatgtatcccagaacttaaagtaaaattaaaaaaacaaaaacaaaaaagagagtgtgtgcagggtacctcccctttacaaaaccgtcagaaaaaagaaagggaatggacaagaaagaaaagacgggaaaaaaagggaaaaagtaaggacatttttaaaggggggagaagagatggcaaataagaaatgatgttggcagtaatggcttttgagagccttactgattgatagaaaatatttcttagataggtttcccctccaggagaggactcttggttcaagctccctcctctcatgctggccaggagcagggctgcagaggaagctctgagtttctcagagaagcctagcactcccttctcttccttctaggcagccaaagtcctgggaggcacaagaaagtgagttacaagttccactctgtcccacagggaggctgcaaagtggtgtcatctctcagaggaagtcggctgagctggctggaaagtgtgtaagtgtgtgtgtatgtgtgtgtgtgtgtatgcgcgcgcgcttgcagcttctctgccagagttgggaaatcagaggtctgatcacttttgactctggtgtagctgttttcctcttgtaatcctcagtgtggtgagcagaaggcagtggaaaacacactccgtgaagtttttttccattagaaggtcactaaactgtgtaactcagaaataaggttctgctgcacacatagctttcaacttacatattcctggactttggacaacatcttttgtcccagaaatgagagaaggaacaacacttttaaattatttttaatttttaattgtggtaaaatacacataacataaaatttaccatcttaaccacttcaagtgtacggttctgtggcattaagtacattcatgttattgtgcaaccattaccaccgtccctccacagaattcttgcaaaactgacactctctacccattaaacaataactcctcatttctccttaccccagcccctggcaaccttcaacctattttctatctctttgactttgactactgaagatacctcacataagtggaattatgtagtatttgtctttttgagactggcttatttcacttaacatcatgtcctcaaggtgcatccacattgtagcatgtcagaatttccttcattcttagaaaaagcaaatgctattgtgtagtacgtatacagcacatttcgtttttccactcgcctaccttttggctattatgattaatcctgctatgaacatagatgtacaaatatctctttgagtccctgatttcagttattttaggtatacactcagaagtggaattgctagatcttatggtaaatctattttgaagcttttgagaaactgctataccgttttccacagtagctgcagcattttacattcccaccaacattgcacaagggttccaatcactttctccacatccttgccaacacctgttattttctgttgtttatttaagagattgggtctcgctatgttgcccagactggcctcgaatttctgggctcaagtgatcctcctccctcaccctccttaatagctgggattataggcacatgacaccacatccagataatttctgtttttgatagtagccattcgaatgggcaggaagtaatatcccattgtggttttgatttgcatttctctactgattagtaatgttgaacatcttttacttgtttatctgccatttgtataccttctttagaaaactgtctattcaggtcctttgtgaattttttaattaggccatttggtttttgttgttgttgtagaattgtaggagttctttaaatagtctggttattaatcccttatgaaatgtatgattttcaaatattttctcccatgctgtgggttgccttttcactctgttgattgtgtcctttgatgcaaagaagcagaattttaagtcaactgcaatactatggcacttctcgagatgtcactaaatgtgagagagaggccaggtgtggtagctaatgcctgtaatcccagcattttgggaggccaaggcaggtggatcacaaggtcaagagatcaagatcatcctggccaacatggtgaaaccccgtctctactaaaaatacaaaaattagctggatgtggtggtgtgtgcctgtagtcccagctactggggaggctgaggcaggagaatcacttgaacccaggagactgaggttgcagtgagctgagatcgtgccactgcactccagcctgacgacagagcgagactcagtctcaaacaaacaaacaaaaaaagtgagaaagaacaagataaaaccctaccctgatgactgcaaagtgtgtgcacccccatccaccagtatttcagcctagcctcaccagaacttgttgaccaagttaggacataacccacctcttccattaccttccctatcagagtctgtatgtgaggttcccagaaatcctttctttgcagacctatgctaaatagaaggttttgtgtttgggcttttttgttgtttcattgtctggttgggttttgttttgatgttggtggtgttttggtttgtatctctgccttctgactatggtttttcaagtcctgcagcaaggaatcttgcagaattaacttcacataaaggattcaaatgaaccacttattcggaagaaaacatcccaggtttgctggccagttcagctctccacactttgcaccaggagggatcattctaaaaagtgatcccaaggggagtgagccagatgcagacatttaactgttctgcaagataaggacttgaaagcatcttataagtgagcactcagcattcaaggtcctggctctaagttttatgagccctaattctgatccagtgtcagctgctggattctctgccaaagaaatactggaaaaccagcttttcttcaatttcattggtatgtcagccactgatggacatcgtctgtgaagccagaccaacctttaaaacatccaaatatattggaatgagtgcatcattttcttttcgcaatggaaaagcaaagctagtttaatggacgacgacgtcaacccaatagtgccaatagtgggtgggggagagtttcgcaggcagggacaggaaaggtcctggagtgctgcccaactctccccactttagagtcacttgcctttccccagggagccccaccaggccatgctctgccacactctgaagtccaattggttcaattcattcctcttctttcttaaccaccccttacaagtttcttgaatttaaggcatgtgcaaggcactgtactgagggcaatggcagtggggagggagacacagagctcatattatacacggcagctgtcctcatggtgctgacagacaagtggaagtgatgaaggaacaatcaagaaaaagagtgatcaatacaggccgggcggggtggttcacacctgtaatcccagcactttgggaggccgaggtaggcagatcacctgaggtcaggagttcgagaccagcctggccaacatggtgaaaccccatctctactaaaaatacaaaaaaattagacaggtgtggtggctggcacctgcagtaccagctactactctcaggaggctgaggcaggagaatcacttgaacctgggaggcagaggttgcatgagccgagatcacgcgactgcactccagcctgggcaacagagtgagactccatcccccaaaaaaaaaaaaaaaaaggtaatcaatacaaagcagacttggtaccacaatttaacattccactcgaccccaagtatgtaggggcttccagcagaggggccagtgaggaggggaagtcccagtgacctggcattggaggtacattgtacacacagacaccaacacaaacacaagcacacatctcaatgccagcacccacacacgctgacactgatatgcacccacacacattcacagatacccatacatatacacacacaccctaaaaaagggatgtgctcttcccacatcagtgccgggatacatttttttttaaacattcctctcctaaaagaaatgataaataggttgggcatggtggctcataactgaaattccagtgctttgggaggccaaggcaggaagattgcttgagttggagaccagcctgggcaacctagcaagatgccatctctacaaaaaatacaaaaattagccaggcatgctgatgcactcctgtagccccagctgctcaggaggctgagctgggaggactgcttgagcccaggagtttgagcctgcagtgagctatgatcacgacactgcactccagcctggggcaacagagcaagaccctgtctctaaaataagtaaataaataaataagaaatgataaatggacaaaaacccagggcttcctaaagcagtttggaggcccaagaagacagcccggctgaatttataacatatcaccatcctttgccccattctagataggtttcatatgcaccttataaaaagtacaccccaacttcctggaaggggtggggtttttaaaggagtagattaatgttcatgggtggtagttgctagagttccaggtgaagaagagaagcaccaagctctgagtgttttttgcagaattccaagtcctctctgcagatgtacatttattcctgtaagtggatgctgggctttcgttttatgtaccctggctcaatttcagcgcaggtcaagttcaaatgcttcatgcggcatggacagtgatgagccttgaggaagtccaggtggttctgattaggtctggaagcacataactcatccaatagagaacccaatcaattgcaaaggtctgggtccctgttcctgcctgctgggtccaagtttcattcctgttggaatgtaacttcccgatcaaagacaaaatctttgattccttcttcccacctaccctcccaacaaaaagtcaccgaaaaaaaaaaaggctggcttggaattgaggctccagaggtttatttggacaccacccaccctttgtaaatcaacattttaacgagttaagtgcacatgaatcagaaacacagggtcacatttcctctgaaatacttgggggtggggatgcaaaatgcactccgaatttggcccagtccagaatcaggaggcaggccaggcccttgtcaagattctctcatcccagtgttcggcccagcagccgggaccatttcccccagccgtcctcagctgcgtcaggactgagcggaatggtgctcacatgccctgccggccgccactaggataatccatgccaaccccacagaatgggaggcgagcgatactgagaacaatgaaggggtctgacatggaaatttcagtaggaaacaagcaattacatgagaacaaacattcccagtgccacttacaacaattggaacacaacagtgattataaaaatgaaagcaacaaattgagagccagggcagcatgcaccttaaaacaaattgtcctcctggtgcagagctgcgaccctctccctgggcaactgtgtgactgtgtgtgtgtgtgtgtgtgtgtgtctgtgtgtctgtgtgtgtgtaacacatgaattttatttgacttgtcttagaggctggatctcttatccctgcggtagaaaccacttctcctgagcaaactggtttccatccaccaggcagggaggaaacagtgagaaaactggagaggattttctctggccctgctataggttcagtctcaggactgtgggaaaatgtgcacggcaggggaaaaggcctgtcttctccaactcagggcagaggcaggtttctaatgaagagggcctaggaaagaaatattttgcagggagccaaacgtaccaggacataccagctttccttgttttcttcatcaagatccacagaacagtgaagctcattctagggttcgaaaggtaaattatttccttccatcggttgagtgaaaatcagtcctctgggtctcatgcacatctactcagtctccattatgggatgccttccttatccagctccagcctgtgtttctcattcatagctgtcaattctggcactgcagggaggaggcatctgaaaataaggcggcagcctggggaagtctggagaggatgcagggagtttctgcgtggcagtggttggcaagtggggagcagagctagcaaggcttcacgctgatatacattgcaatttacaggctggtacttatttttttctctaggcaattactggctgcctcctgctcctcctcttctgtaggggccttggggcctccctcaagcctggcccagctcggggcctgatttgtgcggctaagagtcattgagcaacctgccaagactagcagccaagtttggattcctatggccacagctgctggccttgggagggagcactgaccccagaggaatccagctaaatctgtggaacccaccctggttgtccttgggccacattgtgaaatatgcacttagattgtgggttgggttgtggcatgtgatctctttattccttcagatgatgggcctactcatctagttgatggggcaagattacccagatctgcataagccccccagagaactatgcagcaaaaatggaaactgaggcccctaaaccacccttccaccctcaatccattcccaagtacaaacaataacagcagatgctagtgtaaatcattaaaaagtgcaatagatggctgagcacggtggctcatgcctgtaatcccagcagtttgggaggtggaggcaggaggattgcttgaacccaggagttcaagaccggcctgagcaacatagtgagacttgtctctacaaaaaaatttaaaaattagcatggcttggtggcttatgcctgtagtaccagttaatcagaaggctgaggtggaaggattgtctgagcctggaaggttaaggctgcagtaagccaagatcacaccactgaactccagcatgggcagcagagcaaaaccctgtctcaaaataaataaataaaactaaaataaaataaaaagtgcagtagagatggggatcttgtgcaaagcattttagcagaatctcctgttttctttctaattcccttccttggaaggaaatttattgtgcagttctgggttttttttttttccatttcaatagatttagggggtacagattgtttttggttacatggatgaattatatagtgaagtctgggcttttagtgtaaccatcacccaaacagtgtacactgtacccaataggtaatttctcattcctcaccccactcccaccctctgatcttctgagtctccagtgtccattataccactctggtggacctgtgtacccacagcatagcttccacttataagtgagaatatgccagtatttggttttccagtcctgagttacttcacttaggatagtggcctctagctccacgcaagttgctgcaaaatacattatttcattttttatggctgagtagtattccatggtgtatgtataccacatttcctatattcactcattggatgatgggtacttaggttgattccacatctttgcaactgtgaattgtgctgtaataaacatacaggtgtaggtgttttttgatataatgacttttttcctttaggtagatacccagcagtacgactgatagatcgaatggtagctctattcttagttatttgagaaatctccatattgttttccgtagaggttatactaactttcattcccatcaacagtgtataagcattcccttttcactgcatccatgccaacaaactgtgggttctgattgctttatttatatttaagccctgacacccggggatctcagagaagctggatccctggatcctacctggccagccaatgggcaggcttcctgagggtacacagctttaggactgtggactcaggcactccagggaagcgggaaataagaacttctccttagtgcttgcaactgccacatcagaacttagctgaaatccgagggatcggatcccaaatccttcctcaccagcccccatccaccagtccttttgctcaggtgataggaaggtcatcctaatgataaccacgtggtgggtttcagctgtggaaaattcctggcccctttctccttcttcccaccccctccttctccccttaagcacacacacatgcagctttcccttcctttatttaagcaaacaactctccatgattgggtacagccccttcttatctaaatagtctgcagatgcatgaagatgcaggcgctttctgctcctattcggagcttgttctggtgcccatcttctccaaacctacaacaagtggcctcccttagaccttgctgacagcaatccctactgcctgctcccctagtaagtcagctcaggggacaggctgtcctcaatgtatcaggggtgggattttccctccaaagacttcaatttcccctctctttcttggctcctcccataacctgaggttgaaactgcccagacatgagcaaatggaacagggaaagtcccaattttgttgtcagattcctatgtaactttagttgtccaggtacataccaccagttggttaacaccatcaacccctggtgggtctggggatgggggctgaggactgggaagtttggtaaagggcacagtccataatgttaatagatgggaaaaataggaaggaacctgtgagtttccataatgagcagggtctgagggaaaagaattaaccctaaggtctaggacaagaatgaaatctaatgagtgggttgagaagatcagccccagctttgggtttataagcatgactctctggtttgattttcttcccattccaaagcgtggtcaatattttgagtccttaggagatgggctgtgctgatcatagagatggtgatactgtaacagggggtgaggacgcacctgaaaccatcagcctgttagagcttccctacccaaagtacattctgcacactgacagcttcacagcttcagcctcacccgggtacccaaggaaacgtggtacacatacactatggaatactacgcagccataaaaaataacaaaatcctgtgctttgcagtcacatccaaatgccacatgttcttactaataagtgggagctaaacaatgggtccacatggacatcaagatagacagaatcaattctggggactccaaaaggaggaaggggtgggggcaagaattgggaaatttcctattgggtactatgttcactatctgagtaatagagtcaatagaagcccaaacctcagcatcatacaatatacccttgtaacaaagctgcacatgtgcccccaaatccaaaatttatatttaaatttttaaaagattattcaaatgttaatatggcccactagtagtttgcaaaaaaaattatataatctttggattaagaaaaataacctcttttgatattaaaagcattacgagtcatgtgtgctttaggtacttatggattatttgacaaagctccattggataggccatgtatgtctttatacaaataaaactggaaaaatatgaggaaaaaaaagaaaagaaatgcagaattcaagcccacctcagacctacccttcagaatcggcattttaacactggtcctcaagtgagtcatatacatattaaaatgtgagaaacactccttggacagccaaatgtactcagtcttaaggaaagagggctcgttcccccttgcatttaacttgcctctattagctgatgccgggtaagatgaactcacagagcttcagaagggactgcggcaatatgaagtgtggatgtggggagagggagatgacaaaataacttcctgcctctcatccccgggccacgcaggtcctatgagaatgttttgcaaagtaagatcccgtgaactgctggcatcagagaaacctagcaccttggttctagagcccctttgccaaccttcccaaactttcccaatcagaatgtctgggggtgggagccaagacccacatattagtaagctccccttggtgatactcacataggctgaaatttaagaacgattctccctctgcccttcaattgctattggatgattagtaccatgtcccaccctcaggagcaaaagtgaattgctagcacttctggacccaaggaggggagacagcctttgaagttaagaccagcctacctctgtgtcccttggtcttttatacctcctgcctagggaagtgccgaaatttttcattaaggaggtgcaggtgccatgcagcttgaggacaagcctgtggttccaagtgctgccagcatctctgaggcacaagcgtcaagcagtcctgacccttgggcaccccaaactccaccacggtgactccagcagctggaactgagatacctttgcacacacttcatcatccttttgcagacttaaaaaaaatggaaatggtgggtcatggtggtgagcttcagtagggggtggcaatgacatctccacccagcctaaataaattttctttcttattaaccacagggagctaaaaggaaatatggacattttccttggctggactagtatctcactattttaccagtcaggtacattagcatgtgagaatctttctggactacagcatgactttgatagaatgtttacaagtcctcataccacaccttaaaaaaaaagttgtgtctctgtgcttgggcgtggatttgggtaacctgggaatattttatcacttctgggtaaaactgacagttgtctgcggtttggaggtgacttactgatcagggaactacatccactgaagttgtcactgtaattgcttgcagaattagaagtcacatggaagaattcctgaggcaagaagcacataacctaatatgaaacagcttgggctgggtatggtgcagcactctgagtccaaagggaagctcggcagggagcgcagacatcacgcctacgcaagtgggatgcaggagccctgggttctaattccaaccaggcgagtgacctgggagtcccagactagttgggaaatcccagctatatccccatcttacgttaaaagagtggatatgttcctctccaaggcctcctatgtgtctaagactccagataaggacaagttttccaattctagttggtaattctaacattgagttgagccggaggggaaagagaatgtttccatgagaaacatggaaaagaaattcaggcagggccgaaagctacattcttgtagagcaagcatttaaccttctctctgatctgaaacacacacaaccaggagaaacacttctggaagttatttataggagcagatggtaaatgggagggtgggggccacgggtagcctgtggtgcctcccaagttctccttcagcccacccacacccagttaccatttgcaagctgttgaactgggaccagaaagcatcactgaagaaactcaagaggagaaagatacatgtggttcaccggaaagggtgagaagtgtatgactgagtgggaaaaaaaagtcacagctcacagtatcattgattaattgagtgattttagtcaagtgaatattgatacatggctgaaaaagcatgaaaataaaatgaacacgtacgggaattactattaacataagcgataacatcaaaacatctggtaaaatgcagttaaaaaaacaacacaaatgaaatggaatgtaaaacattttcacagtattcaaagcttttgtaagagacttaggatctaaaagaggagtactacaggaagaaactagaggaaacgggaatttcatccatgtcctgtgtatctgctggcaacaggtcagaacggccagtatgttattccctgcaggctgcctagggtgctctcctcaaacagatcacctgagcctcctgcatctatgaagttatgacacagcaaccagttactcagagtctgatgagaaaaacagattttaggtttgggaaatgggattactgtaatttacacatccaaatgcaaactggagctctgattgaattctaccctggggagaacttgatgctaacccacaggtaccaagagccaagtgttacacaggatattttaaaaataaaatgtttttggaatcctcacctcccatgctatcttctaagataactacaaatattcttcaaagatttaactgagttctgccaaggacctcccaggactctatccagaatgattattgtaaagctttacaaatcccaccttggccctagcgataattaggaaatcacaggcaaacctcctctctcggagaccaatgaccaggccaatcagtctgcacattggttttgttagatactttgtggagaaaaacaaaggctcgtgatagtgcagctctgtgcctacagagagcctcccttttggttctgaaattgctgatgtgacagagacaaagctgctatgggtctaaaaccttcaataaagtaactaatgacactcaaggtcctgggactctgagacagacggtggtaaaacccacagctgcgattcacatttccaatttattttgagctctttctgaagctgttgcttcctacctgagaattcccatttagagagctgcacagcacagtcacctgctcttccgtattctgtggtaactactaatgttccaggtaaacccctccactaaggactctgccgcagagagagggcccggttgcatgaggcactttgtcaaaatgagcagatacgtatgagcactgaactcttgagtgaatcaaccagaactaagacccagatccacgcactcaggaacttgctctgaatttcagtttgacaacagagaagtagaatatttctaattagctaatatatatacacattttttaatcatccaaaattacaggcaaatcacttaaggtccccagcactttacgatgaaaggtcagagagaaccccacaaaaaaggtgttaaaaggacaggatcactaactgtgagaggttaatttatcaggataactctccggtaggtaactaggcgggcatgctgattttcatactggagtcttcaagagttaacagaatctaccatcctttcctccgggtcaggctagggccgcagggggccactttacagcctcactgcagcatcctcactgggtataagcattggcccagagggacaatcataaatgtcctcaaagtgttgcagagaattaagaatccggctttgggggaagaaattaatatgcattttttttagaactacttcctgtacattggacaagaagggtaaagttgtctaagtgaactggcttatatacatcgctgattaaacataagggctttgggaagtatctcagggtacttgggaaaaactgcagagatgttttgcttttgaaactctctcgctggatggggacaccccacccatgtcaactttccatctgcagaaatgaaacaaatatatgtaaaaagtgcggggggacaggcaggctgttctgaatttctttgatccataggcaatcaagttcaaaggaaatgtttctttacaggaaagaaaaaaacggaaagctctgtgagttttgctagggggtgttaggttctagggcaaccacggactcttcaggaaggaaagccacacagctacactaccagggaaatccgcctcccttggcaaatgcctggggagagctgctcctctgggaagcagcctcggacggatcaggagaccttgttctagcacacctttcaaatgctcaatgtagactgttttaaaaccttgaaaaataagtgggtgtttgtcattgttcttttaaaaatgtgaaaaggaaaaaacatgagattagaatcctaagctcttcacccaatttcacaattcaccctgactagcaatttgctggactgttctaaaatttttttcatttgtttcttttttaactatgtgttttgaaaactactgccttctcagcccgaaaatcgccgtctctctcaggctcactgtggtttcctttttctgacacaaaggcaggcacaggctgcccctccacatgtcttggggatcagatcatgccccgggctcataggaaccgaaactttggggcatctgagactggctgattcagattcaaagacaatcacacggaaagactgtgggcagagaaggcaatgcctctcccctggtccctttgctgtcactattacataatggacttgcacttttcctccctgcacttatcactttctgggcttgaccttaattgtaagtgtggtatgagtctgtttccatttaaagcagacagaaagaaactactctggacctgaaaacaacgtgacttgccaatcattagaattttctagttgaaaggcatagatcagccaatagatccacaccaacaagttgcaaaatgtagtttttgctgctggctctcactttccgcccaatccccctttttgtgttttagtggctgtgttgctgttggaaatggtttgtcacctcctcctgtgcagtggctgctgctccacattgcggatcttaaaaaccttcctaatctaaatggcccttgctttacccggccatggctaccctggggtttggagcgtggctatggagggaagggagcgggaatgctgcaagaacaagccgactggattacaatgtccactactgacaggcgcagtgcgtgtgtgtgacccaccgggttcccggggcactgtcccccccgctcccaccccacccgaggctccctccccaccctgcccccgggagaatcacttaaacacggactgaaaggtggggcactcatggtttttcattttcttcatgaagtttttgaactccttgtttttcttgtcccacttgtggatggccgtcagcaagtactggctcttcaccttgcggcccatgatgaggaagtggtggctgaggttgtccagctggtggcagggacagtcagccccattcttcaggtacagcacaagcttcttcaggtccttcttcttgatgggccccaacttcaggggcttcttcttcttggggacaatcttcttgtcgccattttcttttttcacttcttttattttcatcctcagtgctagagatggagaggacagaagaagagaaaagagggtaagagaaagcatttagaacacagcttttctttttttgatcctcaaagtgattgcattttattattttattttttggcttatactttcttcttgtaaatatatatgtttttaattttagattcaggggcacaggtgcagagttggtttcatgggtatactgcatgatgctgaggtttgggcttctaataaccccatcgcccaagcagcaattacagtgtcggccatcctccctcatgtcttttggaatctccagtgtttactgtggaacaaagcttttcatctagaacaataacccaagtgtacagctgaggtggagaagaaaatgaaaggcaagtaacaagtcaagaaacaggcagttttatccataaaaaccaaggtctgttaatcccagcactttgggaggccaaagtgggtagatcctctgaggtcaggagttcgagaccagcctggccagcatggtgaaaccccatctctactaaaaatacaaaaattagccacacatggtggcaggcgcccataatcccagctactaaggaggctgaggcaggagaattgcttgaacctgggaggcggaggttgcagtgagccaagatcacaccactgcactccagcctgagcgacagagcaagactccatctcaaaaaaaaaaaatcaaggtctcagttacccattctgccaccgcctccgccccctattctgtggtgtccagtggtatctctctgtaatggccatcggtgccaggagatcctcaaataaatttcaaagctaaatcacattgctctttttaaaaatccagttatcatgcactgctttaagagaaaaaagggtcctataacccaatttactccacatgatctgatgctattgatctcatcattcaaagacaaaaaatcctgagtgtttttgttttttattgttgtctttgtggaggcagggtctcactctattgcccaggctggagtgcagtgtctcgatctcggctcactgcagcctcaaactcccgggctcaagcaattctcccacctcagcctcccaagtacctgggattgcaggcatgcaccatcatgcctggctgatttttttttttttttaagagacggatcttactatgttgcccagaactcctggactcaagaaatcctccctcctcagcctcccaaagtgttgggattacaggcatgagtcaccacgcctgaccatgagggtttctttttgtttggttttgttttgaagagcaagttattggtttagtattttaacattgaaagacctacaattccttgaaaattgagtcctataaaatgacaggcagaactatgtgtgtgcactcagcaagggaaagttaaaggttgtttcaaatggtcatgcttcctgcattaaacatcaacgtccaaccacagcatgggagaaatcagtttctactactgggtctctatggcggtaagacagcaggtactgctagtatcagtcaatcgctaatcaaccactaatccccactgacaggcagcactaatgttctgccaactgagaagacctacacaaaatccaaatctactttgactttctggcagattagagcaagttctggtgaagtcctaattgataaatccaggtgatgagctctcttcaaatccaatatggtaccagggctgcttctgttctcaactcccaggagtgtgggaaaatcagcccattcaccaactctgctttctcttttctctgtcccaatggacactgaattaacagtgttaacctgtgagccacatcctgtagcaatgactccacaggggctgctgatgaagataaatgagcgtggacatgctctataaacgaagcagactgaacacacagtgtcgcgggtacaatcaactcccctttaagactggtcagcccgagatattcccaaaggagttggaaatcactttctaggtgccagtcaccagataatttgcgtatcttctgaactctttttaatagaaaattaccaagccccctctttttaatgatgcaaggcttccacccacacaccctgaggaaagtctttaacctgaactaaatcacagtggctaacaattatgaaagcatgtgacctgccagaacatgtgctaagtattttccgtgcatttcctcagttaattctaacaactccaggaggaaggcataattattttcccatctaatagatgagaaaactgaggcatagggggttaagttggcttgcctaaagtcactaatcctaagttgaaacccatgtctaaatgtgcacttttaatctgcatgttgtccatgctgactctatggttccaaaattctttagaatggaccccaaacttggagtactgattaaatggaccaagaagatcacagggaggagctcagaccctcttcccagtttcacctacatttcaaaatgacttcacttatgaaatggcaaaagagtgcctcctggttgaaagagacttctctggcaaaggagaaactgcatttgtgaaagctttattatttaatattttaatttattttatttattagagatgggagaaactaatgcatactccagctgacaaggcgagcgccctcttgtctgcagagaagtgagccattgtaaggtagtacccaccacatgctgggctctgcagatgagaatgggatatgtctatctacgactccttgtttaatactcgcagcaaccatgttaagaaggcatcaatagtactttattataatcaaggagaaggactcaggttaagtaacaacagcatgaggccacagtttgtaagagacagaatcaggatcagaacccacacctaaccccaaaaccactctttcctgccatacacaccacgacccggttagaagtgatattgcttcattggaaactatttcactcttctgattgtgttgctttcaatcacaattcaaatcaaaaattaatgttcctttgccatgaccgtgtaaaggaatgtagtttacgtaggtgggggagcagccagggaggagaaatcagagtatgggaatgtgttacacattagactttacttcttgtcttgccacttggcccctttctttttttgaggtggggagagcaggaaagaaggcacgtatggccagaaattactaacatctttccatctttcaagggtttgttttaggagtgcagactaccaacaatgttgaaaagatcatgagctgtcccgggtggatttttccttgtgggtgtgtgtgcagaccccaccatgatgcatcccggggctgctggggcgagggcaggtgctggcccaagagcagcccggaactgatcaccaccaccccatcccatcatgctcacagggcctgggccccagcgatgttgcccatggcctgaatttgcaatgcaaatggtggtggtgaacaaacagaagcccagaaggtagcagctggggcaacagctggatacagtcccaggtcctgggttcttctctgagtctcagtactctgtctgtaaagtgcagggcaccatccgactgcaggcctggtggatcgaccatctgaggagcccctgctgggtacttctgggagacagcaaagtttatctccagcactatccccaccctgtgctcactccatgcttccctgattgggcaccctgctgtgcctggagcatagggctaaaactaaactaccaccttggaccctggatctcagctccctgtaacagctagaccctaatctaaaaccaaacaaaaaaattttaaaaattatgtgttttttttcttaagcaacaattttaacatcctccaagggtaggacatgactcccacctaggcatagctgccagcaagaattcagagacccagaaactttgaaaactcaaaatttgaggctgcaacaagggcctgcctgggtctttctcgggaaatcttaaaataatccattatatttgagtaggccattaagctttcattctacttgcagtcacccaaaccatttttgctcacaaattatacttccttggtagcctccctcaagaagcctggccttatttgggaagctgaaatgagaatgaggaagtcatcacacaccatcccaaaccctcacattcttcaaagccgtctcttcctcctgactccctgcttctatgagtggtgcctccaaccctcccaagcccgagacatcctacccatgactttgaacgtaaggcaaccattggcccagagccagtcatttcataaccagtcctgtggaatggctgtaggaatccaggaagggtctgtggggaaaggtggcatggggttgcattaggaatcaatcttataactcctctgatggcagatgatagtagcaatgaagggtaaagtacagagggaaagagggacatactagagagcgccttcgtcaggtgaaaggaagaagagttactgtaaatgccacgggaggccccgctgggaaaccaggcagcccagtgtcaatgaagaccacagggtccatttaaatggaggaaacacccctcaaccctaagtgccgaagagcttaagaatgagtctgaaactagagcacttcactgggtgattagggggccacgccaacccataggaggccaggatctggagtggtgagggcaaattccagagagcaaaaatccaatgggaagggaaaagaagagagaagccatatcaccaagcttctggactgagtgcgaaggagcacttgcaggcacgctagccacatggattagactgagcccgtgcaatcattcccactcttcttgaagtcagtttaaaattagagtcaaaaaaacaagttataaacacatgcaagaaagtggtaaaggaaaaaagaacatatcaacattttgtatgacagaaagcaaatggatggtagaatctggcttaaaagggagaagaaaagctaaaatgcagatagggatgccagtaaagtgcagagaaaagaagaaaaagagggacagacagggatgccagtaaaaaacaagcccatttgcactccaggtcccacaaatgctcctgattggggcccccggacactcctgaactccatcacagaggctgtcaatgttgggattggcagcaagtttacatatggacactcaaacctactcccctgggccatgagtccaggtggctgccctcaccaactccagcagtagccatgggcttcattccatacagaaggcctgtagttccagctacttgggaggctggaggtaggagaatcgcttgaacccgggaggtggagattgcagtgagccgagagcgcacactgcactccagcctgggtgacagagcaagactccatctcaaaaaaaaaaaaagaaaaagaaaagaaaagggggaaaaaaagaaggcctgaacctgcacacagcctgccgctggggtatactagacacagaggaggaccggacaggtgctgctgcgtgaacaccaaagggttacatgaaagtctgcaaagtgaagaatgagacactcgggtcttagaacactacatttatatgcctgtgtcagaggattgagtggtttttctctaaagaaactattaggctgttgcaaaagtagtcacggtctttgccattactttcaactgcaaaaaccgtagttacttctgcatcaacctaagaatagttcaaaagaaaagacatatgggccctctgcaaaattctcaagtgaggcctaacaaatcacaggccctgcatgtacacaaagagcttccaacgtcatgtctcgctgttaaattcaaatggacagtcaagggctggcaagtatttaaggaaagcctccaaatgtgaatggcagagactgtaacatacaaaacagaaaaggaagaaaaggaattcagagataacagagacaatgcagggagtattaaaaaaaaaaacttttcactttttgccttgttgcactcctaaaagcaagatgggtcaccagcagctctcctggagccatccaaaaaaattcggccagggttctcattcttgtcattatggcctcaatatgtgctgccagtgtttccatcagtatgcagaggaggtaggcttcattaggttagactaagtgagcttccctgaatggattatccaaggcatccaccaagtgaaagaaaccatgctagctctctgtacataaaataaaattttaaaaaaaaaactttaaaaaatgataatatggccaggagtggtggcccgcacctgtaatctcagcactttgggaggctgaggcaagcagatcacttgaacccaagagttagagaccagcctgggcaatatagtgagaccccatctctaccaaaaaaaaaaaattagccaggcatggtggtgcatgcctgtagtcccagctactcaggaagctgagatgagaagatcagctgagtctggggagattgaggctgcagtgagctatgactgcacccctgcgctccagcctgggtgacagagtgagaccctgcctcaaaaaaaattgttttaaatgataataaattagataagacttttgtattcctaaaacaagaacagaaagctattaaaaggaatgttcagagactgggaaagattacttggaaatttaaaatataagagaagaaatataaaatgcaagacaagtaaaaagatgtgaaagaaaggaaataaatatgcagtacactacatggctcagctgcaaataatatttacataattctaataaattaaacattcaatattaaccaaaagtgtgatgtaattatattggaaagatagtgtaaaagagataaatctttaacttcaataacagaaaatcaataaataatggttttaagataaggttaaagaggccaggcacggtggctcacgcctgtaatcccagcactttgggaggccaaggcaggtggatcacttggggccaagagtccaagacccgaccagcctggccaacgtggcgaaaccccgtctctactgaaaatacaaaaattagcctgtgtggtggcatgtgcctataattcctgctaattgggagggtgaggtaggagaattgcttgaactcaggaggcagaggttgcagtgagctgagattacaccactgcactccagcctaggtgacagagccagactgtctcaaaaaattttttcaagaatattttttaaattttttttaaaagataaggttgaagaaatttcatgaaaagatgaacaaaatgacaaacagatgggaaacagaggaaagaaaaagagaatcaatccaagagtttcaacatctgagaaaagggtattatagcaagagagaacaagaaaacaaacggcagaaaataccaaagaaataatacaagaaaactttccagaaatgaagaacatgagtcctcaggttaaacaacacccagctcaaagaatcatgacatttacaaatatgaaagacaaaaagaacttttaaaatcttcaagagaaaagggtagacatctaatacaaaggatcagtatcccagttgcactggatttatcaatacagacactggaaactggaggataatgaatcaatgcctttaaaattgccaaatttgatactgaggcaagctatcaatcagcatgcaagagtagaatgaaaacatcttcaggcattaacaggttttaaaacatcatctcccatgtatcttttcttaggaaactactcaatgatgtgctctacaaaaatgcagaatttttttaatttataaaatgtattatcagccaggcacagtggctcacacctgtaatcctagcactttgggaggcagaggtaggcagattgcctgggctcaggagttcgagaccagcctaggcaacatggcaaaactctgtctctactaaaaatacaaacacttagccaggcatagtgatgcgcacctgtgggccgatctactcaggagggctgaggcaggagaattgcttgaactcgggaggcagaggctgcagtgagccgagatcatgccactgcactccagcctgggcctctgtctcaaaaaaaaaaggcattattaatgttatttttgattgaaaagtaataattgtataaacttatgggttacaatgtgatgttttgtataagagaaggaatgattaaatcaagctaattagcatgtacatcatctcacttacctatttaaaaaaatgcagaattaaacaagacacgggattcaggaaaccaaaggtctaacctaagaaaggaaaaggaaggcttaggatggtttttcccgaacaactgtgtggcaggctgtgatggttaattttaggtgtcagcttggattgagggatgctgagaaggctggaaacgtgtgtgtgtccaagagggtgtttcagaggagactgacatgtgagtcagtgggctgggagaggaagagtcagacctcaatgtgggctggcaccacccaatcagctgcgagggcagtcagaataaagcaaggagaagaaggcaggtattcagcttgtggagtttctgctctccctcccttcccaataatggctgtttctcttctcctgcccttgcacatcagactccatgtttttcggctctgggactttggggcttgcaccagtggcctcctgggggctttcaggctttcagcctcagactgggggctgcattgttccaaggcttctctggttctccagcttgcagacagcctatcgtgagacttctccaatcctgtgaaccaatgcccctaattaactccctctcccatctcctgttgtttctgtttctctgaagaaccctgtctaacaaaaaagcctaaagctccatcagcccagaccaatggtaggaaagagaactcaggcagatttcctgatgcatatctgccagaaagcttggggctgaattcataatatgaacataagtaactgggttaataaaatggggcagttactatctccaggaaaaacaaaatgatgtaaaagaaaggaaataaatatgcagtacactacatggctcagctgcaaataatatttacataattataataaattaaacactgaatattaaccaaaaatgtgatatacctgtactggaaagacagtgcaagagagataaatctttaacttcaataacagaaaatcaataaagaacatctaaatattaaaaataagaaatccaattataaccatgttatttatttgctccagtttgctgaatatgaagaaatcactaaaatacttgaaaattattacttctaggtcataggaactagaggtgggaagggaactgcatgcagtttttgttaaaaaccattcattccaatttaactttttaaactatatttacgttgaatcaaaaatttaaaatttaaaaaacttagtctaataaagaatgtcagtgtatataaaatataaatgaaccacaaaatgtcagatcatgaaggaaatacagagatttcacatctccagacccttcaccctccattcagctggagcaacttggccatatagttaggacttcttaagggttttgattaagaattctgctttctcaaccagctttttgttgtttcctttttttttcttttttgaggaggaggagggaggcagtccactgatttagtcaatccccatcatttttcagataacaaaatcaattgggttagaatgcaaattatttacttagaactggaagagacgttaaatctggttcaaccgatgctcaaaagtgaagtcacttgtcagctctgcctggaacctgctccctgcttccctacccagagctttatgattcatacagcagttcctccagtaggagagcgagaggggatgaatgggggcctagccatctgggatgacggggcaagcagttggatccattttttccaaaaggtgctgttaaaaaaaaaaaaaaaaaaatcacccagagacagataccagaccacacactctgattcctaagagacttgctttttccctaaattgctttctttttcagaggggcctaaagttcccaaagagataacaagagaagtagagggcaagctagtcacagtgagactggcaaactctttttgttttttttttttagacagagttttgctcttttgcccaggctggagtgcagtggcggaatctcggctcactgcaacctctgcctcctgggttcaagcaattctcctgcctcagcctcccgagtagctgggactacaggcacacaccgccacgcccggctaattttttgtatttttagtagagacggggtttcaccacgttagctaggatggtctagatttcctgacctcgtgatccgagactggcaaactctttaagagacagggtctcactttgtcgcccaggctggagtgcagtggcgccatcacagctcactgcagccttgatcttctgggcgcaagtgatccttcagtgtcagcctcctgaggagctgtgactacaagcattcagcatcacatttggctgattttttaatttttgtgtagaaacagggtcttggcatctttcccaggttggtctcgaactcctgagctcaagtgatcctcccacctcagcctctcaaagtgctctcaaagatgtgagccaccacaccagtctgtaaactctacaaagtggcttagcccagcttggttgatcaggaaaggcccacagacgggcaccccaatgcaccagtcgcatgggcctgctccacccctcctaccccacagagcctccaggtggaaaagtctgctcagataccaaagcctcactaagccatgaagacagagcactggtttcctgcctcccagccccagatcacacatgtcttgggtaaccctgaggtctgaggcagaaagcaccctccccaagtccaattgtgcaaatgagattcagtaacagcactgggtacggcatttggctgcaagcaaccacaacctccttccaacactcagcagagttctgggcaccatggcgagctggctttgcggcactagggcccagataagtcctactgacaatggccttgcaatggcagcttaacagaccccactgttcccagcaggagccaatgtctggcatcattaattcgtttagcagagaaaggggcttgtgctttgtcacaataactcagcgtctctcccctgaccacaagccacatgctgcatacttggatgcatttgctgactacaagacatacgttacacacaagaacaaaaaaaactaaactaaaagaacaagatccaaagcagatttctttttctctcatctccaaaaacaaaacaaagcaaaacaaacaaaacaaaacaaaaaacagcagatgtggaaaatgctcctgagtggctcatttgggacaaattatttaattgaagttgtcctgttttctggaccccagacacctcaggaaggtggccaggcaggagagtagagattgcaactttgcagagccctctccccagtactcacatatgaacgcacacacgcaagctcatgtacacatgcacacacactcgccagcatcatcaatgcatacacaccagcagcatcggtgtcagccatccagaatcctgctgctaactgcttgatttcctggattgtgttaaatccccactgagttaagctaatggtgcaaaatgaaaaccccactctgagagcaaagtgctgcctggtgtgatttcatctgggaagccacgcatcttggggagcaagggcttgggcctcagagtggatcagagaagaactgtggcccctccccttcccagtgtgcagcttagcctcttccacccccagccccccaccctcaccaccatcctgcactggagggagagaaagaagaataggagaatcacttaaataaagtccatcactaggattgattgaatcttggctctgagtccaggcaaacctgccaaggcaaacagcttttcctaccatggggtcactggtttttcattcctctccaatctacttcctggtgtttgcccaaatggcaagttgaaatgtgggatggtctcctgggagggaaaagatggggagtgggctacagaaaaggcaaaaactatccctcgctctgagagatgctagagtgagcatcatcagaatcacctggaggattgttaaaaatgcagactgctgggctccacccctggagcttctgagtcagcagccatgagatggggcccaggaatctgcattggtttttatttttagagaccaggtctcactctgtcacccaggtcagagtacagtggtgcaatcacagctcactgcagccttgaactccagggctcaaaggatcttcctgagtaactgggactataagcatgagccaccacaccacctaattaaaaaaatgttctttagttttgtacagatggtgtctcactatgtttccaaggctggtctcaaacttctggcctcaagagatcctcccaccctggcctctcaaagtgccagaattacaagcatgagccactgtgcctggccagaaatgtgcatttctaacaagtccccaagtgatgttaatgctgctggcctggggatcacacttgagaaccactggtttaaagagcctgagggttgggacagggtgggttgtttgatttgtcaccttggttattcacagtggtatcttttaaggactctttcttggatgacgtctaaacatcctagaggcccagagcagccccccaaacccactggagctcaggtggaagccagcaaaattggcacaggcctgtccaagacacagcggagtagggcaaggtggtcagcactacttacagaattgctgaggtctcttccagagctgtgggtgcttgcaaaatcaagaaaacaaaagcttggatagcaagaggcagcacatttcagaggaacggaccccaagtggagagtcagcagaccccagctgaccaatcccaccactcacattttagtggattagactccaccattaacctttagcataaacttgggtaaaatcattttacttctctggatcccagcgtagccatttgcaaaacgaatgtgttcattcattgagatggatccgttcatttcagtctccctgcctgcaatggtgagctacatctgcatcttcctatttcctttccctgtctttgaaatccagtagagaagcccagaccgcacaatgggaacatcccacctctcagatggcaatgctgcccaagccgctccacccccaggggccttgcttgcatgtgcccgaggccagccctgcagggcagacagtagcacaagagcaccatcttggtcacaaagttgtctaagctcaaagacagccccggaaaaacacctgacacactccacaaataataatcagcagatcttcatgccatcccatgtgacagatggggagcagaggcctagggggctgctggcccctttgctgagagacccctgacaaagttagtccaatgcctctgcaaaatcgcagcagttgcacctcactcttctccctttatcatgttctcggtttgtcctctctgaaggaagggggtgcaggtcacctgtgcttcaggccgagctacagaccatcttctccttgatgcctccccagcccagtctagccttggccttcctggctctccttgcctcaacattgatgcagcagagctctgcatgagaatgacccacgagtgttcctacctctcctcctcccctctgtgagctcatgtaggacatggcccaaaacgcatccaatctctgttcaatgactagtgcaatgcctgacatcagggggctcagctaaacacacgtggggcacacaaatgaacagagagatggaaagagctcagccactgcccggatgttcaaagactcactcgccagactggaactctctgcacagaactccgcttcagcactaacaacaacagcaagagccagtggtcaccgagtgcttgcccaggccggggtctggtctacccacctatcagtagatgcactccgggacacctctaacagcctagaaggcagatactccaataatgacacccagtttctagatgtctgggagcagaacctttctgtcccagaaaggttcaagtcccacaactagtccatggcagagcgggactttgatccaagaagcctggctcacaacatataaacactaccagaagcaaaacgaaccacataagcagaacaggaggcctctgtcttgggggttccctttctactggggatagctgcttttcaggcctgggggcagagaagggtctcactggccccctttccctccaagagctttctaggtataaagggatttagagagggaagcatctctctgatccatcatagacagttccaaagtacaaagctaagaaagcaaaaaaaaaaaaaaacctatgtccaaaatccttcatcctcgccatcacatgattctctccaaagcaaaaatagaggcctcatctctctggacctgatagtgtcaacaagcacagttcaaggttcttgcttattcccatttctgaccctacctatttatccaactttctacacctgaatagtctctttctttttttcagctttctaggctttatgtcaatagcaggaaggcttgaagacagaggggccctggtggcctgctctgactccggcccttggcgggcacgaggtccagtctgagcctgggcccaagccacacaccttccccggcataagatgggcagcgctgggcttccctcccaagtccaggggagtgcagggggagggctgacggagctcatacagttttcctttgtggggtgcagggtcgggggatggtgcggcaaagccctgcccgaggcacacaatcatccagtgagatgacaatgtacaccaaacaggatgcagaggaacgctggcctctcaaagctgaaaagtgtcttgacctgagacaggtctggccaaagccaagaatctaaaaagctaagaggaatcagcacccggtcctatgtcaaagctggccttacctctattttctggaattcgcactccctgccctactccgctggcacgcattcaaggcagccaggtggcaccggcctcaagctgaatgccctgactccggcttccaggtcctcagaccctccctgggtctttcctttctctcaagccatctggagcctacacacaagtcacggggcagaggttctgagagctgaagggagcaagcggcaataaaaacccatacgaccccaactctgcacgccctttctacttcttcaggaagccatttcttgagaagaaacaaacaaaaagcttccctgtggctgcaggagctgctgacccatggggccaaattagcacctgcagagggacaaacagccccagccctagaggagaccacagaaggctgctggatgggcaaagactcagggcacacatagacagagctttgcaggaacgggtgctcggcccacattctggagcgcctgccccaactcccagaagcgttcctagcatgcagaaggcaagtgctttctaagtatctctaccaagtggctccacaacagacagattcttttaatgttccaagtactctccagggaccgtgcttctcttcctactgaagatagtcaacatccaggtttgggggccaaggctgagccctgtgggacaggcccgtgagctcctagcaggcatgaccacctctaatgtatgcagctccctctcctctatttccttttcctgcctctcctgccacctgccaagtgctcctacctcgttcatggccttccactccgtgcagggagggagtgggagtcctctctcctgcacctcctccccaaggcctccagtttgcatcaggggtgctgatcacagccccacctcaccagccttcaccagcaagctttgccctgttacacagctgggcacattcgggggccatgcaggcccttcaaggatttgccagtggagtgggagtgcagtgcccctcactccctcagcatggggggattgatgttgcagccacagacaggggaaaatgaaagacaaatgtcagcttgcactcacccatagctagaggcaaagtcccttcagagcacagaagggttaagcccatggctgccatccaaagagttgagacacattgaggatgcggaggcagctagtctgtcctcaggtgctatccaagcacccttgtggctcctatctcttgtgaatggatgtgtacacaggggcataatataaacaagtcacagggtcaatctgtcattgactgagggttcactgtgaagccatccctcatatactgcacacaccctggctaagcaagatcagtaacctgaggagctgcaatgctgtgtgcaggggaaacccccacaccctacagggtgatgaatttcatatacatggccaactgggaaaggcacagtctcaagatctaggatcccctcccaaccttgctgaccactctctggtgttctcgcctaccctgatcgtgatttgtccagagcacctctggcgaatgcatatgtcgtgcctcatggtcaacaaataaacaagtttcaaagggtcctcatttgtctgaagagcctgaaatgagctgctaggacaattcacgagacagctggagaccttcagagcactcagggccaagggcgcaaaaggtggcccctccattcctctcgtcaccctataggactgggttgctaagggccttttgggtagctgtttggttgcctcccacatctgcctctcactgtccctggtttgcctgcatggcaaagggcctctcacccaaggtgttcagatgtgtgcaccttgtagctctgtgttttgtaatgttagaaattaggttttggccatgcagggtgactcaggcctataatcccaacactctgggaggccaaggttgggggatggcttgagcccaggagtttgagaccagcctgggcaacatagcaagactccagctctacattttttttaactagtcgggcttggtcgtgtgggcctgtagtcccagctactcagaaggctgaggtgggagaattacttgagcccaggaggtcaaagctacagtgagctaagattgtgtcactgcactccagcctgggtgacagagaaagaccctgcctccaaaaacacacaaaaaatgcttgtttggaaatctgaaatagaaaaaaataaataaataaaataaaattttaaataaaataaaattttaaataaaataaaaataagctcaagcatgggaaagcattttgaacatggcaacctgttcctcttacttttaattctgtattatttggacattttttattttatacaatgtgaacacattgcctttttgaaactacatattcaaaaatattatatacacaaatatatgtacagagttatatacatgtttaggttttattcatccattcatttattttattttcctggctttctgtacaattttaaagtactgccctgccttcaagaaaagccagagacaagcaaataaagtttttttgcactgatcgggccaaaataactccagctttagaaattttgattcatttccctatgttctttcaagaagctctctgtggctatctacgatctcattcttcttcattccactccaaaagaatgaagattccaacgtatctcacagataagaacactgctgaatttagattcttgcttttattacatgaccttggacaacatgagtctccatcctgtttcttcctctctttctagatgtagatttcaatatctttattaagtttcaggtcagtcatgtccttgtttctccttccctttgctacaataaaaagtacttttccctgacaagtgtcagaattagaccaccaggtaggcgtcacatctatctcctcctccgagtccctttcagagtgtgtgtgtctcccatacaatgggagtaggatgatctttaggccttgtcctgcgaataggtcacattctctgcattagacagagctggtggccagataggaaacccccgtgagaccatctagacagaaaacgtgcaggcccccgattgctgtttcagccatgctcaagatttacttaaagacaatccaatgaagtgatcagaagatcaggccaaagtcagcggctgaacttgtaaaaatcattcagatcaacgctatttttatagaaactaaaaaaaaaaattaaactcctccaactttctttttttttttttttgagacagtttctctctgtcacccaggctggagtgcagtggcacaatctgcctcccaggttcaagtgattctcctgcctcagcctcccgagagtagctgggattacaggcacccaccaccatgcccatcttatttttgtatttttagtagagacggggtttcgccatgttggtcaggctggtctcgaactcctgacctcaggtgatgcacccaccttggcctcccaaagtgctgggattacaggtgtgagccaccacgcccggccaaactcctccaattttcttgtatctattgatgagttgggctaacacaaagagttgattagagcttgttactttgctcagcctgactgttccatccaacctactgctgtacacaaggtgtcctagctgggccaggggactctctgggggattgcctacagctcccaccagcattacctgtttgccatggcaaactttaagattgtcagcaagtaggatccaaacctaggcctgcacatctagagtggctgacaggagcctcatcactgagtgaagatgggaagctggagaatccaagaataataagaaagagtctggttcattagcccagactcagatggaagaggagaaggagaacggcagctccaggtgcagcacagtggctattatggaaaccggccacactgtgggaagaaagtgccaggtaaacaccctgaagagctctttcactagaggctgggacacaccagggcccggccaacattgctggagggcccctcccacattgctggagggccccctcccacattgtctgagcccctcccacattgctggagggcccctcccacagcaaaccccactcatgcactgggcacagtgctctggtggctctgtgatggctgagagcgtcagcagggaccctcagtctggcaatggagctgccactcaggagatgctgggctgcaaatacccacggacctccagcatggctgacaacagccaggacagcagctcagggcagcagcaaatgaagtgacctgcagggaccacacctgctcactccacagagcccagcctgcagggcccacacctgctcgctctacagagcccagggaaggtggcgtagggggaggggtctcccctgcctcctctgaagagcattcttaggtgaggcagaggcaaagcctctgggagctgctggtaagcgcaggcaagtgcaggctggcaggctaacatggcctgccatcatgggtacccccaggctgcaaggccaaggccgatgctccagtccagggagaaagtacagagtcagtgactcattgagttcactctgcccttcttccctcaggtcagacactcactcttccctacgccccacagatgcaccgcaagagtaagtggaggccaagccagcccgacactcagtcccctccgcttccgacctggtggcctgtgctgcctggttttccacaatggagttccgggtgagatttcctctaaagaaaaattgtgcttcgtggcacatgagtgtttaacaaacacgaacttcacatatagatgcacagaatgttaaagcacaatgggatttaagaggccatctaaccaaagtctcattttaccgatcagaaaactggggcccagagagaaaatgaagcccccagcccctcagccgtcagcatctgagctggcaccagaaccaggactcccgacttcctggagccactgctgtcctccgcccctcgttccccacgcactattcccttcacacactcatttccggaagggtgatgccccagcccctcgggttccagccccatgggctcaatcagcctccctcatttcttccacaaatgcaagcaagccactccctacttccctgccagaataaaatgccaaaaaccagagaactaagccccactccaggcggaagaagtgcagccccagcttactatcagataagtcgtttcctaaaaagaaatgcggctgcagtaaggcaggaaagccgggagccagggaccctgaggccagcccacctggcctcacttttcccaggaccacagtcagatacaacagcagggctgtggcccagccccccaacccttccaactcaggaaatgctgagcccccgtgagtgccagggagtgcccctgccatgcctcctctgaagagcattctggggtgaggcagggacctaggacagacaggcgtgctcagttagctcgagcgggatggaggctccaccggatgggatggccaggctcaggctagggtcgggggtgccaatgatccctcccagccgcctcagaagtggccaccctttggtgttctctgcggagttttggggtatgggtccccaggaactctcaggctgagggctccatgggaggaacaggcaacgtttccactccaacccagggtcctcattctatggaactgggcggggggagggggtgggtgggtaaagcagaagctcatagttgccagccggcccagacccgattcctggcatcaccccacttccaaagagcgtcgggaatggggggacagggatggggacgatgaacccaagagagagaaacactctgtgttcctccctgggcttgcctattcccgacttcgagtaatcatccaaaacaaggaaacctgccaggagatacattaagtctgtaagcgaagaagcctccaggcaaagagctgtcagtcacagggaaaacccaacacaatacatggattctactcctgttccgaggcaggggcggttcccgctcaaccttcccaccgcctcccccgccgcacaaacacagggacacaactgtgaaggcaaaaaaggatttgtttttcaaagtcaccaggaaaatcaacaccaagggaggcagagggagtgtggggccagtggctcctccttggataaaggaagcggggcggggggagggggttcagccctgggcctggacttcattccatgtccatgctccttgctgccaactgcaggtccgttcccaaagagtcacagccactagaatgctccaggccatctggccttcctctccaagacacgcaacatggaacgactccaggattctgtctttacacaccctggcgtcatccctttcttcactgaagagggggtccacacacgaggtcgggggcagctaggaactcatttcaagggtaggattcatacgctgctggtgacctaaagagatgggggccctagctggctcctccaccttcttcagaaagatcatcttacatctccaccagaaggaaggttcacccaccaacacagccaacttctggagagaagccagtggccagaaagcacacagtgagtgccccaagcgtggcatctgaagggctgaaaaagagtcctgtgggtcatgcctctggcttcctgcccagtgcaggcctccaggtatcgcagctaagaggctgccaggtctctgaataacgtctacagtgggaccctaccacggaacaaggcagcctgcccctctgctgaacaaggtttcatttcctcaagcccagtttctccggtgccacacaggagtcttccctttgctggactgcacagccttggccctcacatctgttttcttcctgacacctgcagtcctaaaaggtggacatcctgaaacacacaggcttgtccacttgaaggggttatatagggaagagaatggccaggccccaggaaagtgggaaatgcctgggaatgacaggcgtgccagcttgttttctctcacctcacagctcctcttacacaaaatctctgccatcggccaccatggccgaagcgatgctgagcgctcattctaaatgctggcatcggctcggaggaacgtcatggagagtgggtaagagcaccaggtcatgtgccactgcaggctggtggccccgatgcatccatcccacctgcaccagggcctgctgtgggctctgttccctctttaggggtgagcctggctctacatctcaagcctggatttttcaagcatcctttctgatttgatgctttcgatctcagggtcttcagctaatatttgctctccctgtgagtccacagagaaggtgagggaatagattcgtgtgtattataataacctctgaagttctttttaagcttctctgagaaatacattaccattactatcctggcttcaatttggtatatctataaaatgcattcacctgttacagtttaaggaaagtgcagcatgtgtcacaaatgctttgagggaagggaccacaagggatgctgacagcctccacataaacaggaagcccttccagggatgccacatggagctgtaagagagcaactgggactggccgccacagggtgaatgacaagttagaggagaactgcactttgtatgctggacatggcagctcatgcctataggcaggaggataacttgaggccaggagttcaagaccagcctgggccacatagcgagaccccgtttctataaaaaaaaaaaatttaaatttggccaggcacagtggctcacacctgtaatctcagcactttgggaggccaaggcaggcagatcacctgaggtcaggagttcaagatcagcctggacaacatggtgaaaccctgtctctactaaaaataaaaaaattagccagttgttgtgggacgtgcctgtaatcccagctactcaggaggctgaggcagagaatcacttgaacccaggaggcagaggttgcagtgagccaaaatcgtgccattgcactccagcctggatgacagagactccatctccaaaaaaataaaatgaaataaaaataaaaataaaaattagctaggtgtgatgctatgcacctgcagtccctgtacttgggagactgaggcagaaggatcgcttgagcccaggagttcgaggctgcactgagccatgatagtgccaccgcagtccagcctgggcaaagagaccctgtccaaaaaaaaaaaaaaaaaaaaaaaaaaaaaaaaaaaaaactgcaatgcactttgtagtttccaggactcttccatacactctcatgtctacacaccagctctgtgggggatgcatgatggccatcatttggcaaatgagaaaactgtggttccaagcattgcccttggccaaagccatgcgactagtaaattgtggggcaggaatgaaaactcagttctgagttttagaaagtaactgcttccaaactgcttccccatagcaggctctctcctaccctatgcagcggaaggggctcctatgccatccatctctgggtttctgagaacagaagggaagaagcagcagctcagagacacattcaggagaggggctgcaaatgcggggatcagcccaagaagatggcgctggggccaggatgtccagcagtgcccagccctggtcagagaccactgatccacagtttatgcaatgcactgccctttgcagtggtcctacgccctccaatgcacccccaactcaacccttcaatgaatgcgtccaactcagttttcatctgctccaccctctcaggcacatagcgacttctcttccccatgcacccaaggtgaaggccagtgttcccaggggccttgcctggggagcaggaggtgccaaccaagatatcacacctagagagcaagtcacagagtttttgccacagaccaaaaccacctaactgcagagctggaggacactcacagatcacctatggtgaccccttcaactcgcttaaggaaacaagctcagagatttgaactgactggccaaagtcacaaacagttcagtagcagcgcagaaattagatgccaggactccagaatctgtgttatttttttcttactccatattttatcttctaacgcagaagtctttgtttttgtttcttaacaggtgggtaaactgagccaccgagtgcttcagtgacttgcaggcgctgacacagtaggtggtagaaccaggcgctgggctcacgcctgtacagctcctaaggctacacgtgttctttccaatgcactctttaaatcctagagattacagcaccgcctttatgtcaatccctgctaaccgctggaatcctctaaggaagtgactcctgcccagagaaccagcagttctaaatggacttgctgcaaacactgaaacctaaacaaaagaggtctatttggcactcaaagtaataaacaaaataccaagaccataggagtgttccccaaacttacaaagatggcactcagtttgtataatggcatcaatgcagagaaatccctcctgggcttctcagaagctcttctggaggatagtggattagcagcatgctctagacagtgtctctctcaagtgctgggggaggaagtgaccctcgggcctcaccagtggagaccaagtccctgggaagcccaggccagctggaaaaggcagctgcccagcacagccaggctcaccaggcagatgtgctatgcacacacagacagacgcacaggagggcacacgtacacagctcatcacaccacacactacccacatctgtctacacccacacctcacagactgacccatacacaggcaaacacagacacaaacacacatgtgtgcacagcaggtggtcccttgtgtcccccaactacacataggcatcgacagacacccatatctcgcagatataaccccacgtgcacagaggcataaacacacaaaccacacatgcacctccccttgtcccttattgtcactgcagcctctcctgcctccctctttcagggaagctccagacacctgggctaacccagccctgaaggccctcataaatgccattcccagtgcaatgctttggggctggctccggaggcactgctcctgctgcccctggtcaataacaaagtctggagagaaaagtcaggaccatttatgatgggtcctaatgacaactgctcttggtaatggccagctctgcggtgacctaagtatgagctgattacaggctctggctcccgctctgcacacgcagaacacaggtgtcccgggggcactgaccgcagcagatggccccttccctgacggccaggacagctgtgctgacctcatcagccacctcccgagggctccttcaagtgggtggccctgagcaggcccagacccaacaggcaccaccctgagccctctcatacgggacgcggctccagggctcctctctccctcccaccctcactcagagactccctgtccaaaatgtctcaccactgatgtctgcagttctgccattaggacttcattatttgattaatgaggtctttgtcttcttctcctcctcttcctcgtcttttttttttttttttttttttttttttttttttttttgagatggagtcttgttctgtcacccaggctagaatgcagtggcgcgatctcggctcactgcaagctccacctcccaggttcacacctttctcctgcctcagcctcctgagtagctgggactacaggcgcccgccaccaggccccgctatttttttttgtatttttagtggagacggggtttccccatgttagccaggacggtctcgatctccggacctcatgatctgcccacctcagcctcccaaagtgctgggattacaggcatgagtcaccacgcccggccttttttgaggacttttttaaagatataagacagtcatgt

SEQ ID NO: 1992 - DNA, 2555 bp, Homo sapiens
ctcctaaaaggggagtatctgagttttctgagagtaggtcagtcataatctttgtttttcccaagatttaggacttagagaattcagtagatagacaattgaataaatagtacaatgtgataggatacaattaaagattgatgctgttgtgttcaagaaaaaataggcttttcttagttgatgatggagctgaggaatagtcgtgtctagcttctgacctgggaaatggcaagagggctctgggggcctggaattcctagggacggaatgggagttatcagtggggaccagtgccgagctgacacatgtctgtgtttgccagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtgagtagaggagcagggctaaggaaaggaggaccgtttccttctttatacacacacacacacacacatacacacacatatgcactgatgcctacaaatatttctacccaaatacaacacagacttggatgctcacacacacatttggacaccccacttggacactcacacccgcatgcaccctcagacacactggcaccctttcccttgggctcttacatctgagactgccccagtcacttgtgcatttgacaccactcctccaatatctggaagtttcaacaaacaatttgagtatctcctgtggttttccaatgtaggtggcgtcccccaggtgttcctgacagcatcatctgggacagtgcagatccctgtttcagcagttcagctccaccaggtaggtagggatatctttcaccccatcccagatagccacttctttgtcttgaccttaggggatcctgttaccagttcatcaaagccaaaatccctagcctggaagcccatctgcttttctgctcaggcctgtggttggcaggcagggaagccaggggagcctgaactggctggccagtccctgcccctcctcatacatccccttccctccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaa

SEQ ID NO: 1993 - DNA, 85921 bp, Homo sapiens
agcatctgaaaaaatgggtaggtaattggcaaaaagaaaaataagcaaatgaaggggaaaaatctgaagctattattattattattattattattattattgagatggagtctcactctgtcacccaggctggagtgcaatggtgcaatcttggctcactgcaagctccgcttcccaggttcatgccattctcctgcctcagcctcccaaatagctgggactacaggtgtccgctaccatgcccggctaattttttgtatttttagtagagacggggtttcactgtgttagccaggatggtctcgatctcttgacctcgtgatccatccacctcagcctcccagagtgctcggattaccagtctgagccaccgcacctggcctgcttttattatttttaatctacacataattgtatatatttatgggatacagtatagtatttttatacatatgtacaatgtgtaatgatcaaatcataattagcatctccaccacctcaagcatttatcatttctttgttctgggggcattgaaaatccactcttctagctatttaaaaatatataataaattgtcattaattatagtcacccaatagtgctaaagacactagaactattccttctatctagctgtactctttttttttccccagacagggtcttactctgtccccaaggctggaatgcaatggtgcaatcacaactcactgtacccttgacctcttgggcccaagtgatccttccacctcagcagcccaagtagctgggaccacaggcgtgcaccaccatgcctggctaatttttaaattttttgtagaaattggatctccctatgttgcccagcctggtctcaaactcctgggctcaagtggtcctcccaaactgctaggattacgggtgtgagccactgcactcagccatgtactcttgtatctgttaacctgttagccaacccttggctaccccctcccccttacccttcctcaccgctagtaaacactattctaagcaaatagatcttaaatgttcttaccacaaaaataataataataaaagtatgtgaggtgattaaaatgttaattaacttgatttaatcatttcacaatgtatgcatatatcacattgaacactggaaatatacacaatttttatttgtcaattatactttaataaagatgagggaataattgaatataatgttaaaacaaaaaacaattgcaaaacctaaagaaaattaataatctagagcagaccagccttttatacatgaggtcactgaagtgcagagaggtgaactgacttgtctcatcttacacagcaagtcactggcagagcttgacctgaaacccaaagccaagcgttttctattacctccaggtccttcaggccagccctcccagggctcggccttgggaattggtattggtgacaaagggaataaagaggaacatgcatagagctctccatttagattgacatattcacactgtgccagggcatcagcaagaaacagtgcaggctccaagcgcttgccccaaccccatcctctctcataaccaacttcagctaaaaggtctgagaagataagggaatcttaggtgactctcactagggtgtaaatgactcccaccatgatttttatcttatcaagacataactctaaaaacagtttgatggatacgatgccaggcagtaggatgaagacagatggggaaactgcctaccttaggtcaggagtttgagaacagcctggccaacatggtgaagctccatttctactaaaagtacaaaaattagccgggtgtgatggcgtgtgcctgtaatcccaagctactccagagtctgaggtgggaggatcgcttgaacccgggaggtggaggttgcagtgagtcgagattgaaccactgcaaaccagcctgggcaatagagagagactccatctcaaaaaaaaaaaaaaaaaaaagtcagaccaacccacggggaggcagagggtaggtgaggggggtgtggctgggtttacggtggtgcactcatagagtcggcttgggaacagggagctgtgtgtgtgtggaagttaaaagataggctttggagggacctggctttaaatcccagctttgctgtgtgaccttggacaacctgcttaccctttgtgatctcatatgcaaatgggggtgataatgcatacttcacaaattgtgaggattgaatgagacagcatatagaaagtactaaatttagtgattggcaacacactaaaaaataactctatacacccagcaccctagaccagaaggcattgtgctgactcccagaatgcactagaaagcagtctgcttcttcccttcctgcccttcctctcctctcctctgttctcctttcctctgttctctccttttttctctcctcccctgcccaccctatccctcttcccttccccttcctctctcactctcctctcccctgattccagcccatttagtatctaggtgactctatcccaagcttcttctcctggtgcctttgtccccatctctccaagccaccttgattgtctcctctacctgacagggtcaccctgctggctgcaggctggagggatttatagcaattccctccctccttgcctgcacggggctaccagacagccggaagatatgtgggttggacacagtggggccctgggagaggcaaataaatacatcaagttcccagctgagtctggagataaggacgcaggaagatggggctgcaggattcacagatgctgcactgcacggggtcactcttcatagcctgattcctctggcttccccaggaaagtctatttggggcactttgaagaggacacagaagaggacagcacctgagcaatcttttcctgggaggcgctgcactgaggcacccttcctcagcttggatttggtagggacaggcttgaggagtgagaatgtgacagacccaaccccaagatgaggcaggaaggagggaaattgagccccacagcacaggaggggaaactgaggctgagaagggagaaagacttccaaagtctcacaggaagtcagtgaagagaagttacagtcccctaacccctgatctaccactttagacccccttacactgaattgtgcctggcttcccccagacttggccatttgaactggccttgcctgggtacagaattccaggtatctctgcaacatgccaggatccacctcagggagggttctcctccctccagatctctgccccagccagctgcctgatgagatgccctctctatggggcctgatttggggtcagcatcctattatagataactcaagggtacaacatcagtctctcccacacatggatgggattctgttctagtgcccgtgggcaatggagtgggggtacgggggactaacgcaggagacctgaagtgggggcgcctgtcccatccaccccagagacagctgcccttgccactgtcgaggccacacctgcccaagagcctcaagggcctcctaatcagcaagctcacccacagccaccaggcttggcacgtccttgacccagactgcccagataggctggggacatttcccattcccaactgctctgtgacctctctttggcctctgtctccctcccagtaaagtgaaagggatagaggacctccaggccccaaactctgatgctgggtgactctctgatccttgaaggctgtcattgcatctccctaaggtgggtgcagacttcacagagtctttccaggctactagagctgattgcctacaggcaaggagaggggaaagtgcttgggagtcccatcccccaggggcagcccttggccaatgtctgactgctgtgcatctgtggaagtgagcttccctgcctctcattgggacaaacaggattcattttcattctggagcttcctgggatcagtccaacattgagactgtgcctgaaatcacacctttgcttagcttcttcctcttcctttcctacttccccttctctcttctggttgtttttcgcttgggcagttttttaaacagccacctgcacacaaaacattgtctcagctctgcttctgggaagccactttcaagagtaaatgaaaacagtctattgaaagcaagagactgaaggtctgagggaaaagtcagttttatttcagcccaccaagtgccctccctgtgctgttctgggctttgatggggacagtggaggggaaggccctgcgcagccccccaaccccaggagctttgagtctgggggatggaggaggaggaggagactctgggccagccctcctgcggtctgcaggaggccacaggaggtggtggggggttctctgaatgtgtgtttattgtggcctttctgtgtcctgtgatggccccacggaatggaggactgagagttgcagagcaggaaggggtggcagccttgttctttcctggtcaatgtgccaggctcccaaaatattcagtgatcagattttaacctcaaatagcagtgccccaaccgcccctgaatcttgctatggaaagagcctttggtaagtgttttgaagcaggaagactccctctgcccacagagcagtgcacagcagtttgggggaggggctagctcctgggacccaagcgggcctcaagagatgaggcgggaggcgggttgcagtgtgatgggaggggagacacagaaattgccaagggccatgaggaagagaggaagccacaaccccaggctcccaaggagggtgtcttcctgcaggaagccctgtcagatggcagcctgcggcccaaaagccccaactcaacctgcaaactggcttcttctaaggccacagcacccaagggcctcaagacacacatctagcccattcccctaccattgcatgggtggaaacctagaaggagagagggcaaggagttgcttaagaccacttagagagtttgtgaagctggagtgagctttcaggttgtggagctccaagcccagtgtggtctgccccactttgcactgccccacatttttcctaagaccaaggtagaattattcctcctgttttccacctcaacagtaaaagtgcctctcttctctgccatgggactgggagacatgttcaggatgtgaagtcatatagggacatctttgagttcataaacatctcctgttcataaatatccgactaaagactgaagcttccactgctcccaaaatagctttggatcccagcacaggcatttccaagaacagatttttatcctttcaagaattccgtgaaagagctgggtgcgatgtgtgcctctaggcacagctacttgggaggatgaggcaggaggatcacttgagcccaggatttgaggccagctggacaatacagtttgatcctcagcccaaataaataaataagtataaaaataaatcaatcgatccaagaattctgtgaaagcaaagaatcctctggtttgtatgcctaccagagtttcctgaagttggtcacacacactgccctgaccctgactgtgatctcagactgtggatatagattggtctaaactccagataaggaagtatctagtatggtccattataatcctggtcattctcatttcaattcattttgatacaatattaggctactctgaacatgcaattccccaatccttctatttaaaagggatttcttgcttgtagtgagccttgggattgactcctctatagccatatcagggccagataattattctgaaccaatcagtttcatccccttcaccagtgactggttcagagataaacagtcctatgacaataggtgtcaagacccaggggagaggctgtggcttcggaaaagagaagcctgtctttctaacccactagtctgttaacattacgtttgtggctgggcacagtggcttacacctgtaattttcagcactttgggaggctgaggcggaaggatcacttgaggtcaagagtttgagaccagcctagccaacatggtgaaaccctgtctctactaaaaatacaaaaactagcggggtgtggtggcacgcacctgtaatccaagcaactcgggaggccgaggcaggagaatcacttgaacccaggaagtggaggttgcagtgagccaaaattgtgccaccgcacttcagcctgagtaacaagagtgagactccatctaaaaagaaaaaaaaacaaaaaacacaataggtatgtttccttggtggctccggaagccctccagtgacaccaaggcaccaagggacccagtccttgggctggaagccctattaagggtggcagaggggagagatgaaagaacttgcaactgctgatgtcactgagccgctgaatcaacagccgggaagccagccttgcttcctgctttgtgagacgatacacttaatactttccatccttgggggtgggaatcttgttatttgccgatggaaatattacacatcatccccagcccccactcccctgcctcacccggccctaccctttaccatggcaagtcctgccacggaggagctggctgcctcagaaaatctcttggggaaaccagtcctgcctgaattggggtgggattgccaagcattttgcatcccgccccccttacttgttttttggtgtttttttgttttgttttttgttttcgtttttgtttttgttttgagacagagtctcactctgttgcccaggctggagtgcagtggtgtgatcatggcttatggctgcctcgacctcctgggctcaagcgatcctctggtctcagtctccctccagagtagctgggaccacagttgtgtgccaccacgcccaactaatttaaaaaaaatgtagagatgaggtctgactatgttgcccaagctggtcttaaactcctgggctcaaatattccttctatcttggcatcccaaagtgctgggattacaggcatgagccatcttgctcagccatgttcccctttgaatgcaggagtatcgcctcttccaggcaggagttcctcttattcagtgagacaagcacagacccagataattacatgagctgccactggaagagctgctgttaattttgatggcaataaaaggccttgccagtacgttaagctaatttcatgaaaatgctgggaggagggtcatgggctggatcccagattattaataatgtcgagcttcatttgaaccattcagaaaattcctctcagttgcctccagcaaactgcaacaggttgctactttcctctgaaatcaacagtcttctcataggcaaatgtggatttttttgtttttccctagaaaataattaaagtcacaaagtccaataaatacttaaacagaatgtagttttaattaaaaaccttccaccaagtctgcagttgcgggtctctctttgcaaacaggcatgctgacaagcatcagtctaagtatctgaaactagaaacctttacaaataataatagtaaatctggtttctacatatacccatggtgtgtgtgtgtgcaaagggggtggtggtggtgaagaggtctgggggcagagccaaggtgctcccctgtggaggaggcaggacacaagcctgtaggggtgtgtgcagcagaaccttttatcaaacttgtgtcccactctgcaaggcaataataatggctaattcagctattatataaaaaacgtatctcaagtactgagcactaagtgtcaggtactaagtgctttgcgtacattgattcatttaatcctcaaggtgaccgaaaagcataggtatttttttttttttttttttttttttgagacagagtctcgctctgtcgcccaggccggaatgcagtggcactatctcggctcactgcaacctctgcctcccgagattctcctgcctcagcctcctgagtagctgggattacaggcatgcaccaccacgcccggctaatttttgtatttttagcagagacgaggtttcaccatgttggtcaggctggtctcgaactcctgaccttgtgatccgcccgcctgggcctcccaaagtgctgggattattacaggtgtgagccaccgcgcctggtcagtactcttatttatgcctttttttcttgaggcacagagaggttaaatagcttggctaaggacacacagtcagtacataatggagtctgacgctaggacctgcccgcctgacgactacatagaacctgtacaaggaaaggccggaggagggagtataaacagggcctggcttccctgaggagtgatctttcgactggaaattagaaaaggaaagcagcttcttgagggtgtggggctggagagaacatttgtgtgtgtgtgtgtgtgtgtgtgtgtgtgtgtgtgtgtgtgtgtgtgtgtgtgtgtctgtgcgcgcagaagctgaaagatgggaagtagtgagtgttcaggggcttctgactggagggcagccttggggaaggtctccgcagccttaaccggctgctatgctggggatgtttgatgcccatctgggccccggctttcttattctcagaggcccttcccacatctttaggcaagtccattaaatcctccgcgtgccacattaaaatacaagggcaagtacaactctgagtgcagttgcaacagaatcgtttgcacaatgtcgcatgtcttaaacattcaatcaaacatcgattacttccaattttgcagttttctttgcccctgttagcgccaacagatttttttttccagatctcagacatttattttaataggcccctgacaaagtcataagactcagagagaagggagagtgggagaggtgtataggaaggttttgtgccagggactagtcgctcaagaattaggagacgccctgggcactggaaactacgcagcgcgaagtagggacagcgcctgtgttgtgtagtggaccagaggttgctgatacctgggacatagactgggtgggcacgggaagtaaagcctcgggactttggttaagcgcgccccactggcgtatcgcgccgcgggactgcagagccgtgagcagcggtcgccttggtgcagggttccagccacatcttcctcgcccagccagcaccctctgccgttgacccgcctctgcgcccggcaagcggcttccagcagggggcgcgcgcggaccaggcttgggccctagaacagcgcggatggagtcgctggagcaagtccccagatccaaccggtttcaaccctccccaccctcccgacgctccgggttcgcgacgttgaagttaagggtcgatccgcagaaagcggccaggggctccagctctccattcctgggtctgtctggggtcggctccagcctggttagaagccttagtctggattcggcagattctgaatctgggaccctctgcgctagcggcttggaaccttgtcaccctcccctcccccacccctacttccacacacctgattagttgtctgtttctttaatgatcaaagacgtgggcggcggcgggatgaggtcttggttcccggctccacagccctccctaactgtcattattaacgttataaacattagacccgcttctgcgcgccggacggcgccggacgaggtgcgcgcagtcttctagctgagctcggaggcagatccagaagtcgcggctcccaccccaggcctcggcggactctgcctggggcgactcgggctccagccctgcccgggcgggcactgggctctccagggtcgaaggcaggggtaaggggcgtctttcccccagggcagcctccgggaacaaaagcatttgctgtagagtgagctagagcctccgggcccgcgggagtcagctcccgcccaggggtggtcaccgcgtccttaaccaccccaggagccccgtctccctgccgaactccttggcttctgcaaccctgtcaagacagcaaggaaagggggtcttccctggtcctcgggccccgaagtttcggggttgcttataggacgggttcctgcagtccagggaagctctgggcagatagcgagcccattctcccttccattacccagattctgcctccctgcggaaggcaaaaaagaaagaaagaaaataggtaaaaaccggcggagggccttgagcctccccgcctggcgcccctcactcagtcccgaaaagtcccctggacacgccatgccggaccggactcagctcccgctgctgggcccctgcctccaaatatccttcccaggcacaggctcccaagaccgccccctcagggttcccaacacccggacaactgcccaagacgccgctccccgcccccacccccaccttgttcggcagacaaagaagggtgtgctggccccgccgtctgcctccttctcccgaccccacaaggcctagaaacctcagggactcaccccgggctagggacccaatcctggctgtcccaccacaggatccccggcagggacgggtcacagtgctctcacccctcgaccattttcgaagacaccttccctgaaaggcgccttgcgccctccccatgggtcggcggggggggactccaggcccgagcaggcggtgtgaagttctgtgttctgaactggggctgagcaagatgcgatggtctcagcccgctgggccgcccgtagcgacggcaggagtaggggagagggagggacgcttggagtgtgagcgcaccagtctgttcatatttaatttacaaagcagcctcggaaccccgggccgggtggtctctttagacgctgcgctcttagcctgtctctcttccccaccccctcccctagctcattaagatgctcaacactcaaatcggggtattgatctccacggaagccccaaaccctcgccatcgagagacccccatggcccggggtgatggctgtggggcttggtgctcccagagagctcagtggctacagaatgggtggggattctgcgtgtctcccggagcctgaacccctttcctggttatggccggtagctgtctccagggctaacgtgggcagcgcaggggggcggaaaccgggttttagccaaatgcctcgacatcgccgcgcctccgcctcctcgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgaggtgcttgggtgcgctcgagagagcttccccctgctccacctgtcccgcggtgcgcgcaggccaacgcgtcgggcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaactgggctcggtgactttttgtcaggggacagagggaggaggcctgggcgatgaaggaggaaaccgcggaaggaaggagcccccccagagcctcccgttggaatcttttgagtgatttcctgtttgcgtgaccatcctgtgatttttttgccaggtgtttgcacccagccctgctcttagtgtctccaactccagggtggggtgacaaaaaacgagggcaggctgcaagtgagtagggggaggttgcaggaaaggaaggcgggtgtctgcagaccctgaacacagggagtctgagtgtgcgtgcaagtatatttgcactcaagggtgtgcggcaccctctttcacttgagactgtctgtgtagtggggtgtggctgtatatggtgtcacactgcccagtttctgtgtctccacatcagcctttgagttccctgagaagccggtgggaagaggatgggattcatagggacaagaccgctgtggcttgcacaagagaagtcacaaataacacaaagtacagagcgggcaaatgatgtaaagcaggaaagggggagaacctggccaggccgattgcccagagcgagccggcacgtttggcctgggagccaagtgtgtgcgttgtgtgggtgggtggggagcactcagtgaatgatgcatgcacaaccgtcagggtgtgccaagggggtgcacctggggaatcagggttgaaaacacactgatttcatagtcctagaaaggggctttcttgggtgaggaacaggagagacagggggatcaagaaaggagactgtgctcctggccagcctaaaacacacgggttgggctgctgtgtgtctcagctgaatccccctaagatgggaagaggcggggaagagagatggaagaggaaagcaacagaaatgggaagcagataaagattctctctctcccctcccttcttcctgcttccaatttcttgtcctcttttgctgtctctgtgggtcttcctaattggaccagtccaggctggcaacaggcccaagttccaatgctcagggtcctaccccagcctcaggtctgtcctctggcataggtggtggctgtgacacttcttggggcctgagcccagattcccttcccagaccagcaaagctgttttctttcttttttttttatttttttatttttaaaatagatcagttttattctgctagttccataaaaacaatgtaaacacaagcgttctgtacatcttcttggtgaattcacataatgctttgttccctgatcctttaacctcctcgtcttcttccagtcattttctgtttggaccactggccacaggagtggagtggggttggggcttaggagagagcaatgtggctttttcgtatgacttgttttattgcttgccctctcagcacactcctgttactcctaacacaaagtctgagatttaagcccttaaacctgtaggtttcaccatcagctttttctttttcttttctctttttttttttttttttttttgcataggcattactagggatgtgaatgggagactggtatagaaagtggtgaggagccgaagccaagaaattgctttaaacacaagatgaaaacgctctgttctgtacacaaagaatcacctaatactggtgtgaggcatctcacttagctgtggagaagtccttggaattagatctcagaaagacagttccagctttaagacagtaaaacctttaggcaatgggctaattgccttaaaggaaagaagagttctacttgaaagagcttgcaggtgagaaattgtcctacaaagattcttagaaatgttagcggagataactgacatgggtagctgtgggccaaccaagaactgtcaacagcccgatctcatagcaaagctgttttcaagaaaaattcccttctgagggccacagcctgagccctgctcctggtcacagcccaacactgcagtccaccccactgcctgggacacaactcaagaatattatctcttaggaagacacctgttttgttctacctgcaaatcctaccgctgagcacggggcaaggactggcccaattcctagggcctgtttaggaatccagccacgtgattgcttctgggaacaggcctggctgggccagtgagtgctcagcagttttggtgcaactcaatcatctggtcatgggtctcttgtgggaagacaggccccttcctttccctccctgtcctaagaattgggggccctcctcgagaccctctaggatcctgagtgccactagggcaggtggagaggaggtgaaagctctgcccctctttgtccagggccacgtatcctaatggatgagcaaatactactcagctagaccttgtgccttctgggcttggccaggcccaaaggctccaaccacaggtaggaatgaatacgtgttggaggccaaggaccagggtgctgggacactctgccaactgcccactgaaatcccagccctctcaggaaaactctagtttctgtccaaatgtttggccaatgcacagaatggtccccagcctctggccttccttcctacctctttttaaatgtaattaatttaacttatttaattacattaaaataaaatgtcttcctttcatttcctctccctcattcctctctgttcttttttgaattgttccagttcaactaccaatttgaggttgaattcattttcacagtgtccccatcaggtggttgtaaaactctggcttatacttatccagagatggggagctcacattccactccccgcttccagggaatcagttgtttagcagtttaaaatgtgtctctgcctgggttccacccctcaggcctgactgccactggcaagttctctgggagaacctaccaggtgtggaggtgtaatcttcacctctgaccctctctccctggctccaaggctttccattcaatgcaacttttttgagcctttcctgtatgcttcatgtgctgtgctagcttcaatctctccagtgtgtcttgctgtaaaacttatttggatactacatgggaatggagtctaacggcttgaggagtgtgtgtgtgtgtgtgtgtgtgtgtgtgtgtgtgtgtgtgtgtgtgtgtcttgagagacctggaaaatggtcggagaatgcaatatgacagcagtagcctcagaactcagagcaatttatcaggagcagtaattctctgagttacagaaaccagatggccaggatgtggccttgaatcagatcagaaacctgtctaaagaaaggttatttgaaaggagtgcctcctccccctaaatgtttcctaaagatcagctgaaatgagaaccatcttgaagatcattaaagtccattaatataaaagaacaaaggaaggcagggcttctttgagaaagaagcagctggggtagggtcctctggtcccagatcttgtgtctggaatgcagccctccacccatgacatcaaaataacaaccacaactaaagctaacatctccaaagattcgttgtcagtacatatatggcctgtgacttcctggtagacatctcagtttttcctccttgatctcagggaaatgcattttggtaggtagagggaaaggagtggcatcttgctatgactaccctgccccacatttgttaacagagccccagttatgagacattccatagggaaaaagggacctgctctctgcacaacaggaggtgtcgcctgcaaagaaaggaccatgactatgtaagcacagagcaagggaaactgggggatctcctttctctgcagaaatccaagcctgtattctgcagaaagccaagccctagtaccaggacataagaaaggccccttgttgaggctataaattgccaagtctgacctaacaaatacctttaccttatacatttccaacataaaggtatagataagagaaatcctgctgggcagttcggaggaagcaagtggagccatttcagttgtaatgtgtcaattcattgattacatttgaaatgtagccacccacacctatctgttcaatgataagattttgccttaggactcaatagagaataacattatattgaaaatgaaagatctgctgtgactggcatatagaagagattaaattttaaaatgttttgcaatattcgcattttgttcaaaatatgaccagtgttcctaatgagacttgatatggattttttaaaaagccatccaaaggccccatgatgggcacaaaaacaaaaccaacttgttgggttaaattagttggaaagactttgtatcattccattgttgaataagtaatttatgggatttaaagacaggacgattttgaaaattgtgctaattgtgtgtgctttgtttgaacatgtgaatgtaagtttaataattaagtttaagtccacatagaacaaggagagaaaaagtgtttgtatttttatcaactgtttactgcttacatgtattcccttgtgtattaggagttaatttggttttggcaaattaaatgcattttctcccagcaacattctcaaactgtttcttaaattgaatctaaaagccattcaaggcatccagccatttgagagaaaaatttctatgattatataaattaccgaggaacttcgtaagaattgatcattgtcgaaatggggagagaataggaatggagaattaattatcaaatgcgtcttaataatagaggcttgtcacacatctagactaagaatgctaatagtcaccacctaatattagtataaatactaataataccaatagtggctaacatttattgaactcttactatatttcaggcacatactatggatcttacaagcattattttgtcattccttatagtgatcctgtgaggtaatattattattctaatttacaggcaaagaaaccaaagagcacagagggttagtagtttgttgaagatcacacagctggcaatttgcagggttgaagtttgtccttttgttatctgactccaatgccagagatcttagtcaccaagccaaacctcctcctgaagcctctacaaaccagtgaagtatagaataacatattttctatatggttaaatttgcggctaattacagagtttgtctagaaaaaggatttctcttgctgtttctcttatttctcaaaatagcatttttttttttcctgattataaaagtagtgcaggccaggcgcagtggctcatgcctataatcccagcactttggcaggccaaggtgggcaggtcacttgtgatcaggagtttgagaccagcttggccaacatggtggtctcaaactactatttcatgtctctactaaaaatacgaagaaattaggcaggtgttgtggtgtgcgcctgtaatcccagctactctggaggttgaggcaggagaattgcttgaacccgggagttggaggttgcagtaagcggagatcaggtcactgcattccaacctgggcaacagaacaagactctgtctcaaaaaacaaaaaaaagaaaaaagaaaaagaaaaaaagaaaagaaagaaagaaagaaaagaaacaaatataaaaataaaagtaatgcatgcttcaactagaattgtctttggttgccattgggaatgtaaatgggcatagccactttggagaaatatttggcaatctagaaacattaaagatacacatacgtctgactcagtaatctcactcttgggtatatactcaatagaaatgaatgtttacatccatcaaaagacagaagagtcctttggtggatgcaagtgcaacgatgttcatagcagttttatttgtaatagccccaaattggaaacaacctaaatatccaacagtagaatggaggaagtaacctgtagtatattcataccctggaataccacagagcaatgaagaacaaactgcagctacacacaacatggatgtcatcacagtgagtgaaagaagaaagacacaaaagattatggaatgagtgatttaatttaaaggaagttcacatacaggcaagactaatttttggtggaaaaagttggaaggtactaaccgggattaggagaaggctcaagggagacttctgagattctagaaatgttctataccttgatctggatggtggctacatgggtgtatgcatatgtagaaatccatgggctacacacttgagttgtatactttattgaatttgttatacctcaatttgtgtgtgtgtgtgtgtgagtatgtgtgtgatggagtttcactcttgtcgcccaggctggagtgcaatggcgtgacttcggctcactgcaacctccagctccctggttcaagtgattctcctgcctcagcctcctgagtagctgggattacaggcacctgccaccacacccagctaatttttgtatgtttagtagagatgggctttcgccatgttagccaggctggtctcaaactcctgacctcaggtgatctgcctgcctcggcctaccaaagtgctgagattacaggcatgagccacggtgcccagcccttattatacctcaatttttaaaaatggaaaaataacccttggaaatcaggcaccaaagtaatacgtgctccttattgaatagcactgtccgatactagccactagccacatgtggttatttacattttaattttaattaaggtgaaataaattttaaaacttgttcctcaatcccactagccacattttaagtactaggcacattgctaacagcaattgtttatttggacagcagagctatagaaaatttccatcctaatggaaagttctattgctagtgttgttataggaaattgaaaaatatagaagtgtattaaaaaaacaatttattatttataattccctcatccaaaaaataatgtattaacattttatgttaacttctaatttctttctaaaataaattttattaaattacaagagtaacatatgaatgcattcttgtcctaagataattaaatattgataaactgaaactctctttgaccattgcctgcaatcctagagctctccccagtggtaaccactcttactagcgtactatgtacctttttattttttttgagatggaatttcgctctctcgcccaggctggagtgcaatggcgctatcttggcccactgcaatctctgcctcctgggttcaagcaatcctcctgcctcagcctcctgagtagctgggattacaggcatgtgccaccaagcccagctaatttttttgtatttttagtagagacggattttctccatgttgatcagctggtctcgaactcccaacctcagatgatgcgctcgcctcggcctcccaaagtgctggggttacagatgtgagccaccacgccctgcctggtaccatgtatcttttcagaccattttcgcaggtacttataaacatgatgtctgtgtatggaaatacacagcagagccattaacatcaccctgactcaaggagcttccacctggttcagttcagtctcccgaagtgcacaggaagggtgttatccccatcatccacatcccacccagtgtctagggctctcttcctattcatctcgagctgctgtggtcctgggatattgtgagaggggacgtcacatggggcaagtcagatggtcactaggtacagtcacactgcagaactggcaatgccactcctgttgggtgttcctagggcaaggtgtaactgtaaatccaggggagccatcactccacactgtctgtatgaagagctagcctgtggtgcagctctctagcctgaaggtggtgcttcctaaggtagagtctaggaggtctgcaggcatgactcagctccctctgggtcctctcgcagaggtcctttgctgctttcatgaatgccacactggagcatggaacccttttgtgaagctgccccagatccccttggtaccaacatcatcattttctctctggtataaggcacaggctccgtctgactcagaccaatgcacctctcagtgtttaccttttgagttcaattctgaattcacgaatttttaaactttcttcattttaatgtatgcatttacagctattaatgtcctcctaagtactgttttaacagtattccccaagttttaataggtagtgtttacattgccatttagttttaaatattttatttctgtgagatttgttccttgactcatgaattatttagacatgggctgttacattttcaaatgtatgtgtttttttttctgacacttttgtttttgataccacttgcattacctcgttgtcagaatacagactgggtgatgctgattatttggtaattattaaaacttgcttggaggaataggatgtagtcaattttttgcaaatgtttatataagtttgaaaagaatatttattcttgaattattgggttatgatttttatattttaattagatcaggcttgttaatattattgattacatattctctatttcctcacttaattttttgtttgcttgttttattaatttctgagagaggcatgttaaaaatctcttatgattttagacttgtcaattatttcttgtaattctgctcatattgcattgtatatttttgaggccatgtcataaggtgtatacctttttggttaaatttttgttgaagtctaacacacgttcaggaaagtactttcataaagagaaaatacctcttatgaccagtacccatatcaagaaaagaaaattaccagcactcctgcagcatcttcatgctccctcggagtcactcctccatccccactctcctgacttctaatatcatagattagttttgcctgtattgaaacctcatatattccaggagtcttcaaaatgtacacgaaaaatgcatattatgaaaaaactaaccatgatttcaaaatgttttcactaacttgtactaacttgttataacatgtctgaacaggatctagtttgaggctctaagaaggataagatatgagtttgaaaagaacctccattacagcaacatgagttctgctaaaatcaaagcaagaatgaaaatcaaatttatggtgaagcttgggtggaagaattatgaaatcattgataccttaggaaaagcttatggagacaatgccccaaagaaatcagcagtttacaaatggataacttttcttaagaaggaataagaatatattgaggatgaagcccacagcagcagaccatccatgtcaatttttgaagaaaaaaatcttttttttttttttttttttttttttgagacatggtctcactcctgttgtccaggctggagtgcaatgatgtgatctcagctcactgctcccttgacttcccaagctcaggtgatcctcccatctcagcctccaagcaagtagctgggactgcaggtgcgtgccaccacgcctggcgaattttttgtatttttagtagaggtaggatttcaccatgttgcccaggctggtctcaacttcctgggctcaagcgatccatctgcatcagcctcccaatatgctaggattacaggcatgagtcactgtgctggccaaaaattaatcttgtttgttccctaattgaagaggactgacaatagcacaaaaaatatccaatgccgtagacatgtcagttggttcagcttatacacttcttactgaaaaattaaagttgagcaaactttccactcactgggtgctgaaaccattgctcctagatcagctacagacaaaagcagagctttcaatggaaattttaaacaagtgggattaagatccctgttgcattcttcaaagaattgcaacaggagatgaaacatggctttaccagtaccatcctgaagacaaagcacaatcaaagcaatggctaccaagatgtggaagtggtccagacaatgacaacagatgtttgggatgctcaaggcattttgcttgttgactttctggagggccaaagaataataacatctgcttattatgagagtgttttgagaaagttggtcaaagctttggcagaaaaatgcccaggaaagcctcaccagagagtccttctccaccacaatgctcctgctcattcccctcatcaaagtgggcaatttgcaagagtttcaatgggaaatcattagccatccaccttacagttctgatttggctccttttgacttctttttgtttcctaaccttaagaaaaatattttaaaacacccatttttctttagttaacaatatttaaaagatggcatcgacatggttaaattcccaggaccctctgttctttagaggtggactaaatagctggtatcatcagttacaaaagtgtctagaacttcgtggtgcttatgttgagacatagagtttatatttcttatttttatcttttaattccatttttccacaaatggtttgaagtcttgtcatatgctcagctttggtagatactgccaaacagtttttcaacatgtaccaatttacacttgcaccagccgtgagagtcctcatcaaactcagtattatctgtttttggttttagacattctgttgggtgtgtagtggtattgcattgtgtttttaattggcattaccctgacaattaattaagttgaatactgttgtttcctgtccatttgaaaatcctcttatgtaaactgtctttctctctttttcattgggttgtctttttcttattgatttgtagaaattcttcatatattctgggtatgagctttctgtacagaatgtcttccctctctcttcagcttctcttttcacactttttgtagtgtctttttatgaagagctgtttttagttataatgtgctccaatttatcaattttttctttatggttagaactctttaggaccatatttaagaaatctttgcccaccctaagatgatgaaaatattctcctatgatttcttgtgaaaaacattatgattttaccttttttatttccatctacaatgcatgtggaagttacttttgtataaggagtgaggtggggccaagattcatttttttcccatgtgaatatccagttgacctaacaccttttattgaaaagattatcttttcccccactgtaagtaaggccttagcacctttgtcatcagtgaggtgaccatatatgtatgcattgtttttccccttgcagtccggactcggcttctgtcatcacatctctttgtctgactctctttgctgtgtctctcttccacttttaaggatcctagtgatcacattgagtccacccagataagccaggataatttccccattttaaagccagctgaatcacaactttaattctgtctgaagcctgaattctcttttgccatgtaacctaacatattctcaggtttgggggatttttttaccattgatttttgagagttctttatgtattctagatactagagagttctttatatattcttcttttctttttttttcactcttgttgcccaggctggagtgcaatggcatgatctcagctcactgcaacctccacctcccaggttcaaggaattctgcctcagcctcccgagtagctgggattacaggtgcacgccaccacgcctgcctaattttgtatttttagtagagttggggtttcaccatattggtcgggctgatctcaaacttctgacctcaggtgatctgcccgcttcagcccctacagagtgctggattacaggcatgagtcactgtgcctggccaagagttctttatacattctagatactagtcctttgctggatatgtgatttgcaaatgttttcttctattctgtagcctgtattttcatcctcatcagggtctttcacagaggaagacttttaaaaactttttgatgaggtcaaatttatcaagttttccttttatggatcatacatttgatgtcgtctaagaactctttgcctagtcctagatcctgaagattttcccctatgtttttgtctgaaaacatagttatatgttttatagttgcacatatatagttttatagttgcaagttatactttttcagttaatttttgtataaggtgtgaggtttagatgaacccattgtctgtagatgtccaatgtttccagcaccatttgttaagactatccttcctttgttgaattgctattgcacctttgttaaaaaatcagttgggcatgcttgggtgggtctatttctgggttttctattcaattccattgatttttgtatctgtgcctccaccaataacacactgtgttgattattgtaaccacatagtaggacttaatatcaggtagagtcgttccgcctacttttttttttttttttttgtaagattgttttagttattctaggggctatgtctttccatataaattttagaataagcaaatctatgtttacaaaagaaagacaaagacattgcattaaacccataaacatttttacaatgttgaaccttttaatctgtgagcacatgatattgtctctctacttctttaggttgtctttgacttttttaatcagcattttgtaatttttagcttgcagatcctgtatgaattttattatgtttggccgggcgcggtgactcacacctgtaatcccagcactttgggaggccgaggcgggcggatcacgaggtcaggagatcgagaccatcctggctaacatggtgaaaccccatctctactaaaaatacaaaaaaaaaaaaaatagccgggcgtggtggcgggtgcctttagtcgtagctactcaggaggctgaggcaggagaatggcatgaacccgggaggcagagctcgcagtgagccgagattgcaacactgcactccagcctgggagacagagcgacactctgtctcaaaaaaaaaaaaaattgttatgtcccaatttctttgggggtgttcattattagtatataaaaagtgatgatttttgtgttgatcttttttttttttttttttttttttttttttgaaacggagtctcgctctttcgcccaggctggactgcagtggcgctgtcttggctcactgcaagctccgcctcccgggttcaggccattctcctgcctcagcctccctagtagctgggactacaggcgcgcgctaccacacccggctaatttttttttttgtatttttagtagagacggggtttcaccgtgttagccaggatggtctcgaccgcctgacctcgtgatccacccgcctcggcctcccaaagtgctgggattacaggcgtgagccactgcgcctggccttgtgttgatcttatatctgcaaccttgctgaactaactattggttttaagaatttttagtattttccttgggattctctaggtgaattattttattttattttattttattttattttattttattttattttattttatttgttttattttattagacacagggtctcactacgttgagaccaggctggtctcgaactcctgggctcaagttatcctcccacttttgcctcccaaagtgctgggattacaagtgagaggcaccacaccaagcaagatgttttaaatgttatttttataaccaatccttatttttatttattcacatgatcatgtcttcattatcactcctaatgttgttttttatgtctcctctctttttttctgttaagattcccaagctgtggtcttttcacaaaacacctagcttttatttttattaatcaactctacatctttttctgtctagttcattaaatttttttttttttttttgagactagtcttgcttggtcacccaggcaggagtgcagtggcgcaatcatagctcactgcaacctccaccttccaggttcaagcgattctcctgcctcattcggcctcccaagtacctaggattacaggtgtgcacctctacatccagctaatttttgtatttttagtagagttggggtttcaccctgttggccaggctggtcttgaactcctgacctcaattgatccaatcgcctcagcctcccaaagtgctgagattatgggtgtgagccactgcatccatcctagttcattaatctctgatttttatctttaccagtatttttatttctactttctttggatttatttatttttcttttttctagctttttgagttgagaccttagttaattttttaaacatttattgcttttgggtgaatccattggttatagatcccctgcatattgttttggatgaatactgcaagttttactatgtaatgttttaagtgttcttgtaaaagtttgcatctcagtatgatgatgaaaaagttctagagatggatggatggatgattaactacaatatgaatgaatgtaatgccactgaactgtacacttaaaagtggtgaaaatgttatgttacgtatattttaccacaatgaaaagtttgtaattcttgtttgagttatttctttaacccaataatatttatatacatatttaaaacttttcaggatcattttgtggttgctgttgctgttgctcttgttttatttgactattcttttttttgttttgttttgtttttgttgttgttgtttttgacggagtctcgctctgttgctcaggctggagtgcagtggtgtgattttggctcactgcaacctccgcctcctgggttcaagcaattctcctgcctcagcctcctaagtagctgggagtacaggagcgtgccaccttgcccaactaatttttgtatttctagtagagtcggggtttcactctgttggccaggctgatctcgaactcctgacctcatgatccacccgcctcggcctcccaaagtgctgggattacaggcgtgagccactgcacctggcctattcttttttcagccctaattttattacatgtgacttgtgaaggtgtcatgtatgacttctgttttttgagttttattgatttcttttgtgagctagtacatgtttaatttttttttgaaaattttgtgtgtgcttgaagagaatatgtattttcttattgggtaagatattttagattacttttaagatcaagttccttaatttttatcaaaccattcatatccttacttattttctatctgacctgtggacttctgagaggtgtattagaaatctcctaatttgatttgagatttgttttctctttatatttctgtcaaagctatattagtagatgcatgaatgtttgtgcctattatatcttcttggtgaactatcctatgttttaatatgagtagcctccttgttcttgttctttttattgtgttttgccttgactttctcttttttctttttttttttgagacaggatctcactctgtcacccaggctggagtatagtggcataatctcagctcactacaacctctgcctcccaggctcatttgatcctcctgcctcaacctctcaagtagttagaagtacagacatgcaccaccatgcctggctaaattttgttgcggtttttgtagagatgaggtttcaccatgttgtccaggctggtcttgaactcccagactcaagtgatcctcccgcctcagtctcccaaagtgctgggattacaggcctaagccaccacacccggtcctgaatttatttttctaatattaatattctcactcccactttctttttaaaaatatattcctaatatatctttttctagtgttagaattcatttttaattaataattctctaaggtttataatgagaaaacagtcccatactttatctctgattccagttcctagtgctttcccttccactttgaactttttcagttttttctgctgtttcctaccatattaaaaaataacatgctttcctgttattttttcaattttatgtatcacctattgacttcctatggaggttgaataaattcgttctttcacaaagacacaaacacactcaactttcctttcatccttccaatatgattaaattgcaacttttgctgaaatgattgttccaatgtttacattataataattatgcaaacacagttcacagctgatccatgtactgaattctgtttttatttcttttctcatacaacctttcttctcccgcggttgataattaccttgttttttgtttttttgtttttttatttgttattttcttagtttctattacgatatcctaaaatttattgcagaagtataaatttcccctcaatatgttttaaaaattagatatttgatcagtttctttttctttcttggagacactcccagagctccccatccttctgctcccatcctggctgctgaaggcctgatgcacagctgtcatcctgggacttccgtgcaccatcatccctgtttccggatcctctgtcttcctcttcttggtttattctctctttttgatggagcacattctctagagaagcaagagaggatcttgatcttgtgaggcctaaaattatgcaattatacagaatcacaaatggaaaattagacatcaaagaaatgtgggaaaagaaatcacaacaaactgcagtttttgaaaatggtgacaattaccacaaaccacaaaatccaggaaagtagtcgaacattaaactacatgacattgctttataatgattttctcctgaacttttagttgtatctctgaagacctttgtatcagttgaccttcaatcaaaagcagaagcagatcctgctagaaggatatgtttctctctctctctctctctctctctctctctctccctctctttaaatggatttgctgtagggcttcaacattacacaattgtggaagctgactaagcatgctttgtaaggctgttaccttgcatctgatgctggagtttgaagtctgcagggcaggcagggtggaaaggaagagggaaataaaactccagggagagcaagaacaagctagagtccaagaacatgaggtggaacctataaggacagagcagaactgtctccaaccttgatgatgtgggtgtcttgtgggagaagctggtgccctgcctcgcagagcttaacacacacctgggccaggagtcagagcaactgaaagaggatcaggagaagttggaggaggtacaagcccagctgctgccccatgcccaagaggtcagccagcaggtaagcaaccaaatggctgctgcctgtcttccaccctctaaatcaccttcaaaaatgtctctgtggctgggcgcggtggctcacgcttgtaatcccagcaccttgggaggccgaggagggcggattgcttgaggtcaggagtttgagaccagcctggccaacatggcaaaaccccgtctctgctaaaaatacgaaaatcagccaggcatggtgatgcacacctgtagtcccagctactcaggaggctgaggcacgagaattgctcgaacctgggaggcggaggttgcagtgagccaagatcaagccctgcactcgagcctgagccacaagatgggactccatccccaaaaaaaaaaaaaaaaaaaaaaaaaagaaatatcgtgtggccaccctacttggaaacattccagaaaggcaattctgaaaaaaacagttcagcctagccaagttaacatagtacaaagccactgtgcttcttcttaatggtaatggtttgtaataatttccagaaagaaaaataaaaagacaattcagtattttcttcagtatgtttgatcaaaatttgttttttattattggtgatcttgaagttataatactattgcagttttgtgtcccacagacatagggattctgataaattcgatttcatgtgattctcactcaaaaataaaaaaaaaaagtgccctgacaattaatagttttgctggacgtagaattctaggtttgaaactattttcccttagaatgttgaaggtgttggtctattttgcaatgttgaatacattattgacaggagagactgctggctttgactaaacgttaatgagaactgagtactctcctcgcaaatttctatatctaatgggaagggttttccctagccaagctttttggctctgtacatctcaaaatttgttttttctctactacccagctgcttcattgccaaatgccttagaacaagttcatttttgttttgttttgtttttgagacaaggtcttgctctgttgtcctggctggagtacagtgacatgaacacagctgactacagcctcgacctcccagtctcaagcaatcctcctgcctcagccttccaagtagctaggactacaggtgcacgccaccacacctacctaatttttgtattttttgtagagatgaggtcttactatgttgttcaagctggtttcttaacgcctggcctcaagtgatcctcccaccttggcctcccaaagtgctgggattatagatgtgagccaccatgccagcccaagttcatattgtgatacatttgaccctgacctttcatgtcacaatgcctgtgagtcagcccagtggacagcaagagtattcctaaatggtcatttttacaataggacaactaccacatggaagagaactgaggcgccccagtcaagacaattactgacccccagacatgcacgggggacatcctggagtctccagctctggctgagctgtcagctgacagcaaccacatgagtgctcccaacaagatcagcagaagaaccacacagataccagcctacaggactatgaaaaatgatcaatcatcttcatcttaaaccattaagttttagagtggtttgtcatgtagcaatagataactgaacacttgtaaatcatctaactggattttcaaaaacccaatttgaatgtctttcctttaatttataacaacttattcataatttcttatacttaatgatatgtttgggttgattcctgacactttgagttttctatcggccatgcttttttgcctcccacccccatttgtgccctttgttagataggtcaggttttatttatggtatttttcttcttacagtcaggaagttataaatcctatttccattcttcgggcttttctattcaagaaacaaaggaatatatctgtttcttcatctttctttggcgattgggtgtgcttcgggtttaattaggttgaattttacccatcagaaggaagctactgttcgtggcctagaaaacgataaagtatagagtaaggcaatcaaaatcaccacaggaaaggagccctgtgggtctgtctgtgtgtggatgtgtgagcggatggttattagaaaatggttgaggaatgcagctcatcagctgaggctcggtgctcatcagccacccatctgacactcatcaaaagcatcggttgctggagattgaccaggtgtccgcagcggcctgtttcttaccgtctgctttggcttggccaaggtttaggcagcttctctctttcctccaggcttctgaggtctgctttcctccaagcctgagcaagcataacagaaagtggattgtgaccccttatcagctcctcctgggaatcggctgaccctgtctttcctaggcacactcccgccagaccccaccccttgtgtggccagcttcccttccaaacgtttgcttacctctgcttgtcctctctttaccctgtgaaagaaaaagttatttctgtttgattttgagacactcacagatttctgagatgggagagttctccatattgcaatcgtctttctaattaaagcctctccctccctctctaattctggatttgtttttatttgacaaaatatagtcaccattttctggggatgaaaacttagtcaatatcagaaacctgactgcagtcaggaatagagctcattcacctttcttccctagaacttagactgtgcttgaggcatagtgggtacttctttatgtgttttatgaatgaatgaatgaatgaacgaacagatgctgaactcaggagacagagaaggaagctgggagagctggtgtctggcctctgcttgctccaggagctatgttctccctgttcacagctatagctgccagggattctggaaacacatcctgctgccatggaaatgaatgcagtcacagagtgggaacagttaagttacttttctgagagagttacatcatttagaagcagatctctaaaagtccttgctcctgcaggagttggtgactgagtggcagtaattgtgttcacatggttaactatgacagtgtcacatgaagctcaaataatgggttggaaacgcacaaatgattgctagttgcttgagctctctgctagcccttgccttgctctctccatatttactttctccagcttgcaactggatatacagacgtgtctctgcagcagcctggcccaccctattgactgaggcaggaagttgatctgcgggttgcagctgctcttgaggaagctgagtctactaaaatctgttcaccctttccctgacactgctgctgaggccggtccccatccccggcagcttcgctgggccttgtttatcttttcatcactcttgactggctctggcctatttctggatctcatgtctgtcctctgacaaaccctgcctctctgccagctttctggaatctgtcaatctgagaggcatgggaaaacgacattgcccaacagaaccagcatctcaatgtggcaaaaatagactcatccaaagcaatctgggcatacactaatgtccccagcactgaacatccccaatcactggtttcccccatctgattaattttttccccatagagaggttttgcaaacatttatgcatctttaagcattttagtgatctgattttcttaattttgatggatttttctttttttctttacctaaaaatatcatttgaatccattttcagctgattattcctttttttctgtttgtaatagcaacgagctagaaacaaggtaattatccaacaataaaagacattttccctccactttgtgtgctctttgatgctcatgctgcaggccgagggtcacttatatcctcccactggccttattgctggctaacccgtgacccggtagcctagccctctgtctttcctgggaatctcttccaaccagctgacctctgcctggtccttcttagtttgacagagcacctgtttgttcctagggtgccgaatggagcactgtccttctcctggataactgatgacaaagatgcatccaacctgcacacgcaacatgctccctcttccatgaatgccggttgcacccgatgatctgcgcctgctcactctacctgcctccctgcccagggcagagaactgaggatgttatgttagtgaaatcctcagatcactcacagcgcagaacactccccaacttctctccatcatgtgtcaggcccagaagcagttacaatcattacaacatcacctcccacctttccatctacacggttgaacagctgtgcattagtctagaaaagtcaccctgaaaactggctctagtttggggaggtgacatgctcttgctttgtccccagagatgttcttctgttgtccttgcagtgcagggagtacctcctgggctgtgtgcagcagccctgcctgaggtaggggagtgctgttcactaatatagatctgaatctcaccagtctaggaggggacaggtacttctaagtcaatcaatcaatcaatcaatcatcagtcaatcaatctttcaagttttctcatcttccaaaaagacactaatgcccagttgaaagtggtagccactcaattcacctgggcttatcacacaaacaaactctcgttatcatattttttccttgatgctgtatgaaactgagtgaagtcacatttcctgattcagaagttgcaactgaaatggcccaagtgggaacaaaaggggaaattttgataacagatgggttgaccctttatggtatagagctgattctgagaactactccaacaagcatgcattctaaactctatcaagcaatgtgtggaatcacggcaacaaaaacatgttctccctagctcttaagtattttttatttggaaaatggagtttcaagttgttttcctgacttctatgaagattgtgatgaaattgcagaatatataaaacaaaagattgttgatattgtgttcaaatgcaaactagactgctcatctatctgcatatttggcaaatggtgcaaatgtaaatattggaaaattccattcagtctataaacttaccaaaggaaattttaaaaatttcctgctaaacgtcctgacccctctgtaccttttacataacactgctaaaaagaggtatgatttgcctactgtgacattgacagtttcataatgacatttttggttagttttcagtttcctcaaagcatgcagaggcgctttatgagatttttgatttttatgggcgtggtaggagatagccttcttagacatgcctacaagatgtcttgcagaaaagatgttagcatgttggcctactataaaatcatattttcaaagtgtaggatgagaagaatgtccttcactactttggaaatacattgaggatgagaacagagaaaaggattactgtaaaatggaaatttatatgccgtttctccaagactgtttcataatctttaaaaaagctacagaaaaggatgaactaagtgcatctaactcgttccatttaggtgtaggttgtgacaaaaactcatctagtgaacaaatgactcatttcttggaaataagactgctttgaaacttaaaaaattatcactaggaaaggacagccaagttaaacaggattttctcaatttctttactaaaactgtaacttatttggaatccagcttcaatttcacaagttcaaagtacctccctgctttgaaaccattttttccagagaaaagaggcttaccttatgatgacatccaatgtgctttgaagtgttttagaatgacagacattttagacatcgatagcctgtgtgattaatttattgaagcaaaagaactgattgacgaacagctggcctaccaaaacaagcccatagatacaggggatggacatttatggagaggtggaaattaactcctacaagtctaaaaacctgctgttgctagtaaataaaagcctaggtactccatgccctcacacagtattgttgagaagctatttagcattgtgttatcacatcagactgacactagaaatcagtgtaatgtgggcttgagaagagcagagccgcaggccaaagtgaatgttatacttatctccattcagttttatcattgcataaaagaaaggatgggtgtcataaatgccacaggcaattcagagaactattattaagacaggaagctgaaagaataaaaggcatcttactgtagcatgggacagaaggaaactgacattaaggcatcttactttagcatgggacaggaggaaactgacatttttaaaaaatcaaatatatgaaatacctgtttcatcattcctattctattttcattttcctttttaattttttgccttccttttttttattcttttccaacttttaagtttaggggttcatgtgcaggatgttcaggtttgttacacaggtaaacgtttgtcatggtggtttgctgcactgatcatcccatcatctcagtattaagccagcccagcatctattagctattcttcctgatgttctcctttctcccacccctaccctctgacaggccccattgtgtgttgttcccccgatgtttccatgtgttcccatcattcagctcccacttataagtgagaacatgcagtgtttggttttctgctcctgtgttagtttgctgaggataaaggcttccaataccatccatgaccctgcaaaggacatgatctcattcctttttatggctgcatagtattccatggtctatatgtgccacattttctttatccagtctatcattgatgggtatttaggttgattccatgtctttgctatcgtgaatagttacgttttcctttttagaagtcttatgtttatatatcttaataatataaaataaatagcctataaaccttaaatattcaataaggacttttaaaaagttaaaaacaaattgccatatacaaggataaaaacagtgtaaaaatattgttttattttttcacacatatttaattggtcttactattaattgtcactacttgttattaactagtcctattgtctggtttaaataacatttatataacagaaaggtaaataaatcagaatatataatttcaaataagcacctatcttccatattttatggtaatattttaaaatcaatggcacatccgtgtataattatttattatatatggtattatggcttttgtattcgtctggcatggcatggcatggctgtgtcccgggttgtctttctaaaatattggtgatcctgtctgtcacttgcatcatgtttcttttttcttcatcatcttcttctttttttttttgagatggagtctctctctgagcccaggttggagtgcaatggggcaatcttggctcactgcaacctccgcctccgaggttcaagcaattctcctgcctcagcctcccaagtagctgggattacaaacatcccccactattcctggctaatttttgtatttttagtagagaaggggttttgtcatattggccaggctggtctcaaactcctgacctcaggtgatccacccacctcggcctcccaaagtgctgggattacaggtgtgagccaccacgcctggcccggcatcatgtatctatggttccatccacatggctgtcgtgcatatcagtagctcaatcctttagactgccgagtggtgttccattgtatggatacaatgagcccctggtggtggtggtggtggtggtgtttttatccattcactagctgatggatatttgggttgtttccagttcttggtgattataaacatgtgcataaaggttcttgtgtgcacatttttatttttcttgggtaactgcctaagtgcagaattcgtgggttatattatgaatgtatgttttactatgtgaggaactcccaattatcttcccaagtggctgaaccatttttgcattcccaccagcagtgtatgagctgctttgcatgctagttagcacttgataatttgtttcatttttaaaaattttcagctattctaatagatgtgtagtggtattttcttattttaaaattttatagcagtcattttgattggcattcacaactgcctcagagggaaccaagacaaaaagaaaacataaagaaagaaaattctgcctgtggagcggaagaatgggaacaggtgcggaaagggtcccaggaatgggtatgacattgagcatattctgggtaaaaaatcagctttggctgaggaaaagtgccccagggaggtggggggttatgtcaaccagactgccccctctcccagagctcagacccagggctctgagagtcctcaggtcttcgtgtctcaagaggaaaaaaggagttggggtggggggagggcagaaagagttctgccctttattatttattatttatttatttatttatttatttatttatttatttatttgagacagggtcttgctctgttgcccaggctggagtgcagagacatgatcatggctcactgcagcctgaaactccctggctcaatcgatcctcccacctcagcctcctaagtagctgggactacaggcatgtgccaccacgcccagcaaattttttattttttgtagagatgggcttttgccatgttgcctagaccaatcttgaactcctaggctcgagcaatcctcctgcctcagcctcccaaagtactgggattacaggtgtgagccaccacacctgacccagaaagcttatttttgatgggcagtgtccacgtcaccatactgtgagctccatgaaggcaacccatcgtcactcttgtcccctgctctgttcccacacctggcttactgcctgtctcatggttggagcccaggaggtacttatggagtggatggaataatgaatatttctagaccgctgaagctgctttagtgaacgtcacacagaacagtgactgcactctttctgccagtctagtgaaagccccctttgcttgccctaggcccagtttatgacccatcttgtcatttcttcaccacctctcacacctgttcactttactaccccttccctcaccactgcttcttctctgggctgttgacatagcctccttacaactctcacagcctcccccagtcctcttctgtcccccagtttctaatctgtcttatctttgccagatgttggattcataagccttgctcttatcctgacctgtcacatcaaagcccctgtactggctcttgatatccacaaaagaagagccaacaggaaactggccccagctcccttcctatatcccagctcccattggccctctggagggctcttgattttggtcaaagtctatctgcatgtttgttgttgttttttgtttgtttgtttgtttgttttttgagacggaatctcgccccgatgcccagctggattgcaatggcacgatcttggctcacagcaacctccacctcccaggttcaagcgattcttctgcctcagcctcctgtgtagctaggattacaggtgcaaccacaccctgctaactttttgtatctttagtagagacggggtttcaccatgttggctaggctggtcttgaactcccgacctcatgatccgcccatctcggcctcccaaagtgctgggattacaggcatgagccactgcgcccagctgccttcatgtttttaaaactgccctttcctgctgaaaccgaacctatcctgtctgcatggcctctcaaaagaacgaaagaaccagggcttcgggatcagagagatgtgggttcaaactctagtcacctatttcctaaccaaggggacattgaaaaattccttaacctgagtctcagtgctcttttctctagatgggcaataaaaagtacctacctttacttgggaggctgagacaggaggatcctttgggtccaggaagttgaggctgcagtgagctatgaagcaccactatgctccaacccgagtgacaaagggagacctcatctctaaaacaaaacaaaacaaaaaagtacctaccctgggtttgtgtaaggagatggtatgtataaagggggcctggcatatactaacaatgtaggaatttaaaacatagtagatatgatttttggtaattcctgcctaaagaaaaaaaggctaaaaataagggtataattaattaattgttttctaattctttcccagccgtaacactgaaggttgcttccctagggagggaattacctgggtagagattaagtgtgggtgctgctgcccccagcctaatgggtcacatgccctaaagagaagctggtcagtcacaatgctccctccagctcctctctaccttgggatagaggcctcatgggttaaaagaccaaccaaacaacaacaggacacaatagagaaaatagccagtgagggagaactttttcatcctttcccacagacatatgggatcatttcatgtgtgaacatcatgaaggaggaagacaaagacaaacagaaagtggtcctcctaactgggtgctccctgagggagaggcatgagcctgatgatgattggagattgctatggtttgtataatagtgtctcctctgaaattcatgttgaaacagaatgccccatgcaacagtattaagaagtgtggtcttgaggtcgtgattgagtcacgagggctccataatcataaacggatagggttagggggttagggctcttataaaaagacttgacaggccaggtgtggtggctcacgcctgtaatcccagcactttgggaggccggggcaggtggatcacctgaggtcaggagtttgagaccagcctggccaacatggtgaaaccgtctttactaaaaatacaaaaattagccgggcatggtggcaaatgcctgtaattccggctacttgggaggctgaggcaggagaatcacttgaacccaggaggcagaggttgcagtgagcagaaatcatgccactgaactccagcctgggcaacaagagtgaaacaccatctcaaaaaaaaaaaaaaaaaaaaagacttgacagatggagttcactcttttactgcccttccatcccttctgctacttgagaccatggcattccttccctctggaggatgcagcaacaaggtgccatcttggaagcagggaacagccctcagcagacataaccaaacctgctggtgccttgctcttggactttccagcctccagaactgcgagaaaattaatttctcttttttataaatgacccaatctcaggtattttgttatagcaacaaaaatgaactaagacagagttgctccaagaagaagacgcttaaaacctttccaaagcaaatgggtctccttggagtagaaagctccccaacatcaatgagattctagagggaacattatgatcacatatcagggaagagagtgaagcttcaaatgggctctgattagatgctctctaaagcccagcttcattctgggttctgcaactgaagaggctttagggttaaaagggcttccagttgcttgaaaagcaaaaataaaaagaagaagctcatatgtcaataaggtaagtcattaagaaagtaggtgcttttaataccaggtaatgtcagcataagaatatgtatacaaaggtgggttatttttagtattggttgaaggcacattattcttttgacaattagaataaagaaagcaattagaaactccaggaaaatgaaaagctgtgcagaaaaagctgtagcccaaatataaagcaaatgaaatgtggcatgtctttgagcagctgatggagcataagaaaattgaatacatttgaccttgatgctaaggaccccttctgagcagcctgggcatcatgacattggatcagaaaggaaagaaatgtaattcttggatattccttggctcagcggtgacagtgaactgtactcacacaggcatgagaatgtaatattggtttattgattttttcagagtcaatttatggacaaaatgcagctgttataataatgacttcagaatagtatctaaatgttatcatcatttaaaatgtaaaagtaagactattaaagacttgagagatagaggagagatagaagtcggtttcttattttacatagtgggaagtcattcgattgtatcttcactctatggagtaggatgtaggtctattacttagagctcaaaggtaaccagtggaagaaccaagaatattttaactcgcaaaaaccaggaggaatgaagagtgatgaaagggagccatgcgtatgaactaaaaccttgtttttcccagcagagtgaatgagtttcctaggactgccataacaaagtatcaaaaacagtgtgactcggccgggcgtggtggctcacacctgcaatcccagcattttgggaggccaaggcgggcaaatcatctgagatcaggagttcaagaccagcctggtcaatgtagtgaaaccctgtctccactaaaaatacaaaaattagccaggcttggtggcaggagcctgtaatcccaactactcaggaggctgaggcaggagaatcgcttgaacttgggaggtggaggttgcggtgagccacatcgcaccactgtattccagcctgggtgacagagcaagacttcattaaaaataaataaataaataaataaaaataaaaaacagtgtgactcaaacaacaaaaatttatcatctcacagttctggaggctgaggttgaaatcaaggtgtcagcagggttggtttctgcaggggaggatctgttccaggcctctctactaggatctgttgcttgctggcgatctctggtgcttgcagatgcacggctccaccagctgctttcatctccattttatgttctccctgtgtcttcaccttgtcttccttctgtatccaaatttctcctctttatgaggacaccaagaattctaaattttgaatttggccttccacgtagttattaagacacatttgtcatggattggagaacagaacatattaaatcttttgtagaatttataactttaaaatatttacacatatggccagatgtggtgtctcatgcctgtaatcccagcattttgggaggccaaggcagacggatcacctgagatcaggagttcaagtccagcctggccaacatggccaaaccccgtctctacaaaaatacaaaaattaaccaggcgtggtgatgggcacctgtaatgccagctacttgggaggctgaggcaagagaatcacttgaacccaggaggcggaggttgcaatgagccaagatcatgccactgcattccagcctgggcgacagacccaatctcaggtattttgttatagcaagacaagagtgagactctgtctcaaaaaaaaaaaaagaaaagaaaagaaaagaaaataggccaggcgaagtggctcacacctgcaatcccagcactttgggaggccgaggcgggtggatcacatgaggtcaggagtttgaggccagcctgaccaacatggagaaaccctgtctctactaaaaatacaaaaatagctgggcgtggtggtgcgtgcctgtaatcccagctgctcaggaggctgaggaaggagaatcacctgaacctgggaggcagaggttgcagtgagccgagatcgcaccattgcactccaacctgggcaagaagagtgaaactccatctcaaaaataaataaataaataaataaataaaatatttacacatatggtatatgggcctccaattattcttttgtcacaggccctgcaaatgttatgggcaggcctgacgtgtgtaaccacagccgaagaagaaccagaaaccatcagttgttgctctggagagtgcataagagaaggcgagggtgggagaaggaggatcgtagtgttttgttagaggcctctctgtcaatgtgatgctctgttttgccatttgcatgcttcacttcaataaaacttatgaaaattatccaagttctcacctcctcccttgagtcttcctgatccgcagctctcacctctcttctctcagcttctacaaccctcagcagctgtgccgccttctgtcctgcttggcctgctctcccagaggcccctgaagacaataccacctccccaggcccactggccacctgtcttcttgtctcccccgagaggttccctgggctgaggtcagcacagcctgcttgccctgcctcctcttggtcagcattctctgccagagcttctctcctccctccatctctagcctggtgctcccacctgtacctcctggtagcccctcagggttgggagaaggccaagctctgcccacagtctctgtctggtggctgggggtgggtggggaggtgttgcatggaacagcgctgcagcctcacctcttcgtgagaagcaggtgtctgccaagccagatgggtttctgctgtcagtgagaggctccaccttcctcctgactgtcccaggcctttgccaccactgttctctttatgtctcagtctccctccctcccccttccctcaccctcgctttctgctgggtccccccgtttctccttttctctctctctgcattaccctccaagccctttaccctcaattccatcttcccctggagcagagggattattgtgactcccccattccagaccccagatcctgcttcatcctcagggttaaactaaccctgccccacccactcaacctgcacccgcgtctaatccagacccttcatgctgacccctaacaaatggcccttggcccattcctagtgccccacagctaacagagggtcgtgatcctgaccctatagcactggttccaatctagaactttaaactgaacactcactgtcattcataacactccccagtcccacccctaccctttgggaagggctggggctgaaaactcgaggtctgtgatgtatcctgggggtgcggccaagttctgcattcctggaaactgggactggcttggggaaaaacaaaaataattcctatgaagtatgcttcaattggtgctactgctgaaaatagtccctgaggatgaacatgaaggtcaggagagagcagtgggaatggtgccaggagaggggaccagaaaagtggctggagatggccctgagtggaagggcagtgacagtcagcagggagggcttaggaggccctgggcagacggaggagggaggagagaggggggcaaaggctccagctggaaggtcaaggttattgttcattcattcctttgttcagcaactatttgttaagcacctactaagtggcaggccctttgctgggcactagggggatagcagtggacagaacgaagtacccacctgtgtggagctcacattcagattgcggagatagacaggaaacacactaacagagatgtcaggggaggggagggaagaaggacaagtaaggcaaggtgaggagacagcaagggacaaagactgtttatatagagtggcctgggaaggcctttctggggagctggcatttgaacaaacctcaaaagacaagaggaagggagccctgcaggtgtggacagactttgtccagttagaggaaatagtaggagcagcagccccaaggtgggagcagggcacacgtggggctgcacacagtgagcagggccagagcaaaggggggtgaggccagggaaagtggccaggttgcccaccaaggctcacctgggttcctaggtcagagatcctgagaagaggggagaagccctcatgcccaagtggtgggaaggggtggaggagaatggggaggaaatgggagtgaggccaccccaggtaaggtcagctgcaacctctgggctagggtgacgccagaagagaagatagggcctgcagtgcctctcccccatccacagccctgggtgcacatgccacgagctcctgctcactccacctcacatccccacacttgtgcatgaacaacacacacacatggagaatagtcacaggctcacctttcacatgcatgcacacagaaattgtgcatgaacacacgcatgcacacgggccccttgtgttagtgtagacatttttgagaattctaaacaggcagaatataggggccaaaggactttagaccaactctcacgtatgacagaggcactaaggcctagaaaaaggaagcctcataatttggtgacctaggcagatcactctatgtccccccatgcatgtgcatgttgtgtgtgtgtgcgcgcgcacacacacacacacacacatgcacgcacgcagtcccaccagctgtccaaagctccttccataaccctatcttctcaacagcctctctctcccaggacacccacaggcttaaccaagtcccaccaggagtgccccgagtttcctcccagctattccagcaggctgctggggggaatacagtgtcgggaccaagatagactctgcccctcttggtgggatggctacagcccacaaccacagctgaccacagcagcccccgactgcctctctcctctcagagcctgtttccgggttcagaccttcttcctccatctctctttctgggtctttctcccttgcttcctttctctacctccagaaaggaggctgtgattctctgtttttccctctctttcctggtgtctctctcatttctctgtttctctccagttttctgtctctgctgggcttgtccctctcgctccatcttctcatcaggatctttttttttgccttccaggaaaagctgacgtggtgcccctggtcagtgggagtgaggccttctggggtgggggagtcctggttgagcagccacagctggggtgcggctggcgccctggctaggggcagcaggagcaggagcagagcgagaggcagcggaatgggaggagagagggctggacctctgcaggcaggaaggggagcagggggaaagaaaaactgtgggagggagtgagcccccctcccctgctagggtgaccaactgtactggtttgctgagactgtctcgattttagcatggaaagtcccatgtcccagaaaacccatcagttccaggtgaaccaggactgttggctggtcaccctacaagctgccagggacccacaggagacagggccaggactcacaggaggggctcccaagcttggcctcctagttctggggacagtcagggccgcacatactcaccaagggtccccatctcaggcctgagcccaatttagaggaggccaggagaggggagatggcagcccagacagcccacaggaagctcccagcctgaaaagatcagggagcccgacttctgacttgtctccctgcctgctggcatgatctcctgtgaggtgggctttacagaaagaacttgagctctgacagcaagagaagagcagaggggcaacccaggaggtcatacgccccatcctcagaggcctgcacaactgctcctgggctctgctgaggagcaggcccacctgtcccactgtgagacaccttggagagtcaatagtccttggctgagatcctggcggccttattgtccttcctggtggaagcgggtatggccacaccttgcaggcagtggcaggacctgagcagaccaggaagatacatcagtgaccagcacgcacagtctcatttctgcccaggtgggctggtccctcccacttttcccgccctcagccccccacatctgttttgaggtgggagtctgagcttagtgtttggctgtcattaaggtcttaggtagggaatgaggggacagactccctgcccccagaaggctgctgacatactcacccacccaacagagcatgggtctcctacactgtatgaaatattctctaaaatgtcttgggcatgccccttccctagcctgggcccaaaggccctatctgtaagttgatgaggagatgaagtgggtgagctctaaaatgcttccttctgatgaccacccaacttgtccatcatgccatgaagggggcgcttacagagtgtcttccctgtgctggagatcaatagcacctgggaagttaaggcctctgccctcagtgggcttcctctctagtaaggggtcgcacattaagcacgcatgaataaataatcacagcttataggaggagctatgaagaaaagtcaggaatgtctgagagaacagtcactgggaactgagggctgaggaggtgcttgtactctgaccctgatgtgcttgcaaggagggaggtggggtgggaactatgagctcctcagagcaccctggaggtaaagctggtggcacagactttgtgcaggtgagggtgtgtgtatgggctgtgcagaacatagtgaagccccctccaccaggaagccctccctgactgacactgaggtcactgagtctcccctctggtttactgaaccctggatgtgtttcttgcagcctctggttggcccaccaaattcaggactttcctagaaattctccagcacagtcaggatgatgcaagagagggcttcctctgcaggggaaagagagggtgctctccattggaccataataatatcctcagcatcagactcgggtgttttgcaggcagcatgctggggacttctgtggccttgcttggtgacagggaatggggtgtgatgagctggggcaggcttcctggggatgctttcagccaaagatgagccctgtctgcccttggccctgctgagagggtaagttgagtcatgagcagaattcaaccagttatcagatggaaggccaaggaagcttggggagggctactgaggggatacggtaggcttgtctgtggagagcaaaattcttcagtctacaaagttcttttctgggctccttcatctttcggtttctcttccagctccctcgttttgggcctcttttgtttccccattcccctcccctgggccttcccgtttggaaaaggggtcacatatcctcaccctggaggcgtctgccccttccacacagttggtgttggaacagtggagctcagagaggccgatgctgaccgcgtagatgtccagcaccaacagtgggattttgggccctgtgggggacacagagagaactctccgggagtgcggccccttggcctcccctctgggtgcccagtgggcagtgggcctgggtggctcagaatcccagccaggagcactgaaggtcaacaggctcccgccctgagttttctgagccaggcctccctgtttcctccccagccagtggggagcgcagtgaggggcggggcctggagtcttgggagctccctggacaacaacatgcatttagcgcagctcagtctcagagccagcaggatatgttttcttaaaaaaaaaaaaaatgcctaacatcttggctttcaccgaagggttggtatctgctttgtacactttggccttcttggcttttcactgaaacacacacacatggatgcacactcacttccacacacaaacccacaccaagacagacacacacacacactcacacacaaactcatgtacatggtttcatacccacatccatgcaaacacacatacaaatccagaaatacgcaccctcacacccacaaacttgtacacacacacacacgtatacacaccaacacacatacaaccctggcttggacaaaagcttcccgttttttcttgtttgaagtggaaatctcccaccttccatgagattcaatttctcgcccttcccccgctaaaatcctcctggccccatcatttcttgggtcctttccagacagtgctgtgtctttaaggaagttgaagctgctaaaagtgagtgagagagagagaaaaaacacaacccaaaaaaatttggcatctcttcccccctcaagtttctggtgtcacttatgaaacacaggtccttgttgctgcagagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggtaagccagtggggaggagggctccagggccagcggcgggagcgggaggcctgttggacataggggctggttccctcttggtccatccctgctggtctgaggtgcgtgggacaatccctagcttggagccgtccagggggcatctgcttcttccacaacccacaactgaggccccagaaatcccagctgcgtttgggctgagcctctggcctcacccaagtcagctgagaggtcctggcgggggtttatttaggcagctgcctggctaagtttgaacagaacaggccacgggtgtgattccacagaaaaggcctggtgtctgctgcggtcatggccggaggagcgggagagggcgggtggagtggatgggggtggtgtgcactgcacaaggggcctcgtctgggccaaggcaaagcatacctatggggggctccggtgggagggactgcggccaggatgtgggagggcagggggaggttctgcaaagtgctgggggaggggggtggctggaaaacagatttcaagtcataaagtcagctaggaacaggccgaggcagggagaactctccactcggaggaggagctggggtcctcttccatcccgtcttcatcctgcctggctgcgtgacctcgggcaagtctccgcccttctcttggcctcagtttctccttccgtaggatgggggcggtgggctaggtggtgttgggatttagctgggttatgtgggacagggcctcctgatgggaaagagctctggctgggcttgtgggaggaatgagtccctttggcaggttctcgggatcccctgggtgacatgcctttctctgcaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcccctccgtgtctgcctggaattttgtctggatctaggagcctctgctgggagataggatcaggagctgaagagtcagggcagccagcctgcctgcccacagtggcaggggcctctgagactccaacagactgtggaggcacaggagtgctggcccgatgctgtgtcaggggctgggccttgcggtgagctgagctgcagatgttcccttcctccaaaccatcccacaggacagctgggggcaggagcctggggtggctggcgaccctgagcagcgcctgatgtcagcagtggcttcaagagaggcattttggaaaggcgcaaggaaatggaagtgcctgggtggtagctcctcttccctgtcctgctcctggaagagatgttaggaatgaagaggaaagaggggacaggtggggcaagatggaggagacagatgaggagaaggggacacaggacagaggaggagaaagccccagagagactgggaataagagaacatatttacatatttgagggagaaaccaggggggaaacaaatcgtacttatctttctcccaaagaagaaatggtattccaagaggaaagtccaaatgaggactgcagattccctgtaggaatctttccccacagagcaagtggatcagtaactggcctgggccgtgtgtgtgtgtgtgtgtgtgtgtgtgtgtgtgtgtgtacagcaacctgagcggtgcgtgtgtgtgtgtgtacagcaaccttcagcctctccagtgcatgtgtgtgtgtgtgtgtacagcaaccttcagcctctccagatgaggagcataaggatgaggtcctaacctggagactctgcacaacctcctatctgtgccaggtaggatatatgtcttcctactgcctctatcccatccctttcaagatcgaggatgctgcatgcagagacaatggcctgggggagaggctctgtggcctttctccagagctcccagaactgctgagctcagcaaagtggaggcaggatgctaaggagtctggggtagcagctgtgagccttggctgctggccagccccattccctccctccaggtccacatacagcacctccccctgcccactctcccctcatcaacttgcagctcctgctgagctgatgtcaccagcagcatgtatcaagaatgactcctaatctaaaataaaagttgaaaaaaatgactcacgtctggtggaaaacagcaggatggagccaaattccatgcgctaggccaccttgggtaagtcattgcccacgtctgggcttcagttgcctcaaaaaccaaatgacatggtaggactaggtgctacttcatggtccaatagactctgattgcctaaggcttgatattcccagcctgacttggacatccctggctccattcctagctgagtggcttggcttcttggagtaggacatggacctaagacctaacacagggaatggctgtgccttgagtggactagctgctcccctgctttaaggtcttccgtggtccccactgccctccaggtaaagcctgaattccccacttagagcctctctgacctgctcctccaacaagcgcacccttccttcctcttcttggaacagctatttaattgttcccttaatgttccatggtgtgccatcctctgcacctttgcttatactgttccctccgcccaggcaccctttccctgttcttcatttggctaagtcagtctttgagagtgggctctggcatcaccacctccagaaagccttcctggatgttcccccatccccaatgtgaacaggccccctttctctgggaacctggattctcctcccctgagaccctgttagttgctgaaacaaggtcaggaagcctttttcaacgggctgcagtgggatcacagtgtgccctctttggcctcctcggggcagccttgaaagtgggtttcaggtccctgaccccacccctggctttacaggtatttgaggctgtagcaggaacctgagcttggggcaggggactgttgatctccactaactgtgcaggcatttctcaaggccctgctgacctagatctgtagggtggccacatcttcctaccctctgtagcccccagcccctcagtggacccagggcatgttctttattcatataccccgccctccacctccaccaagcccccagtagggaaaagaccccagtctgtctccaccctcctttcccctccgtattctcattctcctcccatcaggacagcctacgctatgtccccccatgtgacacgccccttcctacctccacacctggagtcacactgcttccccagcattcctgaagtcgcttctcctccccagatcctgccccttcttcaagacccagaataagtcccacttccaaagccagcattcacatggctcaggggtggcatcatagggtccccagtctctttgccacccaaaaggatgcagctatgggttctgccttccacccagtgtctggcccagcatgtgaccagaacaccccaagccccatccccatcaatgcacagtgttcctgacagtgtaggcggggttttccctgcatacccctcccgctatgaggacagtttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcagggg
